United States Patent 8,781,750 (CELL-TYPE-SPECIFIC PATTERNS OF GENE EXPRESSION) - sequence listing, part 45

SEQ ID NO: 37870 - DNA, 341983 bp, Homo sapiens
gcactgctttgtctcctgggagcaggtgagtcctgggcacaggacagcagccccattctcagctttcccacccctgtgtcctccactttaccttggggaggacctccaggctgtccctgtgctcatcctccatctgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcagcttggcacagcccatcagagtcactgacgttctgtatataaacttcctgccttagctttgccttgagagctgcaggccccacccagatttcactccttcaagggaagcttttagttgtttggaaggcatgtcttgtgtcctactgagggcagagctctcccaaccaataaagcccaagtttcctgtgtcctgagtgtgcccacttctgtgctgcatcttcttgcagcttgtcacctcagtacaagagtgactgctgagccccagatgtgtgcttgattatttgcatttcttacatagcttaatgcctttcaacaatcttgcacatcaaacattcttattcttcctttacagatagaaggctcagggacattgagtcattttccccaatgtctcttggcttgtaaggatcagaagtaggaaacaaactagtccatccattttccacctacccccctgctccatcatcatcttctgcatcctggtcagtaaatcagagccctcacactgccgtctagtgaccagcagggccgcagtagaggctgaaatgtcttcaggggtcattactatgtccttttcattagctcctttgaggaatgttaaatttcacacattttaacaatcatttatatgcattccctttgtctttccccagtctgcagcttatattttcatttttatggagtttttggtgcacaagagcttaatttaatgcaacaaaaactaaaaacaattttgtttgtgtgtagacaaaaaccactttttcatataaatgtctaagcatatttttctcaacttattctactaaaatttaagtttggattttcaccactaagaataaatgtacctgaaatacatctcatgtaagaaataagatacagacctaggaatgggagggaaggacatatattcagtgaagaaacaatagcttgtcaaaaagagccctaagtggacacctggagctgacggtggagaggtaggtggagggcaaatgagcatgaactttgtcagtctattgtcttgtagaagaaagacagccaggagcagagaccatatgggtgaaggtttatgacttgactgtaggttgaaggttgcagcaggtagagggagaattgcaggcagagggcagagtcactggctggcaggggcagtggcatcatcagttgactctactgacatctaggatttatgtccccaacacacaagctgaaaaacctccccacaatttccccatttttccctgaccctaccatgaccaccagactcctcagtggtgtggccttttgcctacttggggcaggtaagatctttaaagccttttccttggctcaccacatcccagcttaagcctttacctcaggtctccattattggggtccctccttgggcactcatcttccttctatcataaacctcacagaagctgggacaatcaaatccttaagataccagagaacaaaggcagtacatgaagtggcacggagatgcctgagactgtcatccatgactacatgtgtaggtgttaataggagctgaacctggtgtacagctgatctgtcccagcccgcaatacagagaaatccctgagggtctgtgactttctctcaaagccaaatatgtggcctttgtgtcagcctctcccagacctctgtgccctcttgcaccagcagtcaccccacagccaccttcctctgcacacaatgttcagtggaagatataggtggccttgtcttcacgagaccatgttctaggcagtggaagacgttttcccataggagtctccccaacactgcccaggctggggccctcagatttctgagcatccctgtgcatgggaaactctgccctgtgttgagcttctctcccaggccagtctcagctggacgagggaacgcacatcacagtgatgtgagcagttgccgcctctctcccaggcccctcctccagctctggcctcagaagtcctcttcttcacttgctctcagaaaggaaagttcatttgaaattgtatatttgcagacagcattgacaacttttccccgtcggccttcacaactccatcttccccacaccatgctcatgtcagtcctcagcctcctccacatgatgtctgctcccagctgtcctctccctctgcaccttcacctccacgtcaaccacagatgcctcagttcaggacattcctcatgcatcatgctcctcccaccaaaggcctttccactccatgctgtattctctgtgtcaacacaagtctcttcttctttgttcttgctccaactgtcagtttatctacaaccatctctagggagacactccttcaacagttttcctaggctgcacctccttattgtaaatgctcacagcttataatatgtattaaaattcatagatttagcaccatagtcattttccatgactttgtgtgactatttaattgacactactcttgcattctagactgtaacatgcatcattttacaaattgtggatgttttgttccccattttattgtcaggaccaacagcagttccaatcttgaaactggccaatcttgaaaaatgaagagcagatattgaaaggccgtctgagtacccacttagatgtctggacgcattaaatcggaacctctatcccttcatctcctaggatcaaatgagtcctggaaacagatgagaaatccctgtcatggataagtaactggatccaagcctttctgcacgactgaatttcctatctgccctatcgccttcctgcctaatctcctccttcaatctccttccctcacaggtgtcctggatttgggagtctcacagacacagcgcacctaatcactctgagagagtgatcagaaacataatgtcaaacactgacattaaaaggtcatggagaagaaaacaaatggcttccccatgctcttatggagagttttcccaaggcacaaatatctctttgggtggctttgaggtcatggtgcctgacacactgagcgatattatgggtgtccatttccatgaattggtgggcaatgtcagagacacagagttcatggtcaccagcttcctccagcccacacctgattttggtgcagggcgctgagcagagacctttgcttgttaccctcctttgccagttaggaaaggctgattgagaggcagaggctccatttacagagcagggctatgtgttagtccctgaagaattgtgagagccattctgggtggaaataatcaaatatacaatccccaagaatggcccacggatagacagaagtcccaattttgccagaatgatttgcatctatgctttgaagacaaatgcagttttatctctttaggcaataaagaccaaaaatagactagttattttaaataattgaaccttaaacagaccaaagtcagaacatcttccctagggacagcattttcttccacccactcactaaagctgtatttgagaaagcagtgtgctgttgataaacgctggaatatcgttacaatcgacattgtaataatactgctacttggatcagaaacaaagagcatttctaaagcttgaacaatgtaaaactggaaacgagctctcactgagtttggaaatgcaggcactagagggtgctcatttctcttccttttccaatcgggggctattcaaaggctgttctagaacaaggggtgagatcctccacttccccgtggtgatcaggctttcacaggtagaagccttattagttcataatcagccaagctgacctcaccatcaaatgtatcgacctcgatgctcaccctcctcagcagtcagagactggctgtgttcaccaggagctcgtgtgtttttacggagcacactttctcctcggtttattaaaaacaaatgagcctttatacggggttccataaacagaagctttctgtactttgcccatttagacactgcaaattctgatgcctgatgaaaagtgtaaacttaaagcttgcatgtcgttaagattttttaataaccaatttaaataatatatataatgaaaatgtcaataatgctctcgaatccaatcccatgttccattggtaaccaatattaacgctctggtgtgcttcttttcacccctcttttctgtgttcatgcacacctttctacccaagtacacctacagaaaatgggttcacctgtacactttaactgccaaatgtgtactcttttctgtatatcttggtctttattgttccagattggttgatatagatctaacttgctcctattatctgcttcatattgcataatgagggtagacaggtacattcatgctgtattgtctgtttcctaaattctgccagatcttttctaaagtgaccaaatggcatctttacgcttccaggttctcctcaccccagcacccagttgatgattccagcttttccatcactcatagtcctggcaggtctgagagctccatttggtttctcctgcatgaggagacagggagggataaaaggatagacctttatcaaacctaccagagactacatggtatctcagttcatcctcataaagcattgaggggaatgctagtcttgttttatagatgagtctagatgaggctagagtccaggaaatcaataaatagccttgcccatggtctcagagctaataaatggtggaggcagatgaagggcagtcggcttgcttccatgtggaattgatagaggggtcactggagtttgagggaggggaagtctagaaccatctggcgttgtcttcagatcggacaccagggttgagacagtctgtgtaccctatagcaccgcaggtacaagcatcatggtgttggcagtggggagatactagagtgggtaagtgattagtggcctggaactggaagatctgagctttgacaaaattattcccatcacaacatgtagcagagacactgatgtggataaactaggtcagggagctgtgtgaggagctgttgttaaaataagggagggaggagaagcaactaagtggtcacttcctaacatgaaatgtagaggaaaccaatattaactagaatccatctgattttagtcagttttcctttgtaagtatttggaaggtgggataatttattttcaaggttaagtaaacatctatacatctcctttatcttttgaagactggtggcgaagcgaaaaatggcacggccaatggagtcagagtttgtttaataaatatctcagagttcaaagagagactctcatgggccagaaattggtaaatgttcctgcattctaaaattaggaggatcttattttctttgaatcaacagagaaggaagcacaggcagtggggaggaacagttgggaacacggcagagtggccgcaggatgtcaaagacaaaggacatgtaatatcaaattctaagctgtgaagctgtgatgcaaccctccaccttctcctaatggattttttaggtctcagcgcagatgcacagctgagggagtaatttctttggaaatgaaggacaaatagctgtgttaaatattaataacaagtccacattacaaagcacgcctggaaatggaaacaagattatttctaaggccttttctactctaagagtctctaacttggtggcaaggtgagaggtgaggttggggtgggtgttgatccacacgcgatgagtaccatgaggctctaccatgaagcatgtagttctcagtgtgaatcagagccctaagaagaataatgccctttactttgttttgtcctgtgccatcccaaacccactccacccataattaagcagccatggaaatgagggtagccagaaggaatcaaaccctgctgcttggttcagtagacacagggacctgggaggagggtgttggctgggtcaaggagaagatgatgagctcagaaaatagacaaggagaaaccccagtggaaagcttgtaaaactctggatgaatcacaagatatgttattagagctcctttttattactaaattttatttattactaaattaatggcaggaaccctgcacaaagggatattccctatgaaagatggcatctcaaataaaaacagagcattcttccttaccctaaagtctgccctttctccccaagtccctcatgcatcaggccacctttgtgcccacagatcatgggcagcgctgggtggccatcatcatccacacagagagggcagtcagcagcatgagctggttctgcctgatatggtctcaccctaggcatggaaagcaagagacctgcgttgagctgaaggtgctcagctgggtttgtcaggagtcccatctgtcagtgaattgacaagaaacagagcaaaacgactcctgcaatgttgagaagcctgcacctaggatctggaaacttgataacagagaaaaccaatatagacaaaggattttaaacaggattatggtcaattaagcaaattagaaaaggatacttgaaggagtatttgggatacaggaatcaaaaacaccaggaagacatgagaagtttccctaagagtctagactacagcactgtgtagataactaacatcagaatattaattatattattgaagaattaaaatttacattgaattacaaactctttacaaaaggtcatgaaaatcttgtagacttgtttcaattcagacaaatgtgttcttctcattctcagctgttcactggtgcatttatcttgaatttgaccatctggggaatggcgtggcctctcctgactggaaggctctggggcccaggcagggagaatgatgtctcagaatgactcccttgagagtcctgttccccttttatcaatgcacagacccagaagacccctccgtcctgcagcccctgccatgagcctcgggctcctgtgctgtgcggccttttctctcctgtgggcaggtgggtcctgggcagggcccttgcgtggatttcaaggcccatcccctttccactggggctgcagcatcagttttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagttactccacagcgctacaaggttgtctcctctctgcacataaaggcagggaggctctgccctccaccccgacctgagactcagggatgacctgggcagagtattctgcaacgggaaccttggaacccgaagtggccccaagtggcccagacagtatgagcctcgctctgtgccaggtgcctctgtaggcatctcagccaggcctggactggtcccaggtcctcatatgtctcctttgttgctctctcctacaagctctacttttggggttggggccagggcttccccagctcctacttttctactcatcatcctgagtccaaggcccccaggatgaaacaggatttgtatttcagatccatctagactcctgtctctccctggtgaccatgttgcttcctctctagggtttcccccagcccccaccctcctgtggcccacctttcccacctccgcagtcatcctccaccccccacttccctgcccctctctactgcagccatgaggggagcacctctctgtgactccttccttcccgtcacagagacttcaaaggccattttctttgccctgggccagagccttcctttctctagtggccagctccttcctgtgcttcagatctcagtatgatcagcccctctgcgggaagcactccctcccctcccaggtaagatcaactttcctctcataagctctcaatgaatcatatgtctgttagcaacctttagcacagttgggctttctcagatgcttgtctgattatttttgtgctccacccaatttttttttttttaagacacagtctcactccgtcaccaggctggagtgcagtggcatgatctctgctcactgcaacctctgatactctgattcaagtgattctcctgcctcagcctcccgagtagctgggattacagacatgtgccaccacgcccagctaattcttgtttgtatttttagtagagatggggttttaccatgttggccaggatggtctcgatctcctggcctcatgatctgcccttctcggcctcccaaagtgtggggatacaggcgttagcagcacgcctggcctctccacccaatttttaagcccatgggagctaagactgtgcctgctgtatttaccaacatcggtgcctggcatgtggggagacccatttcacagagaatagatgagtgaatgacaggctgagtgagtgatgagtgggtggacgaacaaatagcaggaacacgctacatctactgtaacctgccagagatctagcattaagtacaagaaagcccacctctttgattgctgggctcaggtcggtcttggaaattgatggggaatcactatcatggcggccacacctggttcaaggcttcctcttgtggctgcagcacctgacctcctccaggtctctgtgctctccttcaggatctttccccacaacaaatctagacagatcagagatccacttcaagaattccatccttaaaggttgttccttgaaaccacttctggtaagaaaatctccattaggtttgcatcaataaaacagagccactacaggtttgtgagtgtaaaagatttatgatcagaattagactttatgcatatgtgggaggagctgaggaagacaaggtcttgaggagagaagtcagaaggtgagggagccagtcagtagccagggctcctggagctcgggcaggacaggctggagtggcagggacatgagaggatcagagcatgccaggccatgcagtgggaccttgagccgggagcacaggaaaaggccgaggaaacctgcttctggggaagctgttccctctgtgtgggggccatgctgcgggtatagtgccaaacactgggggcagcctggctgctgttgggcagcatttggcaagatgaactggacacagggtgcagaaggaacaggacttcctaggtctgttggatgcctctgtatctgctggtcactgactctcactctctcaccacaatgacctgccaattgttatagtgactgttttgtatctgtcttctaaatgttacaaaatgtatccttgaccatctctaacccagaatgataaatggcattctgggaaagtcagactcttacatttgcaaagttgacttaacacaatccagcacagtatggattctcccagattaaggcatcagatcacacaactgactcaacctgccacggtccgtggactcctctccgggggacacctgtgctgcccaagtgaatgtggacacaatttgtatgtagatgttccagacactggctactaaattttcttttaatcctgtgcctgaaatctcgctccacccagaggcagggctctgcctcctgcttctgtctccttcctgagcttctatcctgatggagttggatggacatcagacgcctggtcagagtgcagtgacctgtggagacagtaggagggaagctcacatcttgctgccttcctccatccagttcttttataaccaaagcaagtgttctggtctcccttttgactgtgcagtatgagaaatgtgcttcatgaatttgtagctgatcagctcaatgatttgatggccaacctaaagtgaaatcctcagatctgcagaaattgccctgcatttctgtgaagatggcaagaatacagtgtgctagagttgccttctctccaagtagagacctggcccccaaacaggatggagcagagggggccaaagagcccaaaacatgtctcagattgttgaaaggcaatttcccaggacaatcctactgatgacatttcatcccttgtattacacacttggccacccttccccccagatcagctgagtacccaggatatcacacatcccagcatcttctaacgaggaaaaatacttcacgtaccagcctccttcctgcaccacattgactaaccctggaaacttagcctttccagaaaaaagctctgtcttctcttggcccagtctagcctggtaggtttaattcatgatttatgtgaccttttaatttactcaaaggagaacgtatgatttcagggtaaagaatattcattttatttttataagttggacctaaacagtaaactgagtacttttcttccatcagcgtcttaaattagacaacggtaaaacaaatctttgatgctagaacttcagatcctagtgtttttcacatggaagttcccagttacccagtctagggcatggaatagatgagcattaataagtcactgtatgcctgagatggttttctatgggcatcttttctgaattacggttaacaagggtgggaaatgatcccagaagaaaggcatgagggcagttcttgagggaacccatgtgatgggacagtctcattgggcacgtgtgactgggggaatggaggaagctggggcatgattgggatggcacaggggaccctgacttgcgggaaagacaatgagctcaaccctttgtgcccctatgttaggggcgctgttgttgcatcctacaggacatgcccagcaggcaggggagcggctgtaggatgagaagatgaactcagagatgcagtgtgaggtctccaggcacagacggctctggagcacaaaccaatgagccatgaattgatgttgttaaaacggaggttataaatatttaaagtgtcacccaagtgtgttctaatagaaatgctgtgaccctgaggtcctgaggattgagagaggaagtgatgtcactgtgggaactgccctgtggagacaaggacatccctcatcctccgctcctgctcacagtgacactgatctggtaaagcccccatcctggtctgacactgtcatgggtaccagtctcctatgctgggtggtcctgggtttcctagggacaggtgagtcctcaaaacacaaagtagtttcatattttttctgtatgtaggtgtgtgtgtgtatgcatgtgtgtctgtgtgtgtgtgtgtgtgtgtgtgtgtgtgtgagatgactacaaatgttttccttattctgttgccagattctgtttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagccacagcatggcacagtcgcctccttcctgttcacaaacctcatccttctctctctttgcagctcccagagatcattaacagaggcctctctttgctcctcacttttcctgggaaagaggtagatttggacctcggttgtcctttgggtggaaagagaccacagattcattcctgaaacacagtgactgcaaatgtaagtggtgaaaacaatcacgtcccactgcactctaggagggctcggagccagctcactgctccaaacaaggagtgggtgtcttagccttggccttcagagcagacatgcatcttctataggtcttggaggctgctgtgttgcccacatacatgaggttgtcataggcaggaaacatgcctcttcttcatatgttggggcatctggaaggtctgaggctacatccccgagaagatctttcttctgaagcctcttctatccctgtcaccttggaagttttctgccacaaaatatcaaacctctcttcctgtttgaagtaaaggtctttgcaaatttgtggtccttacttgataaatacaatcatggtaacaataacacttcatttcttctgcctactttaagccaagagtatcctttattttatttccatttgccattgctgctgtcctgatagacagaagcatgcatcaccaccgctgccacttcaccttgattcactcaggaaatctgattttcagactctgagtgttttgattgttgtccaactcatttgatttgaaataattctcccaaggcctttaactcaaaaagtgttttatttataatattgaatctattcctttttattatattttttcataatatatagtgttatatagcacttgttagaaatagaagtacaatgattatattgcaatagaatcttccatctgtctgtgggtgatgctgcagtttgtatctatgaaatggaatgcactggtcagagctgatgtgattatgcattatgggtttcggggagtcctcagcgacagaccacttctccaagtctgggactcagtgtcccagatgcaaccctgatagaggtgccctgaatctttcatagctaggaggggcatcatagtccttccaaattcactgatcagaaattatggtgtggtacagacaccaaatttctttccccagagaatgatggtcactggcagggaattgctcttgacccattttttcttgtgtcgtcatcaaatgactccttgctcagccgccctgtgtcttctgggactgagtaaggccagcacacagatgggaattccctgtcttctgagaccttctaactgctgccactttcctccatgtgactgctgagacaactggtcctaacagtggacaagctctgacactgaggctgaacagaccacagtccactgttgtaaatggtgctgcaagaacatgtaacaaaagtgagcagggcttccaatttatagagagaatgaacatgcaagaggagcaaagggtagatggtactaacgaacaaatagggaggaatgtggtttctgttctaatgaaatcattctgttgtcttaagttaagcaggagaaacatttcattgcaattacttcaagtcaaaggctagcggctccccaaccagccagcataactctttgctctgtgatctcagcagcttcagaggactcagaaatcctttctctgcacaaacatcccgttgtccattccaagacccaggatcacacactctgatcttatcatgaaaataatgaggtatgctatagttgctgtggcctcattttagtatgtttagtaggaagcattgaagaagtttgaagcttttctctttagtctatggcttgtatgactcaaaagaagtaaataggcatacttttcccagctccctgttcagtgaagccatgctgggagcttgaaatctgccatggtgggtatgttggtacacagaaattaggaaatgctaccagccatgcccccaccttcacagacacacagtttatcagcacattactggggtattttctgatgtccctcttatgccatttctgagctaggccaatatagctcagaatttatttccccactactcttgttcttagaacccatcacctaaggggccgtcaattgttcctatttccattcaactcccaaattctcttgcactgtagctctgtgtttccttcaagaatgccagtctggaacatgacaactattttgaatgtacctaaaggtatcactgaaccagttcattatttacaaattatctttcctcacatggaatattcagatgctggagtcattgggaacagagatggccaagcagcaactctgggttgtgaaccacatagagccccgctattcttctatgtcactgacagaccctgaaacaaggactattttgctttagaaactaagcagctccacaccagtcaggaatgactctgcttttactttaggctgagagatcagaaggatcacatcctcagtattctcctctcctggactgagtgtggccactctccatctcagtccctggaagttgtccagagttccctgagaatccctgctctggggcagaatcaccaaggctcatcctcaccagctccccacaggctccagcagggctttcctgccaggtgtagggcacaggaatggctctgtctgtctctcaggtagagggaggccaaacagtgatgtttgtataagagggactgggtttctgtgtctccattaaagtatttgacaatattttctttgttttttttttttttttggtttatttttccatctcgccaatgaggagagcaatcccttggtagttatattgtttttggcacttgggaaggtttttgtggttaagtcacattaagaaattgtgcctttttttcctgttcagctgtaacccaaggcagtgaaagaaacagcaataattttgaaagcagttacttgtgtatcttatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaaggggagggagagatgacctctccttcagaccatggtcaacaaggaaggagagggagttcatccatgggaacctgaaaagcagcaaatcccaggggcatctaacttcaggtgcaggagcaaatccttggagaggaaaatggtccagttcagctgtcacgggagacaggagaaagcaaagtcatctaatccacagtcccctggctgatttgcttccttatgatactattttgcatcagcgtgtcctcatctcccgctgctcctctgcctcttccagtgtcatctcttccctgtttgctgctcagatcagtggatgtgcattgtacaaggtgatcatttcctatagcagtccctttgctactcttagttatatccatccttattttctgcattaggtactgctccctccaccattgcttattgtcttgtaacaggtctcgttttatatatttcaattttactttttattaatagacatttgacttcatcttttgctgatctatacttttggggtaacattgtcatttttggaggatgtttttgtttatctttagtgattcagattaaataatctctttatacttcaacgtctgtgtcttcttactatttaaaaccaaatattatttcctttcattcctctcattctgttcctctttctttagatggtagttttaagggagaaaaagtttggctataactgaagctatgtgataagagttattcagaatgagggtgggatatcaagattggtaactcaaagcaataattagggttagaactaatgtaggacttagggtttagggaagctgctcataaaactgcgggatggcacctctggaatattctggcagctcactctgcagacacttcccagcattccttgggccattacagaattaaacaatgatgaagcttcacttattggccacaagatggcagtgtggtccactgcgaatgtaaagggctctgggcagtctgggggagcagcctaggagggaaaaggttaagaaaaattagggtttgtattcaatattatgcagatgttgcaggagttttcagttattgctaggctacctacagctatgcaagaggcaggaagtccctctaatctttaatcagatctacagttgaagaattttggccaggcagccttggtgtcggggcatgtgcagacagaggagcaactgcctcagaggaaaagggaaaagtgagaggcaggctgtgccctgagcccagtgggtctctgctgcacctcatcttccctgcaggtctggccaggcaacagctttaacctgcttgagtgatctgggattctccaagttcataagtcttactgataacatcaacttggctgaggttccattggaaatcaagcacatgttctctggaggacaaaaagtattgacaaaaatttctgaaacacctcagtaaacaaactattgaaggaaaatattagtagatgcaccaaactgtgccgttagagatgaagataatagactagtagaattttacaaaggagactataaataagtctctactaagtatttgtgggcatcaagcagtgtctgagtcctctcagggtagattaaggaaggaattcagctattatcatgactttggcttggatgaaaatccatgaagtcctcaattgattttcttgtaaaatattacagaataatattgagcaaacattttatttttctccagcctgtatccctctttagcactaacaggtaaagcagacacctagaggcacggtttctttagttgggatccattaactgtaggactgggaggtccatagctgggcttcacagggagttcaaaccccacgtgcagggaactccgtgtgtctgtgctgtgcccaactcccgtctgtgaggctgaaaagggggagtgccgggtctcccagtaccccactcacaaagtggggagcaggctgcttgctgggcaaaaaaatcaattcaaaaattggccaatctgttcaaagccaaaatgaaaggaaagtctgaattgtgagactgatgaatgcccaatttcccaagttatgaaatttgtagcagctcatggttctcagaatgatttcaatagcatatgaagatattgtaaaaagcttttgtttgtctacagctttccttgattttgatcctagttgtttttcggcccactcatcagttgagcttattttgatgccaaatttcaatgttgccacttcagtcaccaagcacttctcacattctccataacttacacagatatgtgtgttcctgtcttttcttatttttgtgtgattcatttttaaattgggctgtgcagaatacaagcatacatttgtaagtgaatcccatattttatgatttagctgtttactttttagtaatactttttattaaagtataatagagagtaaaacagaaatattaatacaaggacatcctggtacattttgacaaatgcatatgccagtgcaatagtaactgaaatgattataaaaaaaattctgtcatgcaggaaagtgtcgtcatgctcctttccaatcaatttctatcccagagataaaaattgtatttatttatttatttagagacaagagtctcactctgtcacccaggctggagtgcagtggtgtgatctcagctcactgcaagctctgcctccccggttcacgccactctcctgcctcagcctttggagtagatgggactatagatgcttgccaccacacccggctaattgtttgtatttttagcagagacggggtttcatcgtgttagtcaggatggtctcgatctcctgaccttgaaatctgcccgcctcagcctcccaaatttttgggattacaggcatgagccaccgcgcctggccaaaacttttcttatttttatcaccactgactagcttggtctattcttgaactccatataaatggaatcatataacattttattgagttattttcctccaaaattagtatttctgaagtttattcatattgttgtatcagtaggtcattttttcttatgactaatattccattgcataactataccacaacttgtttatccatgctcccgttgatggatatccacattactcctgtcttcaactattatgaatacagttgttgtgaacattcttgtggaactctttcttgtggacatatacattctttttttttattttattttaggtataaacttaagagtggaaatactgacttacagtgtagatgtgtgtgctatgcttgcgtgtcctcacaaaagctcatgttgaaatttgtcattgtaatggtattgggaggtgggacagctatgactaggtcatgagggatctgccctcagaaagagatcaatgccgttattgtgggagtgaattagttgtcttgggaatggtcttctgataaaaagtataaattcagccactttctctgtcttgggtgcttgcttccccttccttctgccttggataacagcaggaggccctcagccgctatggcccattgatcttggacttcccagtctccagatctataagccaaataaatgccttgtctttataaattacccagtctgtggtatttctctatagcagtaggaaataaatggaaagaaaacatggtgctgagagtgacgctgttgctgtaacaagtacctgaaaatgtagaaacagctttagttaatgggaaatggctaatggatagaggttggaagaattcagagaagcagactagcaaaagcctagattgctgaaaacagagcattaagggcatttctggtgaaagctcagggggaaatgaggaacaaggtatcagaaattgaagtaaatgccatccttctcataagtagcaaaaaccttggcaacattgtgtcctgttctaggactttatggaatataaaattatgagccattagctaggatatctgctgaaagaaatatctaagctgcaaagcattcaggccactgtgtgactacttttaggcaccaggcaatttaacccagcaagaaggcagccaagggaatagattttgcaaaccagcacagatggtgacactacctccctctgctgtcctgtctcccataagccaaactcactctgaagttagagaaaagaggagacagttaacatgatacactggagtcagcctgtgaaggcagggtggatctggagggattaacataaactttccagagcactacatataggatggccttgagggtgttgagtccaaagctggctaggtctgtggtgtgagctgataaggccctagatttatttctggggaatctgcactcttaataatttacagacaacacaggtctgctttggatctgatcagatggactaaatcttggggcctctgtaccgctggccactcaggaaatgggttgggaatgttgcctgggacaggaaaatatagtaagaaaccttggtgtgaatctagcttcagaaagatgatgtgaggagagcaaggaagagctggaaactgatggtttaatcacaggctcctcaccatctgctgataggcaggtgtgcgagctccagcatggagcaccgcagcactaggtcagaggagggtgatagggtgatggggcagcctgtgagctggggcagttaggcagaggagcaactgtatcaccacagaagcttctgccttcacccatccctccagctcggcaggacaggtagagagtccagtgtccgtggagcactagacctaaggaaggctgcatagggaagacacaagacagtgacatcacagcatacccctcccatcaggaaaatcaaggcccagaactcactcagctctttcccaggaggaccaagccctgaatcaggtgcagtgctgcctgccccactgtgccatgggccccgggctcctctgctgggtgctgctttgtcccctaggagaaggtgagtcccgggcacaggacagctgctccattctcagctttcccacccctgtgtcctccactttaccttggggaggacctccaggctgtctccagtgctcattatacatctgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcagcttggcacagcccagcagagtcactgacattctgtatataaacttccgccttagctttgacttgagaactgcaggccccacccaggtttcactccttcaagggaagcttttagttgtttggaaggcatgtcttgtgtcctactgagggcagacctttcccaaccaatagagcccaggtttcctgtgccctgagtgtgcctgcttctgtgctgcaacttcttgtagtttgtcacttcctggataacttcagtagaagagtgactgttgagccccagatacgtgctagattcttcgtatttgttacatagcttaagggctttccacactcttgcacatcaaacatttctattcttcctttatagatagaaggctcagggacattgagtcattttccccagtgtctcttggcttgtaaggatcagaagtaggaaacaaactagtccatccattttccacctacccccctgctccatcatcaccttctgcatcctggtcagtaagtcagagccctcgcactgccctctagtgaccagcagggctgcagtagacgctcagatgccttcaggggtcattactatggcctcttcattagcaactttgaggaatgttaaatttaacactttttaaaaatcatttatatgcattccctttgtctttccccagtctgcagcttatgttttcacttttatggtgtttttttgatgcacaagagtttaatttaatgcaacaaaaactaaaatcaattttgtttgtgtgtagacaaaaaccgctttcttatataaatgtctaagcgtagttttatcaatttattctagtaaaatttaagcttggattttcaccactaagaataaatgtacctgaagtatatcttatgtaagaaataagatagagacctaggaatgggagggaaggacatatgttcagtgaagaagtaatagcctgtcaaagagagccctaaagtagacccccagagctgatggtggagaggtaagtggagggcaaatgatcatgaaccttgtccgtttgttaccttgtagaagaaaggcagccaggagtggagaccacatgggtgaaggtttatgacttgactgtaggttgaaggtggcagcaggtagagggaggactagcaggcagagggcagagtcactggctggcaggggcagtggcatcatcagttgactctactgacatccaggaattatgttcccaatgcgcaagttgaaaaactccccacaatttgcctattattccttgaccctgccatgaccaccagactcctcaatggtttggccgtctgccccctgagggcaggtgagtcccctaaagccttttccttggctcaccacatcccagcctaagcctttacctcaagtctacattattggggtccctctttgggcactcaacttccttctatcatagacttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggtagatatagttggccttgtcttcatgagattttgatccaggcagtggaagacattgtcccataggagtttccccaacactgcccaggctgggactctcagatttctgagcagccctgtgcaagggaaactctgccctgtgctgagcttctctcccagggcagtctcagctggacaagggaatgcacatcacggtgatgtgagcagatgcagcctctcttccaggctcctcctccagctctggcctcagaagtcctcttcctcagttgctctcagaaaggaaagttgatttcaaaattgtatatttgcagacagcactgacaacacaggtctatgttcttttccctgtcagccttcacaactctatcttccccacaccatgctcatgtcagtcctcagcctcctccaagtgatgtctgctcctagctatcctctcatcactctgcaccctcacctccatgtcaaccacagacgcctgagttcaggccattcctcatgcatcatgctcctcccaccaaaggcctttgcactccacactgtattctctgtatcaacacgagtctcttctttttgttctttctccaaatctcagtttaactaccaccatctctagggagacactccttcaacagttttcctaggctgcacctccctattgtaaatgctcacagcttataatatgcattaatattcatagttttagcaccatagtcatttccctgactttgtgtggctatttcacacttctcttgcattctagactgtaaaatgcatcattgtagaaattgtggatgttttgttccccattttattgtcagtaccaacagcggttccaggtgccagtgaccagtcttgaaagaataaagaagagatattgaaaggccctctgagttcccacagactattccagaagtctggatgcattaaatgggaacctctatcccttcatctcctaggattaaatgagtcctggaaacagatgagaaatccctgtcatgcatgagtaactggatcccaagcctttctgcacgactgaacttcctcactgcccatcgccctcctggcttgtctcctccttcaatctccttccctcacaggtgtcctggatttgggagtctcacagacacagggcacctaatcactctgagagagtgatcagaaacataatgtcaaacactggcattaaaaggtgatggagaagaaaacaaatgccttccccattctcttaggcaaagttttcccaaggcacaaatatctttttgggtggctttgaggccatggtgcctgacacactgagctatattatgggtgttcatttccatgaattggtgggcaatgccagagacacagacctcatggtcaccagcttcctccagcccacacctgattttggtgcagggcgctgaacagagacctttgcttgttaccctcctttgccagttaggaaaggctgattgtgaggcagaggctccatttacagagcagggctatgtgttagtccctgaagaattgtgagagccattctgggtggaaataatcaaatatataatcaccaaggatggcccacggatagacagaagccccaattttgccagaatgatttgcatctatgctttaaagacaaatgcagttttatctctttaggcaataaagaccaaaaatagactagctattttaaataattgaaccttaaacagaccaaagtcagaacatcttccctagggacagcattttcttccacccactcactaaagctgtatttgagaaagctgtgtgctgttgataaacactgcaatatcgttacaatcgacatcataataatactgctacttggatcagaaacaaagagcatttctaaagcttgaacaatgtataactggaaacgagctctcactgagtttggaaatgcaggcactagagggtgctcatttctcttccttttccaatcagggggctattcaaaggctgttctagaacaaggggtgagatcctccacttccccgtggtgatcaggctttcagaggtagaagccttattagttcataatcagccgaactgacctcaccatcaaatgtatcgacctggatgctcaccctcctcagcagtcagagactgtgttcaccaggagcttgtgcgcttttacggagcacattttatcctcggtttattcggaaacatgggcctttatagggggttccataaacagaagctttctatattttgtccatttagacactacaaagtctgacaccagatgagaggtgttgcttaaagcttgtatgtggtgaagattttttaacaaataatatataaagaaaatgtcaataatgctctcaaatccaatcccaacttccatcggtaaccaatactaaagctctggtgtgctttgcacctctcttttctgtgttcatgcacacctttctacccaagtacatctacagaaaatgggttcacctgtacactttaccggccacatgcatactcttttctgttaatataccctggtctttattgttccagattgatcgatacacatctaacttgctctatttgctgcttcatattgcataatgagggtagacaggtacattcgtgctgtcatctgattcccaaattctgccagatcttttctaaagtgactgagtggtctatttatgcttccaagttctcctcaccccagcacccagttgatgattccagcttttccatcactcatggtcctagcaggtctgagagctctatcagttctcctgcatgaggaggcagggaaggataaaaggacagacctttatcaaacctaccagaaactacacagtatctcagttcatcctcataaagcattaaggggaatgtttgtcttgttttatagatgagtctagatgaggttagagtctaggaaagttaatgaatggccttgcccatggtctcagagctaataaatgttggaggcagatgaaggacagttttcttgcttctgtgtggagttgatagaggggtcactggattttgagggaggtgaagtccagaaccatctggggttgtcttcagatcagatgccagggtgcaggagagtctgtgtaccctacagcactgtaggtacaagcatcatggtgttggcagtggggaggtacagggggtaagtgtttagaggcctggaaccagaagatctgagctttgagaaaataatccccatcacaagatgtagcagagatactgatgtggatacactaggccagggagctctgtgaggagctgttgttaaaatgagggagggaggagaaccaactaattggtcacttcctatatgtgaaatgtagaggaaaacaatattaactagaatcctatctcattttagtcagttctcctttgtaagtagttggaaggtgggataatttattttcaaggttaagtaagcatctatacatctcctttaccttgtgaagtctggtggcgaagcgaaaaatggtacagccaatggagtcacagtttaataaataactcagagttcaaagggagactcttatgggccagaaattggtaaatgttcctgcattctaaaattaggaggatcttattttctttgaatcggcagagaaggaagcacaggcaatggggagggacagttgggaacacggcagagtggccacaggatgtcgaagacaaaggacatgtaatatcaaattctaagctgtgaagctgtgatgcaaccctccaccttctcctaatggattttttaggtctcagcacagatgcccacctgagggagtaatttctttggaaataaaggacaaatagctcggttaataacaagtccaccttacaaagcacacctggaaatggaaacaagattattcctaaggccttttctactctaagagtctctaacttggtggcaaggtgagaggtgaggatgggggtgttttgatccacacgtgatgagtaccatgaagctctaccatgaagcatatagtgttgagtgtgaatcagagccctaagaataactccctttacgttgttgtgccctctgccatcccaaacccaccccacccataattaagcagccacgaaaatgaggggagccagaaggaatcaaaccctgctgcttggttcagtagacagaaggacctggaggaagggtgttggctgggtctaggagaagatgatgagctcagaaaatagacaaggagaaaccccaggggaaaacttgtgaaaccccggaggaatcacaagatatgttatttgagctccttttaaattttatttaatactaaattaatggcaggaatcctgcacaaagggatattccctatgaaacatgacatctcagataaaaacagagcattcttccttaccctaaagtctgccctctctccccaagtccctcatgcatcaggtcacctttgtgcccataagtcatgggcagcgctgtgtggtcaacatcatccacacctagaggacagtcagcaaagtgaggtggttctgcctgctgtggtctcaccccaggcatggaaagcaagagccctgggagcagcggaaggtacacagctgggtttctcaggagtctcatctgtcagtgaattgacaagaaacagagcaaaacgactcctccaatgttgatgagcctgcccctgggatttggaaacttgataacagagaaaaccaatatagacaaaggattttaaacaggattatggtcaattaagcaaattagaaaaggatacttgaaggagtatttgggacacagaagtcaaaaacactaggaagacatgaggtgtgtccctaagactctagactacagcactgtgtagataactaacacttaactattaattatatcattgaagaaataaaatttacattgaattacaaactgtttccaaaaggtcatgaaaatcttgtagacttgtttcaaatcacacaaatgtgttcttctcattctcagctcttcactggtgcatttattttggatttgatcatctggggaagaggtgtggcctctcctgaaaggaggctctgggcccaggcagggagactgaggtctcagaatgactcccttgagagtcctgttcccctttcatcaatgcacagacccagaagacccctacgtcctgcagcccctgccatgagcatcgggctcctgtgctgtgtggccttttctctcctgtgggcaggtgggtcctggcagagccccttgcgtggatgtcaaggcccatcccctttccactggggctgcagcatcagctttgttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattccacagcgctgcaagcctgtctcctctctgcacataaaggcacagaggctctgccctcctcccacccaagactcaaggatgccctgggcagagttctctgcaccaggaaccttggaacccagagtggccccaagtggccaggacagtatgagtctcactctatgccaggtgccacttcaggcagtctcagccaggcctggaagtggtcctaggttctcagatgtctcctttgttgctctctctggtatatcctccaagctgtcctttttgtgtagggccagggcttccccagctcctactttcctactcattatcctgaatccaaggtgcccaggatgaaactggatttgtatgtcagattcatctatactcccatctctccctggtgaccctgttgcttcctctctctatggtttcccccagcccccatcctcacgtgatctctcctgtggcccacctttcccatctgggtagtcaccctccaagtccttgctgggtctctcctcccctcacctccccgcccctttctactgcagccattaggggagcccctgttctgtgcctccttacttcccatcacagagacttcaaagtccatttcctctgccctgggctggagccttccttcctctaatggccagctcctacctgtgcttcagatctcagcatgatccgcccctcctgcgggaagcacaccctcacctccctgctgagatcaactttcctctcataagctctcacagaatcatatgtctgttggtaacctttagcacagttggactttctcaggtacttatctgattatttttgtgctccacccaatttttttttttttttttagacagagtcttgctctgtcaccaagctggaatgcagtggcaccatctcggttcactgcaacctctgactctttggttcaagcaattctcctacctcagactcccgagcagctgggattacaggcacacaccaccacacccagctaattcttgtttgtatttttagtagagatggggtttcaccacgttggccaggctggtctcgatctcctgacctcatgatctgcctgcctcgggctcccaaagtgctgggattacaggcttgacccaccgcgcccggcctctccacccaatttttaagcccatgggagctaagagtgtgccggctgcatttaccaatattggtgcctggcatgtggggagacccatttcacagagaatggatgagtgaatgagaggctgagtgagtgatgagtgggtggacgaacaaatagtaggaacaagctacatctactgtaaactggcagagatctagcattaagtacaagaaagcccacccctttgactgctgggctcaggtcggtcttggaaattgatggggaatcactatcatggcatccacacctgtgtcaaggcttcctcttgtggctgcagcacctgacctcctccaggtctctgtgctctccttcaggatctttccccacaacaaatctagacagatcagagatccgcttcaagaattccatccttaaaggttgttccttgaaaccacttctggtaagaaaatctccattaggtttgcatcaataaaacagggccactacaagtttgagagtgtaacagatttatgatcagaattagactttatgcatatgtgggaggagctgaggaagacaaggtcttgaggagagaagtcagaaggtgagggagccagtcagtagtcagggctcctgaagctctgggcaggacgtgctggagtggcaggaacatgagaggatcagagcatatcaggccatgcagtgggatcttgagctgggagcacaggaaaatgccaaggaaatctgtttctgggaaagctgttccctctctatgggggccacccctgcagatgcactaccaaacactgtgggcagcctggctgctgttggccagcatttgggaagatgaactggacacagggtgcagaaggaacaggacttcctaggtctgttggatgcctctatatctgctggtcactgactctcactgtccaaccacgataacctgccaattgtcatagtgactgttttatatctgtcttctaaatgttacaaaatgtatccttgaccatctgtaacccagaatgataaaagaaatggcattctggtaaatacaggctcttgccattgtagagttgacctaacacaatccagcacaggatggattctcccagattaaggcattggacctaacacaatccagcacaggatggattctcccagattaaggcattggatcacacaactgccccaacccgccacaatccctggtcttctatccgggggacacctgtgctgcccaggtgaatgtggacacaatttgtgtgtagatgttccagacgctggtgactaacttttcttttaatcctgtgcctgaagtctccctccacccagagagtctatatgtgtatatctgtctgtctatctatctctatctctatctctctctctctgtaatttccacttggaagaaaatgtcatgatgactacatgttactgggatttatttatgaaaaggattttattaaaaagaattagaaaatttgaatccttttctgaatttttccttgggactgtcctgagagcatttttgacatgaccaacctttgtcgtgtgtgtatttggcagcctagagtgcagcagagagttattggccccacatatttgcgagttagactggagatggctgtaaaaatgactgactcttagtgttattcactctcagtctgggcctcactagaatgtcacagactaccatcgaacaaatagattcccagtatgaagaatattaggacatagcaacgaggaaacatgagcacaagcaacaaacgtttgaagtgcaaacctgaagactcgaaattttggcattataagatatgaaagtttggagagctacatttaaatgaacatgagggggaactgaaacaaggaaaaagagaatgtctgaaaccaacaacttgcataaaaattgtcaaatagtatatctaggaatgcctcatacaatcactgaaaacaaaatggaaaggcaagcagttgataagctcctcctatagagatttttagtgatgtcaaagatggatctgcaggagtgatctagaatgcagcacagaaaataaaaagtgaaatatgaaagaagttaaagaacaaggaagaaaaaaatggatgtttcctatgtattagaatatgcatatttttcataatttctcattcttttcttgcatatgatttatgtttcaaaaagataaataggaagaatgttatgaggtgatatttatgagatgttagctgagaatttttagacgtgtttcaggacctaagttcagagtttccagaatcaaaatgaatctcaaataagacagtcaagtcatagggaaattgtagaacatgagggaaaaagagaagattttgaaagcagtcagaaaggaaagagaaatacgtcccatagaatagatggagaacaacagtaagtcaagatagtagttaaaaataaccattagctcaattatcattctccttcatttaaggtgagattgattaaaaaaacttttagaagtggaatatgaaaaatgactgctgtgagtttgctaccaaggtctctttactgaattacagttaagaaaggtgggaaatgatcccagaagaaaggcatgagggcagttcgtgagggaacccatgtgatgggacagtcccattggacacgtgtgactgtgggaatggaggaggctggggcatcagtgaggatggcagaggggaccctgaattgcaggatagacaatgagctcatgccttggtgccttgtgttgggggtgctgttagtgcatcgacaggacatgcccagcagacagaggagtggctgtaggatgagaaggtgaactcagagatgtagtgtgaggcccacgggtccagacagcatgggagcccaaaaaatgaaccatgcattgatagtggtaaaaagctgatacatatttaaagcagcacccaagtgtgttctaatagaaatgctgtgaccctgaggtcctggggattgagagaggaagtgatgtcactgtgggaactgccctgtggagacaaggacggcccttatcctctgcttctgttcacagtgacactgatctggtaaagcccccatcctggcctgaccctgccatgggcaccaggctcctctgctgggtggtcctgggtttcctagggacaggtgagtcctcagaacaccaagtagtttcattttttctgtttgtaggtgtgtgtgtgtgagagagtggttgtgtgtgtgtgtgtgtatgatgactacaaatattttccttattctgttgccaaattctatttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagccacagcatggcacagttgcctccttcctgttcacaaacctcatccttctctctccttgcagctcctagagaccctaaacagaggcctctctttgctcctcacttttcatgggaaagaattacatctggacttcagctgttctttgggtagaaagagaccacagattcattcctgaaacacagtgactgaaaatgtaggtggtgaaaacaatcatgggagtccttggagccagctcactgctccaagcaaggagtgggtgtcttagtcttggccttcagggcagacatgcatcttctataggtcttggaggctgctgtgctgcccacatccatgaggttgtcatgggcaggaaacacgctcttctcctgcatatgttggggcatctggaaggtctgaggttacatcccaaggaacatctttcttctgaagcctcttctatccgtgtcacattagaggttttctgcaacaaaatatcgaacctctcttcctgtttgaagtaaaggtctttgcaacttttgaaatccttacttgataaatacagtcaggataacaataagacttcatttcttctgcctactttaagccaggtgtatccttcattttatttccatttgctattgctgctgtcctgatagacagaagtatgcattcaccaccactgccagttcaccttgattctctcaggaaatctgatttctagactctgagggttttcattgctgtccaactcatttgatttgaaataatttttctgaggccgttaagaagtgttatatttataatattgattctattgctgtttatttttcatattatatattgttatatagtacttgttatagatagaagtacaatgattatattgcaatagaatcttccacctgtctgtgggtgccgctgcagtttgtatctatgaaagcgaatgcactggtcagagctgatgtgattatgaatcatgggtttctgagagtcctcggcgacagaccacttctcccagtctgggactcagtgtcccagacacagccatgatagaggtgccctgagtctttcctaggtaggaggggcatcatagcccttcccaattcactgatcagaaattgtggttgtacagataccaagtttctttcctcagagaatgacggtctctggcaggcagttgctctggacccattttttattgtgccatcatgaaatccctccttgctcaggtgccctgtgtctcctgggactgagtaaggccagggcacagatgggaattccctgtcttcctagaccttctctctaatggctgccaccttcctccacttgactcctgagacatctggttctaacagtggataagctctgacactgaggctgaacagaacacagtccacaggtgtaaatggtgctgcaaggacatgtaataaagtgagcagggcttccaatttatactgagaatgaacatgcaacaggagcaaagggcagacattactaatgaacaaatagggtttctgctctaatgaaatcattctgttgtcttaagttaagcaggagaaacttttcattgcaattacttcaagtcaaaggctagcagctcccaaccaaccaggataactctttgctctgtgatctcagcagcttcagaggactcagaaatcctttctctgcacaaacttccctttgtccattccaaaacccaggatcacacactgatcctatcatgaaaacaatgaggtgtgctatagttgctgtggcctcatttttagggtgttcagtaggaagcattgaagaactttgaaagctttgctcttgagtctagggatgtgctggagccagcttgtatcattcagaagagccaaataggcatactcttcccagctccctatttagtgaagccatgttggcggcatgaaatctaccatggtgggtatgctggtacaaccgaaattagcaaatgctaccagccatgcccccaccttcacagacacccagtttatcagcacatccctggagtattttctgatgtccgttatgccatgtcttgtgggcccaaaagggctcagaattcacctcccctctagtcttgctcctagaagccatcatctaagggggcctccattgttcctatttctgttctacctccaaattctcttgccttgtggttgtctcctacaagcatgccactttggaacatgacaattattttgattgtgactaaaggtatcactgaaccagttaattttttatgaattatctttcctagcatggaatattcagatgctggagtcattgggaacagagatgagcatgcagcaacatgcaagttgtgaaacacttacagccccgctattcttctgtggcactgacagaccctgaaacaaggactattttgctttggagactaagcagctccgcaccagtcaggaatgactctgcttttactttaggctgagaggtcagaaggatcacaccctcagtattctcctctccaaggcggagtgtggccactctccatctcagtccctggaagttgcccagggctccctgagaatccctgctctggggcagaatcaccaaggctcatcctcgccagctccccacaggctccagcagggctttcctgccaggtgcagggcacaggaatggctctgcctgtctcttaggtagagggaggccatacaatgatgtttgtataagagggactgggattctgggtctcctttaaagtatttgacaggccaggcagggtggctcacgcctgtaatctcagcactttgggaggccgaggtgggtggatcatgaggtcaggagatcgagaccatcctggctaacatggtgaaaccccgtctctactaaaaatacaaaaaattagccgggcgaggtggtgggcgcctgtagtcccagctactcgagaggctgaggcagcagaatggcatgaaccccagggggcagagcctgcagtgagctgagatcgcgccactgcactccagcctgggcaacggcgagactccatcttaaaaaaaaaaaatttgacaaaattttctttgatttttgttctattttgccatctcaccaatgaggagagcaatctcttggtagttatattgtttttggctcttgggaaagtttttgtggttaagtcacattaagaaattgtgccttttttccctgttcagatataacccaaggcagtgaaagaaacagcaataattttgaaaacagttagttatgcatcctatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaatgggagggagagatgacctctccttcagactgttctgaacaaggagggagtgagagttcatccatgggaacctgaggaggagcaaatcccaggggcatctaactcagggtgcaggagcaaatccttggagaggaaaatggtccagttcagctgtcacaggagataggagaacgcaaagtcatgtaatccacagtcccctggctgatttgcttccttatgatcctattttgcatccgtgtttcctcaactcccgctgccccctgcctcttccagaatcatgttttggctctttggtgctcagatcagtggatgtgcattgtacaagttgatcatttcctgtacaagcccattgctgctcttaattatatccatccttattttgtgcattaggtactgctccctacaccactgcttattgccgtgtaataagtctcattttgtgtatttcagttttactttttattattacacatttgacttcatcttctgcttatctatacttttggggtaacattgttatttttggaggacatttttgtttatctttagtgattcagattaaataatctctttatacttcaacgtctgtcttttatttctatttaaaaccaaatattattttcttttattcctctcattctgttcctctttctttagttgatagttttaagggagaaaaatttagactataactggagctacgtgataagagttattcagaatgaggctgggatattaacattgttaactcaaagcaacagtcagcattagaactagtgttgggatgagggtttagggaagctgctcataaaacctgcagaatggtacttctggaatattctctcagctcactctgcagacacttcccagcattccttgggccattgcagaagcaacaatgatgaaacatcacttactggccataagatggcactgtggtccactgggatctaaagggctctggggagtctgggagagcagcctaggagggaaagggttaagaaaaattagggcttagatccagtattatgcagatgttgcagcagttttcagttttgccagactacctacagctatgcgagaggtgggaagtccctctaaactttaatgagatctacagttgaataattttggctggacagctttggtgtcagggacaggtgcagaggagcaactgcctcagagaaagctaggggcaggatgtgccctgagcccagtgcatctgcgctgcacctcatcttccctgcaggtcttgccaggcaacagctttaacctgctcaagtgatctgggattctataagtttgtaagtcgtactgataacatcatcttggctgagattccattgggcaccaagcacgtgtactctggaggacaaaaaatattgataacagttctaaaacactcaagtaaacaaactactgaaggaaaatgttaatagatgcaccaaactgtactgttagacttgaaaataatcaactaatagaattatcaaaaagagactacaaataaatctttactaagtatttgtgggcatcgagcagtgtctgagtcctctcagggtagattaaggaaggagttcagctattatcatgactttggcttggatgaaaatccatgacctcctcaactgattttcttgtaaaatgttacagaataatattgagcaaacattttatttttctccagcctgtatccctccttagcactaacaggtaaagcggacacctagaggcacggtttctttagttgggatccattaactgcaggactcggaggtccatagctgggcttcacagggagtgcaaaccccacgtgcaaggaaccccgtgtgtctgtgctgtgcccaactcccttctgtgaggctgccaaaggcggaggtccgggtgtcccaggaccccactcacaaagaggggagcaggctgcttgctgggcaaaaaaatcagttcaccaattggccaatatgttgaaaaccaaaaagaaaggaaaggctcaattgtgagactgacgaacacccaatttcccaagttatgaaatttgtagcagctcatggttctcagaatggtttcaacagcctatgaagatatttttagaaagtttttgtttgtctacagctttccttgatattgatcctcaggtttttttcagcccactcatcacttgaccttattttgtggccaaatttcagtgttgcctatttcagtcactgagcacttctcattctccaaatcttacacagatatgtgtgttcctgtcttttcttctttttgtgtgattcatttttaaattgggctgtgcagaatacaagcatacatttgtaaatgactcccatcttttatgcaatttagctgtttaatttttagtaatactttttatttaaggtgtaattaatacacagtaaaacacaaatattaatacaaggacatcctggtacattttgacaattgcatgcgccagtgcaatagtaactaaatgattattaaaaaactttccatcactcaagaaagtgtccttatgctcctttccaatcaatttctatcccagagataaaaacttttctatttttatcaccactgactagctttgtctattcttcagtttcatataaatggaaacatatttttattatttttcttcaaaattagtagttttgaagtgtattcatattgttgtatcagtaggtcattctttcttatgactaatattccattgcataaatataccacaacttgtttatccaagctcctgttgatggatatccacgttatgtctgtcttcaactattatgaataaagttgttgtgaacattcttgtggaattctttcttgcgaacatatgcattcttctttttttttttgatatagatttaagagtggaaatactcatagtgtagacacgtgtgctatgcttgcgtgtccccacaaaagctcatgttgaaatttgtcagtgtaatggtattgggaggtgggacagttatgactaggtcatgagggatctgccctcagaaagagatcaatgcccttattggaggggtgaattatgtcttgggaacggtcttctgataaaaaggatgaaatcagctgttttctctgtcttgggtgcttgcttccccttccttctgccttggataacagcaggaggccctcatcagttatggacccttgatcttggacttcccagtctccagatctgtaagccaaataaacctcttgtctttataaattgcccagtctgtgatatttctctatgtcagcaggaaagacattgaaagaaaaaatggtaccaagagtgaggctgttgctataatacctgcaaatgtagaagcagctttggttaatgggaagcggctaatggatagaggttgaaagaactgggaggagcagactagcaaaagcctagactcctgaaaacagagcattaagggcaattctggtgaaggctcagggggaaatgaggaacaaggtatcggaaattgaagtaaatgccatccttgtggtaagtagcaaaatccttggcaaaactgtgttctgttctaggaatttattgaatataaaaattatgagtcattcgctaggatatctgctgaaagaaatatctaagtggctaagcattcaggctaacgtgtgactactttcaggcaccaggaaatttaaccaagcaagaagggagccaagggaatagattttgcaaaccagcacagatggtgaccctacctccctctgctgtcccatctccaataagacaaattctgtgctgttagctgttaaagccctagaattatttctgaggaatctgtactcttcataatttacagacaacccagctctgctttggatctgatcagatggactaaatcttggggactctgcaccactggccactgaggaaagggaagagaatgttgcctgggacagaaaatatagtaagaaacattggtgtgaatctagcatcagaaagatgatgtgaggacagcaaggaagagcaggaacctgaagtttaatcaggctcctcgccctctgctgatgggcatgtgtgtgagctccagcatggagcaccgcagcactaggtcagaggagagtaagagggcgatggggcagcctgtgagctggggcagtgtaggcagaggagtaactgtatcatcacagaagcttctgccttcaaccatccctccagctctgcaggacaggtagagagtccagggtctgtggggcactagacctaaggaaggcttcctggggaggacacaggacagcgacatcacaggatacccctcccatcaggaaaatgaaggcccagaactcactcggctcttccccaggaagaccaagccctgaatcaggtgcagtgccgcctggcccactgtgccatgggacccaggctcctcttctgggcactgctttgtctcctcggaacaggtgagtcctgggcacaggacagcagccccattctcagctttcccaccccagtgtcctccactttaccttggggaggacctctgggctgtctcctgagctcatcctccatctgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagcttggcacagcccagcagaatcactgacattctgtatataaacttcctgccttagctttgacttgagagctgcaggccccactcagtcttcactccttcaagggaagcttttagttgtttggaaggcatgtcttgtgtcctactgagggcacagctctcccaaccaacagagcccaggtttcctgtgccctgagtgtgcccacttctccgctgcatcttcttgcagcttgtcacttcctgggtaacttcagtagaagagtgactgctgagccccagatgtgtgctagattctttgtatttgttatgggcttaaagccttgcaacaatcttgtacatcaagcattcttattcttccttgacagatgggatgctcagggacattgagtcattttccccgttgtctcctggcttgtaaggatcagaagtaggaaacaaagtagtccatccattttccacctacccccctgctccatcatcaccttctgcatcctggtcagagtaagtcagaaccctcacactgccctctagtgaccagcagggccgcagcagaggctcagatgccttcaggggtcattactatggcctcctcattagcaactttgaggaatgttaaatttcacactttctaaaaatcatttatatgcattccctgtgtctttccccagtctgcagcttatattttcatttaatggtgttttttgatgcacaagagtttaatttaatgcaacaaaaactaaaaacaattttgtttgtgtgtagacaaaaaccgctttcccatataagtgtctaaatatatttttctcaatttattctaggaaaatttaagtttggattttcatcactaagaataaatgtatctgaaatatatctcatgtaaaaaataaggtggaaacctaggaatgggagcgaaggacatatgttcagtgaagatgaaatagtgtgtcaaaaagagctggaaagtagacacccggagctgatggtggagaggtaggtggagggcaaataatcatgaaccttgtcagtttgttatcttgtataagaaagacagccaggagtagagaccacatgggcaaaggtttatggctggtctgtaggttgaaggttgcagcaggtagagggaggaatagcaggcagagggcagagtcactgtagggcaggggcagtggcatcatcagttgactttactgacatccaggaattatgtccctaacacacaagctgaaaaacctcccacaatttgcctatttttccctgaccctgccatggccaccagactcctcagtggtgtggccttttgcctcctgggggcaggtgagtgccttaaagccttttccttggctcaccacatcccagcctaagcctttacctcaggtctacattattggggtccctccttgggcactcaacttccttctatcatagatttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggaaaatatagatggccttgtcttcacgagaccgtgatccaggcagtggaaaacattgtcccataggagtctcccaacactgcccaggctggggccctcagatttctgagcagccctgtgcatgggaaactctgccctgtgctgagcttctcttccaggccagtctcagctggacgatggaacgcacataaccatgctttgcgtggatgcagcctctcttccaggcccctcctgcagctctgacctcagaagtcctcttcctcagctgctctcagaaaggaaagttcatttgaaattgtatatttgcagacagcattgacaatacaggtctatgttcttttccctgtcagccttcacaagtccatcttccccacaccacactcacgtcagtcctcagcctcttccacgtgatgtctgctcccagctgtcttctcccttcctctgcaccctcaccttcatgtcaatcacagatgcctcaattcaggcccttcctcatgggtcatgctcctcccaccaaagccctttccactccatgctgtatcctctggctcatcagaagtctcttctcttttgttctttctccaaatctcagtttaactaccaccatctctagggagacactccttcaacagttttcctaggctgctcctccctattgtaaatgctcacagtttataatatgcattaatattcatagacttagcaccatagtcatttccctgactttgtgtgactgtttgacacttctcttgcattctccactgtaaaaggcatcattctagaagttgtggatgttttgttccccattttattgtcagtaccaacagcggttccaggtgccactgaccaatcttgaaagaataaagaacagatattgaaaggccctctgagttcccacatagactgttccagaagtctggacacattaaatgggaacttctatcccttcatatcctaggatcaaatgagtcctggaaacagaggagaaatccctgtcatggatgagtaactggatccaagcctttctgcactactgaacttcctatctgcccatcgccttcctgcctagtctcctccttcaatctccttccctcacaggtgtcctggatttgggagtctcacagacacagcgcacctaatcactctgagagagtgatcagaaacataatgtcaaacactggcattaaaaggtcatggagaagaaaacaaatgccttccccattctcttaggcagagtgttcccaaggcacaaatatctctttgggtggctttgaggccatgctacctgacacactgagctatattatgggtgttcatttccatgaattggtgggcaatgctagagacacagacctgatggtcaccagcttcctccagcccacacctgattttggtgcagggcactgaacagagacctttgcttattcccctcctttgccagttaggaaaggctgattgtgaggcagaggctccacttacagagcagggctatgtgttagtccctgaagaattgtgagagccattctgggtggaaataatcaaatatacaatcaccaaggatggcccacggacagactgaagccccaattttgctggaatgatttgcatctatgctttaaatacgaatgaagttttatctctttaggcaataaagaccaaaaatagactagctattttaaataactgaaccttaaacaaaccaaagtcagaacatcttccctagggacagcattttcttctacccactcactaaagctgtatttgagaaagctgtgtgctgttgataaacactggaatatcattacaattgacatcgtaataatactgctacttggatcagaaacaaagagcatttctaaagcttgaacaatgtaaaactggaaacgagctctcactgagtttggaaatgcaggcactagagggtgctcatttctcttccttttccaatcggaggctattcaaaggctgttctagaacaaggggtgagatcctccacttctccgtggtgatcaggctttcagaggtagaagccttattggttcataatcagctgaactgacctcaccatcaaatgtatcgaccttgatgctcaccctcctcagcagtcagagactgtgttcaccaggagcttatacgcttttacatagtacactttatcctcggtttattccaaaaaatgggcatctataaggggttccataaacagaagctttctgtactttgcccatttagacactataaagtcagacaccagctgaaaggtgtaacttaaaagcttgtatgtggtgaagattttttaacaaataatatataatgaaaatgtcaataacgctctcaaatccaatcccaccttccactggtcaccaatattaacactctggtgtgcttcttttcacctctcttttctgtgttcatgcacacctttctacccaagtacacctacagaaaatgggttcacctgtacactttacctgtcacatgcatactcttttctgttaatataccctggtcttattgttccagattggtcaatatagatctaacttgctcctattagctgcttcatattgcataatgagggtagacaggtacaattgtgctctattgtctaattcctgaattctgccagatcttttctaaagagactgaatggcctctttaggcttccaggttgtcctcaccccagcccccagttgatgattccagcatttccatcactcatagtcctggcaggtttgagagctccattggtttctcctgcatgaggagacagggagggataaaaggatagacctttatcaatcctaccagacactacacagtatctcagttcgtcctcctaaagcattgaggggaatgttagtcttgttttatagatgagtctagatgcagctagagtccaggaaggttaatgaatggccttgcccatggtctcagagctaataaatgttggaggcagatgaagggcagtcagcttgcttccatgtggaattgatagaggggtcactggagtttgacagaggggaagtctagaaccatctggggttgttttcagatcagacaccacgggtagtatggtctgtgtaccctacagcactgtagatacaagcatcatggtgttggcaatggggaggtactagagaggtaagtggctactggcctggaaccagaagatcatagctttgaaaaaaattattcccagcacaagatgtagcagagacatcaatgtggataaactaggccagggagctctgtgaagagctgttgttaaaatgagggagggagaagcaactaagtggtcacttcctatacattaaatgtagaggaaaacaatgttaactagaatcccatctgattttagtcagtttttcgtttaagtagttggaaggtgggataatttattttcaagtttaagtaagcatctatacatctcctttaccttgtgaagactggtggcgaagggaagaatggcaaggccaatggagtcacagtttaataaataactcagagttcaaatggagactctcatgggccagaaattggtaaatgttcctgcattctaaaattaggggaatcttattttctttgaatcagcagagacggaagcacaggcagtggggagggacagttgggaatacagcagagtggccacagaatgtcgaagaaaaaggacatgtaatgccaaattctaagctgtgaagctgtgatgcaaccctcctccttctcctaatggtttttttaggtctcagatgcgcacctgagggagtaatttctttggaaatgaagaacaaatagctgtgttaaatcttaataacaagtccaccttacaaagcacaactggaaatggaaacaagattatttctaaggccttttctactctaagagtctttaacttggtggcaaggtgagaggtggggggtggggatggtgttgatccacatgcgatgagtaccgtgaggctctaccatgaagaatacatttctgagtgtgaatcagagccctaagaataatgccctttacgttgtttgggaccaaacccacctcacccataattaagcagccatggaaatgaggagagccagaaggaatcaaaccctgctgcttggttcagtcgacagaaggacctggtggaaggatgttggctgggtctaagagaagatgatgagctcagaaaacagacaaagagaaatcccaggcgaaagcttctgaaaccctggaggaatcacaagtcaaatttctcccagaagatggtggcagtgactcaccttcaggtacaactggctggtgctacagagctaagatggacttagtgtgttggcagtttgcaaaatctgggccatttggtcattttcttcagtgactttttaaagtgaagttttacttccaacattggcctgatgtgtgggtctgttcttatgggggttagggttagagttgctccattacttgagtacccatgaagtattattggtcatagaatgagcaggattatcaggagtagaaggggtagggagagggagaactgttaagtgaagcagtagggttgagtgaagagtattttagacatatgagtacatagagggatgaaagcccagctagcccccagcccccatagaaggaagatcaagatttgacaactaggagaggcatgattacaccatgcagcttgatcaaggactgagaaagctttctagacaaatgacaggtaatgacccacactgtgaatcggtattgaacgtgagatgtcaatatatattcatatatccacttatatatctaaaataagaagtccttacaaaccctgaaaacataaaccctcactattacaggatgtgcaggtgatttggatcctgtgaagaccctcaaacaggattaaaatccagtaggcagaggtctctgattctttgttagctacagaggaagatgtgctatgatggacacctagggggtctgggggtcttcccatccccttcccagatccacacctagaggaatgtcaggcagcacaattcagagaaccaccagaaaagctgtgagaataggactccaatctgaatccagcttctctcagctctgcaccccttgctgtgtaggagtcagtgcaggagaaagctgactgggtgagaagagaagggatcctgaaccatgccagaggagacctgtgaactgggaaatgagcagcaacagcaccaccacagacacacactcgccaggcacagggagaggacagatcctggcctcttgtagcaccagagctctgaacgccctctacctgctcagtctcccatgggatctaggctcttctcctgggcgctggacatgccttggtttctcaaaaccaggtgtgtcctggatgcacctgggggaatctcagctctgaatatgccaagccttgccagaggaaccatgtattttgaaaacccacggggtctgtgttaaaaacaacaatttccctctcagagcatgatgggattccatgttcctgcttagttgtgctttgtctcctgggagcagatggctctggaaacctctgagggaaatccctgtccctgcaactgctgtgcctcagttccaaacattccccatgcagtctcctacgtcctagctccaggttctatctccattcatgaaactgtgctcacacagacctcttgaaagcaggtaatgggtatggagcagcaataggtgtgaatacatcctactttatggcatcatctatgggaagcaatgtcagctggaaatgcaccagcatgaattttatactattgtgatgtagcacttctgagattgaaggtacaatggcatattccaagctggtcaaccaaacatctcactccatcagctggacacacatcccctagtggggtgggattctgtgggtctccttttgccagcagcaaagaccttgctgaaccatctcctctgctttgcttcaaacttttcctccactttgcaggatcttctcaaatctgggtctaacttgcctgcagtgagaggaattgtgactattgtccctcatatgaaagagggtgcccatgaagttttaagagttaagttaggaatgaaaatgagaaattaattgctcataatgcagactgttaggaaccccaaggattaattcaactccctattttttaattgtactactcccatcacaatgtcaagggtaaaacagttctgactttttctaaaggctatggaacatttattgatttcagaggtgacttagaaacacaggaggtgtcgtgataagtagtagagacaaaaaagaaaaagtattgagattaatgaattcatatggggaattgtttaactgttctttttttaacctttagaatgagttgaagatcccaacttagcttggtgcctgctggaggcaacgtttcttcccttgcccctctgagctgtgaattgaaactctttcgggaaaaagacgcggcaattctctccacttcccaaacacctcccactcctacccagaccgtggatgggcaggaaatgcaggaacagagccagaaacaggagatctccaaggaaggttgacagtcagcactgggatcgtctgtgtaaagtgctgctgaagcagccaggtggcatgtccagccgacaatgcgaaaggaaaaagtgagaagacttcccgaaggcggagggtggaatgcgggcagcagccccctggagggctgagtggggaaaacaaaatggacctcacagaagctgtgtgtgtggaaacccacttctgacttatcacttgtcatgaattctatgcttcatggtgttacaccgtttattgtttctgatgagtgacagtaattattttctttcttgctggtacataataaagtggtgcacatcagagttgctgccatcttagacttaactcatcagtatcaggtgatcctgaggctcagtgatgtcactgtgggaactgctctgtggcgacaaggacgtccctcatcctctgctcctgctcacagtgaccctgatctggtaaagctcccatcctgccctgaccctgccatgggcaccagcctcctctgctggatggccctgtgtctcctgggggcaggtgagtcctcagaacaccaagcaatctcattgtgtctgtgtatgtctgtgtgtgtgtgcgtgtgtgtgtgtgtgtgtgtgatgactacaattgttttcctcctgttcccaacttgtatctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagccacagcatggcacagtcgcctccttcctgctcacaaaccctcaggcacttacttctccttccagctctcagaagccctgaacaaaggagctgccctgctctttcctcagcaaggagaatgaatgcatttggaactgcaggtgttcttctgatactaggaggtcagaaaataacctctgaaatacaggaacagggaatactgggtagtaataattttgacttatggatttctgggattccttatatatagttcaaatttccataattaggatataacagagcttagtctcatggatagtgactaagtaaatattcttttatagaactatgaagtttcagcacatttatattaaactactgttaccacatgtcaccaactcagacctataatctaccaaggagtggggaagccaaacgcaaacactgctaaggccatttacagctaccacccttggaagaaaattggaatctttagtaagaatttccatcaaaatcaattttttagaaataactattacccacaataatgcacattaactcatgttcatacattgctttttttccttctgaaaatcttgtagtcattctatgtttaatttccttcttctccagtctaacttaaaaaaatagaaatacaaattgagattgtttcataagataaaccccacctgggaaggtgttaaaaggacacaattcaaagaaaacctgaataaaattatatcaaccacgtaggattctttgaggtttccaaagaagatgtaccagtttacattcccacgagaggtatatgagttttggatggaatttttttttttctctctctctctctgtagattagtttttccctctactaatagtttctcttgacaaacagaagttcttaagtgacaatcattccatgtttctcccatttcagttagtgttttgtattttggtgtccactttaggaaatccttgcttacttcaaaatgatcatgttttcttacatttccttctaaaatctttatattttccacttttcatacttagactcacaatcgaactggaattaattctttgtaggtgatatgaggaagaggtcaagttctatttttccaaatgattattcaatttacccaatactatttaagtggtaatagtttcaccatcactcgataatatcacttttgtcataaatccgtcattatacatgtgtggccttttttctcggatctctattctgttacattggtctgttctgtcagttctcgcactgataatatgctgtcttactacagcttcatccttattcttaatatctggtagaataatttctcaagcttcgctcctttttatcaagtgttcttgagcactcttgacactttttttccatatacattttagaatcagcttgctaaattattcaggaaaaagataacaactgctgggattttttttgtttttgtttgtttccaactgatttaagtgcatcacagaacaaagctaaaaatattaatagaaatataaaaatatctaccacccaaaaatataaaatacaaaatatctggcatcaatcaaaaattacagacctgcaaagaagcatgaaaataggatctataaggaaaagaaggattaattaataggaaccaactcagaaatgacaaattggcagacaaagacagtcaaacagttactataactctggtctgtaagttcaaagttttgttgagatggggaaaggcataatgagatccaaacaaagcttctagagataaaaattacaatgtctgtgatgaaaaatacgctggatgaagttaccatcagattagacattacaggataaaatattaataaacttgaagaaataacacaaacaattcttaatgaaatacagagaataagtgggggtcatcagtaaactgggggacaactttaagtagcttaatatgtaattagagtcccaaaagcaaatttttaaacttgaatgaatttctttaaaggataattggctatttacactgaaataattccaaaacagtgcagggattctaatatatgcaaacataaatctataacaagactagcataaagacaggtgaggaataaatgaacacatatatcattggaaggtttccataatctgagtgaagtcacttgaaggcagactgcgttaaagtagagatgcaactgaaaatcatagagcaaccactaagatgacaaaacacagcattatagttaataagccaacacaatacagagttataaaaatgctcaaataatccataaaaacaacataaaaagaaaaaaggaatatagaagagatgggattgatagaaaacaaatagaagatgatagacccaaaagtaaccacatcaacaatcacatcaaatctaaatagtctaaaagcacagattgtactattgaatattatcgaatcatatcaaaaaaacaactatatgctgcttatcagaatactatgaagactcagaatgtaaaaaaatataaaagtatggaaaaagatgtactatgccaacaccaattaaaggaaagccagactagtaacgttaatatcaaacaaaataaatttcaagcagagaatatcatctgagataatgaaagtcatatcctaatgacaaaagtattggtctatcaagaggttgtaacaatcaaatatttacgtacctgaaaatggatcttcaaaatcccaaggcaaaaacagaactgcaaggagaaacagacaaatccacaattataatcagagatttcaatagccctcttttagtaactggtttaacaagttgacaaaaacaaaagacaactaaggatacagaagatatgaactacaccaacaaccaacttgacttaattgacgtttacagaacacttcatccaacagcagcagaatacatgttctcttggagtgcgcactgattgtgtgccagcatggactacgtacactgggccataaaacaagcatccatgcattaaaagtattcaagtcaaaccaagtgcactcgctggtcacagtgaaacttcattaaaaatcagtaagagaaagatttctggaaaagtcccgaatatttcaaaattagataatagttgtctaaataactcataaagcaaaaaataaatcaaaagataaaagataatttacaattattttaatagtatattttggtcattttttttttctttttgaccaaatactggtgagaatgaagataagtaagacctttcttttttattttttttttaagacggagtctcaatctgtcactgaggctggggtgcagtggcatggtgttggctcactgcaacctccgtctcctgggttcaagcaattctcctgcctcagcctcccaaatagctaggattacaggtgcccaccaccatgctcagctagtttttatatttttagcagtgacggggtttcatcatgttgggcagcctggtctcgaactcctgacctcaggtgatccacctgcctcggcctcccaaagtgctggggttacaggcataagccaccacgcctggcccaaatctttcttttttggggtgagagtaaattgtaaaaccgtttttgatgagtaatttagcagcatacatcaaaagagttaatactgctaacactccttgacccagagtgttttttatttaatgaatttatttcaaggaaattgctatatatgcataaaatgtttgagaatgttcaacagaaaagaaattattttaaactgaacaaatataaaaatatatcaaagttggtatgatgctgccaaagcaggactgaggggaaactgaagaacaggggataattttctattcattctgaggccagaactactctgataccaaaacgagactaagagattccaagaaagctgctgactaatatctctcaggaacacagattcaatgatccttttaccattacagcctagagaatctgacaatatgtaagagggatagtacaacatggtcaagtagggtttatctcagtaatgcattgttggtctgacattcaaaaaacagactatgtcatttaccttatctgtatgaaaaatatgaaaagtatatgatcatatctatagataacttaaacatttgataaaattccatatcctttcttgaagaaaactgttatcaaactcagagtaacaagaaattttcttcacctaaaaaaggacatttatgacatcctatggttaaatagaatatttttgcaagcaaactgataagtcaaagatgcatatgtaattcccagatcaaatactagaaacagcaaaaagaggataaaatagccttttcagcaaatggttctagaaaatgggataatatggaaaaataatgaatctctagccttatctcactccataaccagatgtgggcaaactatggcctccgggcaaatttggcctttgtctgttttcatacagcccagaaactaacaaaaattttacacttttaaatgattgaaaaaaagtaaaaagtattttgttacatataaaaatctaagatattcaaatttcagtaaacataaatgaagttctattggatcatggccacagtcattcgtgtatatattgtcaatggttgcttttgcactacaatgacagaattgagtagtcgagacaaatactgcatgatgcacaaaactaaaaaatttattatttcaccctttacaggaaaactgctgacccttcccataaacaaaatttagtaagagacacaaaaaaaatcccagataatcgaaaaactagaaactgaaagcttcctggaagaaaacatagcaagctctcttcatgatcatggggtaggcaaagatttcttaaggacaaaagaatgttctaaccataaaaaaagcaaattgttctttatgcaaatcccaaaaagttcttcaaaatacattacgaaaaaataaatgtatatctgagaaagggctggattcatattataaagaattcctacacatcaatcataaagaaggcaattcactaaaaacaaaaagttgactagagaattaaaaaaaaaagatatataagtaggcagtttcttttcatgagactaatgtgtttatttctccagacttagatgattgtttcactgatagcatgtcactgtcagctgcctccaggaattatctttggttaaagggaatgctttgcccaggtctcaccccattcctatggcagctggcatttaatgactggctgatatctcccttcctacaccattatttgatgaaatttaaaatttaaattaaaatgaaaaatttttctttcttgtttagaaagacatttgctttatgtctccctcaccaacctgtgcaaaatttgagtttgaggcaggtaaacctgaaatcagcaagagctgtgctgtgtcctgagagatcccgatggtctaatttaggaagcacccagtctccctagtcagggtccttagagcttcctcatagtgactacacactggccacttgggggcactgtggatccactgagtgggtcactgatagcgctgtctgagagagagagggttaagggagacagtcttgatttcgtctctgtatcagggatattaccagatgaaccagaggtactgctggcacaggaagagttaatcatagtcttatcagatcaactgatatgcaacgtgtatttgtcatgacaggaagccatgaactgaagccttgtgtggcctctctagcaacctaggtttgatggggagtgtgatgagggtttcagcagggcagcctggataacccaagccaggtggagataaaggagcatctgcctcagatgaaaatctcagaagctgtgcggatggctgtctgcccggaagcctgccccctctgctcagcacagctagcttcccctgctctgcaggaagctggacaggatgggggaaagcctgagttagctgagctagtcctggagtacagggtgcctatgggagcctacaggacgatgacatcagaacagtgacatcacagtaaaaacctccaaaaaacggtgaggaggagcaaaagccctgctttctcaccccaggagaccagcaacctgagcagggagatgcttagtcctgacctgcctgactctgcctggaacaccaggctcctctgccatgtcatgctttgtctcctgggagcaggtgagtcctgagtacaggtgggacatccctgtatccacagtgttcaattgttgctgaagtgtcaaactctcccgagctgagtcttcagcttctgtctccttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagcttaggcacagaccctggagaattactggctttctgtacccaaaccctcctatctcacttgaggatgtaatagggagaaggaggtgggggctgccacacaactttagccaagccccagagatgcttctattcttttctaacattttcccctgccctgctgagctcagtgagagctcctgcacttgtgggctccagacccactggaagttctcacatcttagccagtactttttaattcctagcaagtggcgggagcttctactctgtgccaacataggggtatatgttttagtgtgtttcctgttgccatacagaatacctgagactgggtattttataaagaaatgaaatttgtttcttacagctctggaggctgggaagtccaaggtcaaggacccacatctagtgaggaccttcttgctggtgaggactctgcagagtcccaggtggcatagggcattacatatgagggggctcatgaaagatggtcaaactggcttttataacagacccaacctcataactaactaattccttctataacccattaatccatgaatggattaacctttatgagggcagagtccttaagatccagtcaccttccaaaggtcctacctctcaacgctgctgcattgggaaccaagttttcaatatataaattatttaggaacacagtcaaatcatagcagtacacattgcgggttttttttttttttcttttttgagacagggtctcactctgtcacccaggctgaagtgcagtggtgctgtgatcatggctcattgcaaccttgagcgcgtgggttcaagcaatcctcctgcctcagtggcctgagtagctatgactacagggacacatcactacaaggtgtgtccccagttcctcagttcctacaaggtgatgtgtccccttgcctggctaattttttttaatttttatttttgtagagatgaggccttgtcatgttgtccagattagtctcaaactcctcaaatgatcctcctgagtttatgtgttttaatgcaaagatagacattagcatatccactttatacatgtagaagatttcagtgtaccattttatagataggaagctgtggctcatgaacttctccagtatttcatatttccaaggatcaaaggcaggatccaaacctacgactccatgcctccaaaataaaatttctaaaattctatagtgtttcctgggccttggtcaatgagctacagcagagcactattcttccatctcaagactagccaagcagtagaagaaggtcacatattatggaatgtggttactatggcttatggcctgccaacctccaggacatataacttccagccagagaatatttgtcctgttttagttccatatagaatggggccacaatatgtcctaatatagacatatagtgacaaggggcatttctaatacatcacagggttcagtcaaggaaacagaatcctctaggaattccaaggagaataggagttaatacagggaattagtggttataaaccactggaaggctgaaaagtgggagggtctcagaaggttgaaacttgcgctcaggtccaccactagtgatcacaaagactgaagttgctacttttgcccaggtcagggactgctggaaatagctgagagtcatagtggtcttgcagtgaccaagagggtgattcacaggaaagtatccagaggtcattgcaaatccacctgtctgttgctgtcagataaaagtctttattctgcttctaacttttccacaagtatagcttactgggggaaacaaaactgttttcagaaacttgctctcaggagaatctaggaaatgtctttttcttttttttcttttttttttttttttttttgagatggagtctcgctcagtcgcccaggctggaatgcagtggcgcgatctcggctcactggaagctccacctcctgggttcatgccattctcctgcctcagcctcccgagtagctgggactacaggcacccgccactaagcccagctaattttttttgtatttttagtagagacggggtttcaccatgttagccaggatggtctcgatctcctgacctcatgatccacccatctcagcctcccaaagtgctgggattacaggcgtgagaccatgcctggactgggaaatgtactttcaagtcttctagctcttgcaataagagagagagagagattgttggaggacatttaagggtactcagtgccaaaagacaatcatcagcacacccagctatgcagcagagaaatggaaagcaggagaataaattttatattttctgtcaaattgttacatgaaaatttattttatatatatagctttgctgttgtcatttagttgttgtttacttgttaatttattcagtagatattcctggaatacctattatgttaaaaatttccttggaatacagaaaatgagatgtaatttttcaaattacacattctgtctttaagaagtctaaagtctggcaagataatatatccctaattattcacacatgcatttacaatgtatgaaagtcatttcaatcagtcagttttctggcaaggaacagatgacacagtcaaaaaggctgaagtgaaaacaatttaatcgaaggactatgtttagaggggtaaacagacttagggacaccaagaagtgtttgagggaccaggggtttccagcacattgggaagccagtacaactaactgtggggcctatggaaaaaggggtgggagggaaattctgtgttactggaggtgcatgcaagtaatgagaaaagtttcccaaaggaaggaattcaggaccagagctaggaaggggaagcccagatatgctgaactttctcttcactacccttcaatgtccagctggtgtcttccattggaaagcccagctgaaagcctggatagcaccgtttgctgacatcagtcttcaggggcacagtccagggcagtaaggggcaggcaggcgagagtcggttgtggggaactttgggtgtgcatgtagaacagccagcacagcagctaccaagtgtatgatgtgccatttgcagatgcatgtgcaagtacacggtggacagagaccaacttaattctacatcttttatgtgaacttagagaaaattgccttgttgattgctaataacaagcaacatcgttaatcccattttctctgggccatataccaagtacattatttcaattaatttcttaagaacttcaaaagggagaacaatttactcccatattacaggtaaaaaactgttagagaatttagattttctaaaggaggtacagctaacaaatatagaacttagactcacacctaggccatactgactttcaacctatgcttgaaggttactccaccctatacattttggtagaggaagataccttcaacattggaaatctaaatgtctcttttagaaacaatgcatctgacacaaaccatttgaataacatctttcatgtgggaggctgcacgctaaagaggaagatcctcagagatgaggagacctcagtagttcatcttctgatcccttgggtcagtgactttgaaaacatttggctaaactgaggccaatcatatatgtcttacagagattttatacatgtaaataaaacagagtctaatacatagtataggctcaataagtcttaggtccctatgaattttctgacaaatctctagtcaagcagttatttactttggcaatctggtaacaaaggcatacacgaattacttttgtctgattcacctatgattcagacacaaagtcatctaaaatgcaaatatagtagtctgataattcattggcaaaagtaacacaaacagttgtgtcttaagagaaagtgaaaatgttgtaccttacagcatttcctgcttgatactgagtctgatatgcaaggtgtgatgctcccagaaagttgtgaattcagagcaatcctgatggattccatctcctgttgctccagcacaaactcaatattgtacctttatcctggtttcctctctccctattttattctcccatctctcttattcctaattcctgagatcctttccaaaataaactactttcaccaaagtccatgtctcaaactttgccttcaggggcagcttaaaactttgacagtgatagaatgagatgaccctctaagacacttctctttgaaaaaggccgtggttttcttttagttacactgccatgcattcattcagaagtcctataatgatatatgaactatctcttccaagttcattttgactcagtctgagtttccaacagactcacatgggtctctgctcagttaaggctctgagcttatttgtaactgaatagactaagtttatgtttcacagcttcagggtctgcatggactcagagaaccattcatttctttcttcagtcattcaacaaaaatttaacaagagtatgtgcggagtagatccaagttttgcggaacatgaggcttataaaattttagggatcgctttgaaaaagagaatacaaaatgagaatgtcttgaaaaaattctgtgcaaggccaggcacagtggctcatgcctataatcccagcactttgggaggccgaggtggttggatcatttgaagtcaggagttcgaaatcagcctagccaacatggtgaaaccctgtctctactaaaaatacaaaaattagccaggcatggtggtgggcacctgtaatcccagctacttgggagactgaggcaggagaaccacttaagcccaggaagcggaggttgcagtgagcagagatcacgccattgtactccagcctgggtgacagagtgagactctatctcaaattaaaataaataaataaattctgtgcaagtgagaaggcctgaagttattcttcattgacttcatggcaaatccacttctagctagttaccgtgtgtaggcaccatgtaagtgcttgagaaacatcagcacagaaaacaggcaaaagctgcaaaataaggtgtatgttttcaacaaaagaaaattggtaaatcaataatgatcaagtaatacaaatgtaaatacaaggaaaatattcctggtagatgtttatctccccagagaagtcagagtattgttgagaattctattggtggatcacaccttatttattgatggatcacaccttattttgataacaattctcagagctcttggattccatgtgccctactctaaagaatctgagccctgagatggaaagctctcctttcctgtcctgactcaaccatgggcaatgatctctttttccgtgtgccttttggtctcccaggaccaggggagttctgggcatagatgggaaagctcttcctgggctttccaggccccagccacagcctctccatcggggtgttcatgggtcccctccctgtctccacttcagattctgtatccattctcactggagcatgagtgtaggaattacccacccaggttacatcaagatgtgcagtcacaaaaagggatcctcacactgagatgtgtcctgtatctgaaataacagtagtaccactattgactagatgtaaattttgcaccacagcacatttatggttcaatcaatatcctcccatttgtatttataagaccttctgaatggacacagggcatttccctatgaccttaaaggcaccaggctagtgtacttctgggcaaatatctcatatacatccctaatgagcttcctcttatttttacacaaaagaaaaaaaggagggtgggttttccccacatagtccatccactcacaagccaatctcctgcagaaataccctcacagatagaccaagaaatgctgttgtaccagctacctaggtatgccctagcctggtcaggttggcacctaaaattaaccatcacaaaactcatgagaacacagaggtctgagttctgatgatgagactcctattaggtgatggagactcaggtggcctcccctaaaacaaaaggagaagtcatatctgtattagtcatacatatgtgtatatgtacatacatgtatgtattctgttggttctgtttctctctgaggacgaggtggcctagatccttccctttctgggtaaagggtggaagcagtgtggatcattacttagtgtgttctgatagccatgtgtcactatgtacttgttctttgtgtcttcacatctcttcctgttgcattttaaagcattttcatagtatgtggtgttgcctagcagagcattctcatagcaaaaaaatgtatatatatatacatatgcatatatatattctattggttctgtttctctggagaaacggtatatatatatatatatatatatatatatatatactctccctgtatatatagtatatatatatatatatacactctctctctatatatagtatatatatatatactctctatatatatactctcctatatatagtatatatacactctcctatatatatagtatatatatatatacactctcctatatatatagtatatatatatacactctcctatatatatagtatatatatatacactctcctgtatatatagtatatatatatactctcctatatatatatatatatatatatatatatacacacactatatatatatatgggaagagagagagagaaaaagaaagaagagaagagaagagaagagaagagaagagaagagaagagaagagaagagaagggaagagaagagaaggaaagagattagggaaattggctcacgtgattatgaaggctgaaaagtcccccagtatgccagccatctgcaagctggagatgaagcaaagccagtagcatgactcagtccaagtttgaagccctcagaccacagaagccaatgttgtgtctctcagcctgagaccaaaagcctgacaacccaggggattgctagtgcaagtcccggaatccaaaggtaggagaatctagaattctgatatccaagggcagtagaagacacatgtctcatctctgagagagaatgcaaattcaccctttctgtgcctttttgtttcatccaggcccccagctgactggatattgccatacacattgagagtagatctttcccacacagttcatcaatttacaagccagtctcctccagaaataccctcacagacataccaagaagtgttgctgtaccagctatccaggtatgccttaatctagtcagattaacacctaaaattaaccatcaaactaccagcgggaacacacagaggtctgagctctgatgaggagtctcctgtgaggtgaactaatgtgacagggcataaaacaatatacaaattgtattgatcctgaccttaagactttttgaaaccttcccagatgtcaggtggctcttttaacagaggccagcactgtaggctgacatccagttatccagagtttgagaaaagataaaatctagtaaaaggtacttagaggcaaatttgaggagatgagttataaaggacaccagactgccacgagaatgtcccttagactacataaatattagaaacaattaaaacagcatataaatgaggaattgtatcctaatgggaataaaatatgcagagaggaatgcattttctttctaataacctgcaaagagcatatgcacttatgtctttaaaaatagtctacaaattattcccattctgagctgttaaattgtatatatgtcctataaaatattgttgtatataccataaattacatatatgtatatatttgatttatttttttggagaatgtaaggggtgtggcaggttaactttccagctcaactatttgtcaggggcactgatgtcatcgagtcactgagaacctaagttctatttccccaggcagggctgggagagatgagatcctggcctggacctgaaatgggcacaaggttgttcttctatgtggccctttgtctcctgtggacaggtgagggctggtcacaggtgggcttccttccctagaattcccaaggcctcaatacaagtctttttcttgggattacaacatcagggtctgttgttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtccacagtgctgcatggctgcctcctctctgcacgtaaacagcagttagaaagactgaggttgctctgtgtctatccccacccttggaagtccaggcctccatagaagtcagagggccctggccagcctggaagccatagagcaggggccttatgaccctcagtgctgacgtccattcctaccccagtctcagaccaactggaggtcaccccaacacacttagcttgccaagtctctcttctgcagctctcttttgctgcttgcagaaaggaaaaggcatcattagttgaggttagcgatgattctcttaaccccaaagcctggactcccttctctcccctttgggcttcagtgacttcttcatctgcccctttccccagctccactatccttccactcatagtcatgaaccttcactcctgacctctgttcctggctgcctttcttctatgggccaatagcctcatggggccctctatcatttgctcttcacctacatctccatcatcattttgcacaagtctcccctggctctctctgctccagccatgctcctttatgttcagttatttcctcatatgtgttatgctgtttcccaccctggggatgtgtgtttttacagattatttcttctacactgaacatatgttcctccctcttattcctaagtctctacttcatttcttacatgaaagtatatttcaggtacatttactcttaactataaacagaaaaacttaaatttcactaaaagaaattaaggaaaatatttttatcctttgagtgaagacttttttagtggaaacacaaaagaacacatgccataaaaaaataatactggatgggcatggtggctcacacctttaattccagcactttgggaggcctaggcgggtggatcacttgagcccaggagttcaagaccagcctgggcaacatggcaaaacctcgtctctactaaaaacacataaattagctgggggtagtggcgtttgcctgtaatctcagctactctggaagctgaggcacgagaatcacttgaacttgggaggcggagggtgcagtgagccgagatggcaccactgcacttcagcctgggtgacagagcaaaactccatctcaaaaaataaaacaacaacaacaaactgacattagttgtattaatcatgtatcgaaacacatgataaaaaatgaaaagtcaagccacagcctggaaaaggcataaggaatgcatgcaaatgaggaagaatcagcatgacaccatttatgttcacaaaagtcccttggctcccctacagttccaggcttcacatgcagttaaagtgctgggaacatatgaagaggttctgaataactggatgtgtgcagaactgatgtgggcaatcccaagtctggcccttagaaataacttgtggcagccacgcgcggtggctcatgcctgtaatcccagcactttgggaggctgagatgggcggatcacaaggtcaggagattgagactatcctggccaacatggtgaaatcccgtctctgctaaaaatacaaaaattagctggatgtggtggtgtgtgcctgtagtcccagctacttgggaggctgaggcaggagaatcacttgaacccaggaggcggagactgcagtgagccaagattgcgctactgcactccagcctggcaacagtgtgagattctgtctcaaaaaaaaaaaaaaaaaaaaagaaataacttgtggcactgtgaagggagtcctcaagtagacacagaaattagctgcaaagactcatgggatatagcatacagttgcacttatggttaagatttattacagtgtcatagtaaatattcagcagcggatcatatgaagaaaacacacaggaggaatctagaggagttcacacattggcttccttatgctctcttcctcccgggaggggtcacacagagctcacttcttccagcaacaaaaatgcattaacacgtgtgcaatgtttctgcctgtggagctcatcagagactcaacaccccagaggctttagtggaggccagtcatggaggcactcactgcctagtatgaacccaaaatccacagcccagaaggaaatctcggtattcagcacaatactgtttgcaatatcagtctaggccacaatgagctactcctctcggttaggagaaactatgtcagtgcagggcactgctcaccagccagcttcccagatgtcagccaaatgccaacctcacaagcaggactttctaagcaccacagtctcaagccttgctgttgactgttttctgtacagatcccttcaattcttttgccatgccctaataaacctgggagctacgcaatacagattgactaatgataatatggaagcagcctggctcactgggtcataatttggtgaaaaaccatgaaagaaagctacttatggcctgctgggctttgtggacatgggaagtaagacttcatagaattaagccaatgagattttaagatttatttttatttttttttctgtagcatagctgttcttatctaatagagttagtatctacaatgggtaaagcattctcataacttactaagacaatccaataaaatggcaatacttagtctaaataggcatttcacagaaaagtaaacataaattaacactaacataaaaataggttcttgggctaggtgcagtggttcattcctgtaatcccagcactttgggaggctgaggtgggcagatcacttgaggtcaggggttcgagacaagcctggccaacatggtgagaccccatagctataaaaaatacaaaaaattagccagtcatggtgggatgtgcctgtggtcccagcagctactcgggagactgaggcacaagaatcacttgaacctgggaggcagaggttgcggtgagccaagatcaccccctgcactccagactgggtgacagagcaggactccgtcttaaaaaaaaaaaaaagaataggttcttaacctcacttagaatcagagtattccaatctgaaacagtaaattatgaatgcaaacttatcagattttgaagactggaaagtcttcaaagaaatgatagtcccaaatatgagaaaagatgtggactagtggaactgtattatactacagaagaaaattataactgatatggttttgttctgtgtcgccaccctcatctcaaattgtaatccccatgtgtcaagggagggaactggtgggaggtgattggatcatgggggtggttttccctgtgccgttctcctaatagcgagtgaattctcacagggcctgatggtttatgagtggcagttttcccttctctttctctgtcctgctgccatgtgagacgtgccttgcttcccttctccttctgccatgattgtaagtttcctgaggccttctcagccatgtggaactgtaagtcaaataaacctctttcctttataaattaaattacccagtccctggtatttcttcatagcagtgtgaaaacagactaatacaataattatatcagaaaaccctttctgagatatattctgacaagcaacattttgaaacaaattagcaatatagttgaccctctatatcagctgatttggaacccaaggataccaaaggctgacggtaaggaaggtgggcacccttggattaggatatcagcagggtttcctggaaccaatcccctcaggatactaagagatgactgtgtgtttaaattacttgagttcctttcattgtctttagggtccatcatggagaattgagttgtcaatatttattttagccattttgaaggttttaattgatatttaaaaattaacacttaaaaactgtggttatacatatatgtataaccatggttttacatatatatatataatatatagtatatacattaccacagttttatatataaatataaaatacatattaccacagtttttaaatgttaatttttaaatgttttatatgtacataaaacatacaatttttcaccttaacaattttaaaatatacaattaagtggaatcacgtacattcacaaggttgtagaaccatcactgctgtttccaaatgtttttcatgatctcaaagagaaactacacccattaagcaataactccatctttcccatgcttctcagcttctggtagcctctaatctaccgtttgtttatatgaatttaccaactctagatagttaattgatgggaaattataaaatatatctccctttgtgtctgtcttctttcacttagcctaatgctttcaagattcatccatattgtagcatgtgtcagaattttactcctttatatagctgaataatacttcatcgtgtgtatagaccacattttgtttatctcatcatcagctgatggacttgtgggttgtttccaccttttgactattataaataatcttgcaataaacactggcctacaagtatctgtctgctttcctgctttcaattattctgggtgtatacctaggggtggaattgctgagtcacatgggtattctacatttgacattttgagcaactgcccaacagtgttttacagcagcctcagcattttatattcccataacagtgtaaaagccttccagtttcttcacagccttgccaacacttaatttctgttttgttcttctttttaaaaattattacagccatgctggtaaatgcgaagtgatacctcattgcggttttgatttacatgttcctaataattaatgatgttaagcatctttttttgaacttttactttaaatttgaaaattgtattatgtatacttcaggtacataacatgatatgatgagatacacacctataggaaaatggttactatagtgaaacaaattaatatagccatcatctcacatagttacccatttactccctgtggcaataacagatataatttactcatttagaaaaaattctgaatatatgaactatagttttcatgtggcacattagatctttagacttcttcatcctgcctatctgctatcttgtatcatttggcctaaatgttcccatttcctattccctccccctgccatcctcccattaaccactatttcattctctctgtatatttgagtttttacaaatttcacatataaataatatacactatttctctgtgtctggcttatttcacttagcctaatgtcctccaggttcatctatgtttgttgtggtaaatggcaagatctcattttttttttaggatcaaataatactccattgtatatgtatgccacagtttcttcatccatttgtccatcagtagacacttaggttgtttccatatcttggctattgtaaataatgctgcaatgaacatgggagtgcagatgtctccaaaaggtgggatttcattttctttgtgtatataccaagaaaagagattgctgggtcatataattctatttttaatttctttaggaacatctacactaattttcttaatgagtgcatcaatctacttttccaccaacagtgtataaaagttcctttttctctacactcttgcaacttatctttttaataatagctatcttaatgggtgtgaggtgctatctcatagcagttttgattttcacttttctaacatttagtgatattgaacatcttggccatttttatgccttcttggtagaaatgtctgtttaggtcctttgctcagtttaaatagggttatatgttctcttgccaaagagttgtatggggtctttatatatttggtatattaatctcttatctgacatatggtttgcaaatattttttccaaatccataggttgccttttcatgttgttgattgtttaatttgctgtgcagaagcttttcagtttgatttagtcccatttatttttgcttttgtagcctgaactttttgtatgatatcgaagaaatcattgccaaggccaacgtcaaagagcttttccaacatgttgcatgtaataaactgaacttagatagaagacctaaacattagatattaagcatcttttcatatattattgatcatttgtatatcttcttaggaggcaatggcttttcttttccagttgttttttagtttttctttgtctttagattttagtagttttatgattgtaaggctaaatgaggttggggttgaacttcacttgggagatttgtcgctgttagtgtttttagtgcatattctgaaacatttttaatagactgtacaacagagaataagtaaattcattgacattactgggaaacagagttcttacaaagggaagagagatacaataagaaatagggaaagacaaggaagaaatctgtggtgtttatttgaattggaggtatcaaatatgaactattatttaaaaattatgtatttcctaactctaaccatacaatatgtaagaagcaatatgaagtcgatggacaattgctttatttctttgtacttgtgttcccagtagtaatgggcagaattattgcatgttatttaatttctaaatgtttctaaaagaaacaaagcagaaatggcttcttctagatccagagcagggaaagtcaaaaacatcttttggcagaaatcaaggaagtttcatgacccagaaaacatagaaaaaagccacagaaccagtttcatggggctcccactagccaaacacgagtatctaaacattagagcataataatgaggacactaaattataacaaattttaaaaatctataaggctataatgacaataaaaagatgtaggtaagaatgtcttcattacagaataatgctagttactaaatttcattagaaaatcaatgtagccattaatgtagttacagacagagaccatcagttgatgtcaaaaccaacatctgaaaggttattggagaccaagatatctatattgtgtcaaagtatcactccactaattgcttattaactataaaatataaatgatatctttgcaatggagagatctgatgtctgtgatgttaaatttagtatcgccaaaaatgtgtaaagacagcattatatgttcttgtaattgatcggatgcaatgggaaacacacatcaactatggcatggtatttgccaaaatatttaacctctgataatgtggaaattctgattgggggtcattttaccagtcagctgacatggactcttacaaaaatcaagaccatgaaagttggaaaatataagtgggccaaagagatgtctagtttaaaagtagctaaaaagacctgacaaccaaaagaaatgcataatctttgataatgtcctgtagaaaaaaaattaaaaccaaaagacacattggtacaactggagaaaggggaatgtgaagcatatatgagaaaataatgttatatgaatattaagtttttgagtgtaataaaggcatttgtggttttctaagataatggcctctttttaggagagacatactgaatcgttaagaataaagtgttttatttcagaaattgagggtaaaatacacaaaaagagataaagcaaatgtcaaaagatgttaataattgaaatacattttaatattctctttgttgtatgattcagctcttccaaaagtgtcagttttttaaataaaattagaagaaaaaaatcttaagatcttgaaatgttggcatgatttcagttttgtggtggctatttattatattcattttcaatatctttgaaatattctataattaccataaaacaaacacacaagataaggtttcttttagccctatagtgtactttttctatagggacaggctatgatttttaaaagtccccccaaaagataagagaatttatagtctgaggacaaaatagctgatatctctgagatgagcacaaaacttagctaacaatgcatgtcaagaagctgtttagtaaatacacaggactgttttaactgaaacaggagattctgagttccctacaggttggtcaagaactcacagatgttggggaattgcctgaatgtaagcagaggagtggtagtgcttgtcctaaattgtggttggataatatgtgtttgtgtaacagggagggggctctagcaggactgaaacactgtctgtggggaggagtctctagcaggacagaaggatcacatggagctggaatgaattcccttcagtcccccacaaacactgtctgatagtagccctgatctaatttccattgtttagaagtcccaccactctccctgagccatggctggagggcctaagcccagtggctctgaaccattggccatcaggaggcactgaggtttgatggcgtccaaatgtttttgaaacagggctaagtattgcctgagaagttgagtttaaaggaaaagtgtggcttcatcctagcattcagtatctagtttgcaggtgttttgagtggtcaatggaaactcatctttctccactgatgccagtgggttctgttcggcagtgaaatctgaactgtagcaaaccattgagtggagaatcttctgagcccacttgaggggtagatggaggagagccaggagccaacctgaatgctcacagacccatgcagaggaacaagtgcctccttgggagaacatcagagaaaccttagcacctaacctattctagtgtgtcctggacgatggacaggagaatgtaaggggaatgtagaagatgggagtggacaactgtagatgtttccagatatctcaaattgcagtaacaccacaaatattcttaacaagaaccagattttccagaactctggcatttccttccctgagcaatgagacggccctttgggccctgacacaatcatgggtgttttttgttcatttgttttggtgctcaggaagcaggggaggcatgagaatacctggggaatgtctttcctagaaataggatgccccaatttcaagtatttcacatgcagcttgataggtcctgtctccagccacccagcctccactctctcaatgctgttgtcatccagggccctaagctctggtcacacggacggaagaggtagtgacactgtgatgtgaagacactttccaccatgaaattattaattggtgtcaatataaggcaggctccgactagcagcttttctaccacaatgatagacaatttatatggaaaagagatggttctgataattctacactcacaggtcttcacctgataaccttgacatgtgtcccctaggttttaggaacttggatttctttaggctgagttgtactattccctttctctgaacacacatgtcattggttagttcattcatattgattctcagggcttctccaatccctcaagccttcccactctaccactcagataaggagaagtgtgtcttaactaatgttgcataattttttaaaaattgctggatactaacactgcaattcaattgtaaaatatgatagaggtgtaagtgttttagatcccagaagtcctgctcaattttgcatttattgttggatattcaccctgatattttcaggaattagagtgttcttcacccatttgggttaagatatcagaacttactttcaattcattggtgaccagagactacaggcagaatcatagtgaaggcttgatacataatacataatgaagattgataacagcaaaaagggaactagtcattggccttcagataaaatgaaacctcccaactttgtgctcagggaattattttacccctttaggttagagtatgtcagctagttcaatgcagttctaggataaagctgtgtcaattaccctagaggactgggagcatggaggacctggtagaaaagaaatacccaaagagaaggaaaattacacacaaaatcaagaggtcactaattgatatatctattttgagttgcctttgagacttccacgtagaaacatctagcacaggataggcctagagatgtagtgacagatctaatcccccaagccctgaatatgtgagtgaggacgcttggatgaacttccagtctatgaatacattaaacaaacttttagctctgttttagtttacaacaactgttttctaagaacttaagcatttgtggagacaatgatgtcactgtaggaacttctctgtaaggacagcaacatcccacttcctctgctcctgctcacagtgaccctgatctggcaaagcttccatcctgccctgaccctgccatgggtaccaggctcctctgctgggtggccttctgtctcctggtggaaggtgagtcctaggaacaccatgatcctcacataatctcccagtgattattctagtcatttccttctattttaaaattctttttcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcttagacacagtgtagcagagacacttccctcctgtgcagaaaaccgcaggactctctcctctctactcagctcacagcagcctttccttattcctcatcctcccaggaaagaagtgagttttcagatatagctaggattcatatagtgggaggaaatgaactatttcttacaacatgagcgctataattgttgcttgaaaatgtgtctcagggatttgaaacacttcttggggacaactcaagaaacctaaagtgacttatcagagattgagtcctcaggggtagtgatggtttatctcccataaaagtatgtgatcatgaaacatgtacaataaacttaataatacagatagtgattataccaagcagcaaacagcaggctccccttatgtagttgtcagcatgtgaatgacttgttacccttagtgacaccccggctgtctagcaaagtctcaacacacagtatgtgtttggaaatctttttccttctgttttatttttggtaaagtatgctaataatgatgttgttaatgatagtgattataatttcaggtatgttattcagccctttttccagttcaaagaaatgcacacaaatggataccccggcaaccaggtgcaaatcttagctccagatgaattctacttctcctgaactctctaactcttctatgtaatcatcccagcccaagaatatatctagacctggaccagtcagttcagaggacatttctacgtgtctgccttgtatattaaaagttccttagtggattgaaatattccttgtaagaacttctgaagcaatcaattgccctctctgataatatacactctgtgtgtctagctccatattcattactctacttctgcctaaactctctaatactagaaatctttctgaagtattggttagaattacttaaaaagcagcatactggaaattgtctgaaagcactgtcactgtccatttgcccctcctgacttccctcccctccttatccaatctaatacctgatggcaagtcaggctttatttccatttgttcattgcacatctccctgtcctttattcctgtaataaaacctcactgatgtgatggattaaaatgaccactcactcaccatctccttgtcaaaatttctatttttttcttttcccaatctgctatgttagttatagttaataactccctcataacattttctgagatcactttttattatttgaatataggacacacagttgtttcagagtctgtctgatcattttcacctctaagatcttcataggatatttttgtgattttctttttgtgctgcttctcagttatggtgcttgagttttcatggcatttgtatttctccttaccaatctgatgatgtttgacactttgccaaacactatagttgtagaaataattttgggggtaggatggatatttttctgcagagatcatttttctgtgcttctgaaagtgcatgtagatataaacagtcaggctccctgaatcacagtttaaggcttgaggtgtcctggagcatctggagaacaggtttgtctctggcttattgttactagtggaatttggcaatgacacgttcggtatgttctgggctttgctttacccccgtggcctgtgagtcagcttcctgagtgctgagtcaggatctgcaaatgcccgctagggcaaatggactgctgtgctcacctcccggagctcttgccctcaccaacattccagcccaattattattatttttttaggactttaactaaaatttttaatgttgtttttgatattttttttccaactatgtagataacaacagaaagagtgagtgccattatccttaattattgggattaaggtgaaaataactttacctggaattctaattttccttgtattttaatgttagattctttgtgatttgtctaatattcaacttaaatggtatagagatgttaaactctgatatcaaatactttaaaaaaacttatcaagaccattcataatccaattgagacatatctttgtttggggcatgttgtttttagagtattcttctactgttatttatttctatcacataacctctgtgttccattggaccatatggcaagatgggaaagacaatcaagagaatgctgagatctggtcaaatagtacagattgggcttcaaattaatttaattactgagttctgggggtggatttgtgctgttttatgagtatttcctggggcaatggtcaaaattagagggagtaactgatatgtggctattgttttaccccgtttaaagccaatctcctgggacaacacaccccattttgtggggcaccccgaaagtaataatcctgttttaatcttcctattccttgccaaatcttctctacagaagggaaatcagttatactatttcctctcttcattttagtttagtctctccttattttcccgttttcctcctggttccctagagaaaagtagattattttcaacatgtgctaagatcagtgaggaactctctcttccatgcagggtggcctgcagtttggaggggatagggaatgggttaaattctgtttcagcatcatgttagccagcccatcgagtttcacaatgagacctgctgcttatcagtattaaaactgacattatgtttccacctttctgactgcattgtcaatgtctggggtgtttctgtcctaccccatagcactaatattatttgttggccttttaacaccaactaatcataatatcctatatcccttgtactcagtgaaataaagctcaagtccctgtgtcctggcaaaagagagcacatttgtgctgttctgcctactggccactaggaggcactgtggcttcgatgtcatccagagtctatggggaggagctgagattgctccctggaagatggttaagaataaccccgaggttggacctaaattcagggagttggtttgcagatgtcttgaatgatggctgggaataaaggaattagtaaccgacgcttcctccattgtagaggtgggttttgctttaaattgtgctttgagtggggctgagtgacaggtgtactttgcagtgcatatacctctgagctcgcttaagatgtaggggcacaaggagctgaggtggtgcagggcccatgttctgagcttggaaaaccagagaagcagttcttgtgtcaaaggagccttggagagcctggccccaaaccagcccaggccaaccctacctgctctgtgagagtagaacagcaagaaagggaggtgctacccaggaccacagcagagggaccctgtcgccagggagatgaaaatcacagtgatgccacgaccatatccacgtatgaggcatagtccagtgtgtctcctggaagaagatgaagcctgggcagacataagaatatgtttttgaataggcttcccttggcctgattttaaattccttccatgtgatcatgcatctgtctgtacctgtattttgtacccggcttctgcctctcacccatcagtcccatggctactagaaggtattaaatttctattgacaaaaattaccactaatttggtggcttacaacaataaaaatttattatcttacagttctggaggttagaagtccaaaaccaggctaaaatccaggtattggcagggctacattccttcccgaggctctcagggagaactatttttctctcctattcagcttctagaggccaccagtgttccttggctcatggccccattcaatcttcaaagccaacaaggactgggtgagcctttgctcactctgcatcactctgacactcactcttcatcctccctcttccacattttaggacccttgtgattacattgggcccatctggaaaatccaggacacgctccccatattaaggccagctgattagcaaccttcattccatttggaacattcgtttctccccttgccacataatttaacacattcccagtttctgggaattagacatgtacatctttgagaggtcgtcacgctgcctgccacacttgctacctggttacacgaagtagtaagcaattaactttttgaaggcagaattatggccatagttttatatcctggatccaacagaccctgcaaaaggatagagcccacatggaaatagcccctccagtaacacaagctagtctgcaaactaatgcccttttactttgggaagtgcttttgactgcaggggactcagaagcatgcctctgtgccaacagcaaaaatgtgcccttctcttttgttggcaagtaacttaaccaaccaacccaaaaaaaagatctttctctcagctttccataatctctgagacgaagtaggtttggagaagtggggttacaggggaaaaagccaggtgttaatgatgaaaaaacattgaacttttctaggggtagtaataagatttaattcaagactagaacattttagctgcaaatcttcaagaataagacaatattatcccctttctgttttattgtgggactagagaatgtgagagaggttacattccatgggctttgggaatttaatatggttcaaggataaacacacccaggtttttcactgcagagaagagcttcaaatataatcagttttcaggtcatcagctcagctcttgtatccctaacaatgcagttgacatgcgtcttctcagatgtctaactcctaactcactgagggatactttaagtacatataaaggactagaagcaccaagctaccagtgagaggaagaggagagtttgcagagaagctggcttgaaataagacaatgagttcatctttaaatacttgccatttgaggtgcagatggatatagttggcaggctcctatgtaaggcatgttatggagaagctaccgtgaattgataatatcaaaacaaatatccagggagcctctgcaagtgtgcatctctatttcacaccaattatagttgagttaattcctgcctgattcatctcccagagatgcagcctcctcttaaagaagttgggggtggtggcccattcagtgatgtcactgacagatgcattctgtggggataaaatgtcacaaaattcatttctttgctcatgctcacagagggcctggtctagaatattccacatctgctctcactctgccatggactcctggaccttctgctgtgtgtccctttgcatcctggtagcgagtgagtcttcagaatatttgccatcatcaggctgggcttctgcatggatgatctcatatattttccttattctgacgcccaattctgtcttctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaacccggtgtttccccttctccttctacctcccagcagtcctgggcaaagtctctgctgttcctccctccctatgagaaaaaagtggtttgggggtatgaaaaagacagaaaatgagaagggatcaacataggaaaccttatgttggtttgaggattacaaaatgggttttgaggattccttaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacgttcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtgcacactcacagagcactgatgacgcctcctggtaaggacccacactggggtatctaaaagcagacaggcatgtccagtcttctgttgccctgtttcctttctgattatatgtccttaacacacaaatttacattttccttcttatttatatgagaagtttctatacaatacctgcaatccattctgagtggttataatttctgtgtgatattcatatttacatgctgattccttctaaatacctatcatggtatcattgacaactgaggcaaaagacccctatattttgagtgcccaaggccattgaggttttttggagctctgccataagcccaattccactgtgtcattttcctatttttctttccttttttgttttttgattagtgggtcctgactttcaagatgaaaatagtgcagaattcctccctgctgcttccagatcattttccttcctacttctctaaagcccagctgcattataggcttcctttagcctgattttaaattccttccatgtgatcatgcatctgtctctacctgtatcttgtatctggcttctgcctcttacccatcaatcccatggctactagaaggtattcaatctctgttgacacaaattactactaacttggtggtttacaacaaaaactaattatcttacagttctgcaggtcagaagtccaaaaccgggataaaatccaggtgttggcagggctgcattccatcctgaggctctcggggagaactgtttttctctccttttcaacttctagaggccaccagtgttccttggctcatggccccattcgatcttcaaagtcaacaaggactggctgagctttgctcactctgcatcactctgacactcactcttcgtcccccctcttccacattttaggacacttgtgattacattgggcccacctggaaaatccaggatacactccctatattaaggccagctgactagcaaccttcattccatttggaacattcctttctccccttgccacataatttaacacattccagtttctggaattagacatggacatctttgggaggttgtcatgctgcctgccacacttggtacctggttacaggagtggtaagtaattaaattttttaaaacagaattatgaccacagttttgtatcctgggtccaacagacctgcaaaaggatagagcccaaaggaaataggccctccagaaacacaagctagtctgcaaactaatgccctttaacattggcaagtgctttcaactgcatgggactcagaagcatgcctctgtgccaagagcaaaaatatgcccttttatggcaagtaagttaattgatcaactcaaaaaacaaacatttctctcagctttccagaacctctgagaggaagtaggtttggagaagtgggattaaggggttggcagggggcggagaaaggtcaacaggggaaaaagccaggtgttaatgatgaaaaaacattgaacttttcttttctaggggtagtaataagatataattcaagactagaacattgtagctgcaaatcttcaaaataagacaatcttatcctctgttttattgagggaatagagaatggagagaagttccattccacgggctttgggaattcaatatggttcaaggataaataaacccaggtttttttactgcagagaagagcttcaaatataatcagttctcagggcatcagctcagttcctctatccctaacaatgcagttgacatgcatcttctcagatgcctaactcctaactcgctgatggataatttaggtacacatagaggactagaaacaccaagccaccagtgagaggaagaggagagtttgcagagaagctggcttgcaataagacaatgagttcatctttaattacctggaatttgaggagatgtatatagttggcaagctcctaggtaaggcatgttatggagaagctaccgtgaattgataatatcaaaataactattcagggagcctttgcatgtgtgcatctctctttcacaccaattatagttgagttaattcctgtctgattcatctcccagagatgcagcctcctcttaaagaagttgggggtggtggcccattcagtgatgtcactgacagatgcattctgtggggataaaatgtcacaaaattcatttctttgctcatgttcacagagggcctggtctggaatattccacatctgctctcactctgccatggactcctggaccctctgctgtgtgtccctttgcatcctggtagcaagtgagtcttcagaacatttaccatcatcaggctgggcttctgcatggatgatctcatatattttccttattctgacgcccaattctgtcttccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaccctggtgtttctccttctccttctacctcccagcagtcctgggcaaagtctttcctgttcctccctccccatgagaaaaagtggttttgggttgtgacaaagacagaaaatgaggtttcaacataggaaaccttatgttgatttgaggattatgaaatgggttttgaggattccttaaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacattcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtagcacactcacagagcactgatgacgcctcctggtaaggacccacactggggtatctaaaagcagacaggcatgtccagtcttctgttgccctgtttcctttctgattacatgtccttaacacacaaatttacatttttcttcttatttatatgagaagtttctatacaatacctgcaatccattctgagtggttataatttctgtgtgatattcatatttacatactgattccttctaaatacctatcatggtatcattgacaagtgaggcgaatgatccctgtattttgagtgcccaaggcacttgaggttttttggagttctgccatatgccaaattccactttgtcattttcccattttttttttttttttacgtgtagggatcctgacttttaagatgaaaatagtgcagaattcctccctgtgcttccagatcattttctccctcctactttaaagcccagctgctttgtacatattactttataatattaccccttctcattgtacctaccttattaccttcagaaattttcttttttttaatccttctgcctgctactaatccagtcatcattcttaatactattcatcacatagacaatttattcactcgcgaggcttctaagtttctcgacttcctatatcctgagtctttttcccctctaatcattttcagacttgtttccatgattatagaccattaaggaacaacaaagatctttcaatatttctatttaaattgtcctgtcgttctaccactacctcccttctgtctatatcagtaactcctacaattcttctatttctctgacctctccagttcatagagcccataacttttatttttttaatttttttttggtctttctaggatgttatttattaaaaatagattctctgtccctaccctcacccctgctggcaaaatggcctttcccaacatcttttcctgcatggataacaggtcttgaggacgcagatgtgcatcctacctaaactacaggctcaggcttttctgggacagtgaggcagcagctctgccagagccaagggtggaacagcacaagacgacatcagcaaaccctggtgcacctaactgtgggctgctatggagtctgggatggactggagttcctcctgctccaggcctcgggagacaaaatccacaaagagagacccagtggcccagcagcagccccctgagagcccacaactttttaactcttacgctttaattcttacattcttttaattatattttaagatttaagactataatatcaaccccgattaaagccaactccccgtaggttcctatgaatggcagagttgggaggggcactaaaaaatccccgtgggaactcattcgatttatcttctgtagttgtcatagactcctcttaggttcctctacttctaatcttggcctccctcattctagccaccaacccagggtctactctcaatacagaagtcagagtgatcctttaggttagatgttgtcactcgtccactaaaccatacagtagattcccgtttcactcagagaaaagcctacagcctgcataggcctacgaggtcctcggtgatccccctccctgttgtatttcttgcctcctgtctgttcctctttcccttgcttattttttcacaacacagtggctttctggccattcctcgaatacacaaggcacacttctgccttagaacctttgctcaagctattccctttgcttggaacatccttctcccaagtatcccagtcaggcctgcaagaagcctgaattattctaccagtgacacaatcattttcctaaaaccacttttcaatttttatacattcaacaattctccattgttcaccagataaaaatgtcacctcgggagggcatttgaattttaaaacatttggaccatatcttatcttatttttgactactgagtaagataaatgttactttatcaagtgcacttcatacccttacaaaacagtcttacacaatttaatgcctgttcatacatttgttcttgcaatttctgctaccttcttcatattgttcaatacttctagtcactcaagacactactgaatgcttctttctctatgaagcaggaaatggttctatatactctattttcacagtggagtaaaatagatacacattttaggaacaaaacaaccatgcagattatagaaattaaactattttttacatactttcgaaggtgaggaagttcagaagctcaaatatggttaagatatgttttgcttctatttaagtccacattccccaccactttaaatcttccaagaaagatttccctcattcaaattaaaaacattttgatacaagactgggggcagggaagtgctgggtagagaagggcggggtccctggtgagggctccaccctcgggcctgtgcccacagacctaaatgaggacaggcgtttctgtttttgcactcaaaaagttgccttttggcccgccacgcctcccatcctgtgcccatataaacccgagaccttaagcggacacggacacaagaggctggacatctagaagagcagaagaatacagcagcagacaccggcagatcagcgatggcggaaggacacgaatgcgaggggagttcagccaggggaagtctgcgagagtcctgccactgggcagccaactgcaggggaaaaccaccgttccactccatccctcgacttctggctccccatctatctcactgagagccacttacaccacttaataaaagcttgcactcaacctttcagcccacatatgatctgattcttccagtacactggtcaagagctcaggctgtcacattggccccctgtccttgcaataagcagagggtctattgagttgactaatgcaacgagacggcagacggcatagctgaaagagtgcactgtaagtcctagacgctgccatcccttggagcccaaaagcactccccatggcctctgcacctgcccgtctgcatgctcccctaggggtttgagcactggggcaccagtgaagtgagccatccccctgtcacatgtcctgcgaggagaataagggaattctccggttttaacttaatctgtaaaagaccttgttaagaggatgaaaaagaagccacagcaatggataaaacatttgtaaactacatatccaacaaaggaatattatgactgtttcgagatttgcagaactgtctatttaacccatagactcatgagcaataataaattattattgctttaaccagtgagatttgagtgaggcttgttatacagcattactgtgcaggtgtcaattgatatactctatattgcaatatcgattcttaaattgtctaaccataatcctatagaccattactaattccaagcttgttctttttatgaagagtgtcgctcaactctgatgtctttgttctgtttaatattttgatttacacatgaacacagttcccagcagctttcaaacctccagaagcccttaacatttctgattctgaaaaatatcttttcttgttttcagcattttttattgttattttttattcttttgtatgggaaggtactcagtttaccatcctgaattagtaattctttaaacatttttgcaattccagtaattagagatattactgcattaggcattgaagataccatggtctttgcatttcctgcttgcatatcgagtcctatgaactatttctggtgtctctgagtcacttcccagtgtggtcattggcttttactgagtctgattcaccgacctttactgagcctcactcaccaacctttggtcattcttggacatagaagcacaaattcaacagtgttgtttcccaaaatatgtaatatgcagggaaaattacttttcatgtaaaatagacgtgtccttttagtattaccagtagattattctaattatagactagtaacatccaacagacttatttgggtttagtgacagacctattactgtgttcgctcctcagttcaaatacagagtgtgtattttgcatcgtgtggctgcaagttttggggttctccatcatatacttagctatacaatgccagctactcttgtctggatattttcccaaatcctggatgattacaaacttctccttcactggtgaaattttttttttttttttttttttgagatggagttttgctcttgttgtccaggctggagtgcaatggcacaatcttggctcactgcaacctctgcctcccaagttcaagtgattctcctgcctcagccttctgagtagctgggattacaggaatgtgccaccatgcccggctaatttttttttttttttttagtagagacagggtttctccatgtttgtcaggctggtctccaactcccgacctcaggtgatccacctgctttggcatcccaaagtgctgggattacaggcatgagccacagtgcctggccaatttttttttttttaatgaagggtcaaacctgatattaagtctttcagacagtaagaagataactattcagggtctacaagatggccaattagaagcagctgtggtccatggcactcagggagaggaatgaaacggggtgagtgaatttagcactgtcaattgagatattcaggttctcacactgggactgtctaggcaaacaactcaacccacagagaacaaagaaaagcagggggtgtggggcatgatggcccaccaggagcagcacagagccaaaggaacccccacccccagccaaaggaagcagtgagtgattgtgtgaccctgcccaggaaacgactcttctcccacagatctttgcaacacatggatcaggagatcccctcacaagcccacaacaacagggccttggatccagtacacagagctgcatggagtcttagcagagcagctgctcaggcacacacagagacccaggagttttacacattccagcctcaggatccccagcaaggcaggaaatctgtccacatataaccctaggaagggagctgaatccagggagccaagcagcatcattctgcaggccccacttccatagcacctcacaagttaagacgcactggcttggaattccagatagccaatagcaacagcctagaatctgcctgagataagtatgaattcctggggaaagggggtggccaccatctctgcagtccagtagacttagctgtttaagcctgccagctttggagaatacaaatggtctggatgaggaaaggttccccataatcagcacagctgccttgccagatcatggccagactgcttctttaagcaggaccttgatccatcccttctcagtgggcaggacctccctgtggaggcttcagccattctagccagtgttctacattgagagctctgatctctccctaggatggagctcctggcagggaggggcagcctccatctctgcagttcagtcaactcagtccttctagcctgttggctttgcagaatcccaaaatggtctggacgagaaagcctcctcataatgcagcacatttgctctaccaaaaagcagacagactgcttctttaatcaggcccctgatcctgttcatcccaactggatgagacctcccaacagggtctccagccacctcctacaggtgtgttctggccagcaacaggtcagtaccccccagggatggagcttccagaggaagaagctggctgccatctttgctgtttcacagccttcactgatgatacctccagtatgggaaaaaccgaggcaactaaggtctggagcggacttccagcaaaccacagcagccctacaataaagtggcctgactagtaaaggaaaaacaaaaaacagaaaacaacaagaacagtatcaatgaaaaggaccccacaaaatccaaggtcaaaggtcagcaagctcaaagattgaaggtagataagcccacaaaaatgagaaagaatcaacacaaaaatgttgaaaacttaaaaagcaagagtgccttttctcctccaaatgactgtaacacctctccagcaatggcacagaattgagctgaggctgaaatggctgaattgacagaagtagggttcagaaggtggtaataatgaactttgctgagctaaagaagcatgttgtaatccaatgcaaagaagctaagaatcatgataaaacaatacaggagctgacagccagaataaccagtttacagaggaacatgatcaacctaatggagctgaaaaatacaacacaagaccttcacaatgcaattacaagtatcagtgggagaacagaccaagtggaagaaggaatctcagagtctgaacactatctctcttaaataagaggggcagacaagaatagagggaaaagaatgaacaacaccccccagaaatttgggattatgtaaagagactgaacccatgactgactggggtacctaaaagagataaggataatggagtcaaattggaaaacatacttcaggatatgatccagaagatctttcccaacctagcaagacacaccaacattcaaattcaggaaatgcagagaaccccagtaagatactccatgagaagataaaccccaagacacataatcatcggattctccaaagttgaaatgaaaaaaaaatgttaagggcagccagagagaatggccaggccacctacaaacggaagcccatcagactaacagcagacctgtccgtggaaaccttataaagtacagtggttggaagctattctttaacattcttaaagaaaagaatctccaacccagaatttcatatctgaccaaactagcttcgtaagtgaagaagaaatacgatccttttcagacagcaaacacttaggaatttgtaccacaggactgccttgcaagagctcctctaggaagcactaaatatggaaagaagaaaaccattaccagccctacaaagcacactgaaatacacagaccagcaacactatgaagcaaccacataaacaagtctgtgaaataaccaggtagcatagtaatgacaggatccaacttacccataacaatactaacttttaagtgtaaacagggtaaatgccacaattaaaagatatagaattgcaagctgagtaaagaaccaagactcactgatatgctgtctttaggagacacatctcacatgcaaagacaaacataggctcaaaataaacggatggaagaaattttaccaaccaaatggaaaacagaaaaaagcaggggttgcaatcttagtttctgacaaaacagactttaaaccaacaaagaacaaaaaagacaaagaagggcattatataacggtaaagggttccattcaacaggaagagctagctatcctaaatatatatgcacccaatacaggagcacccagattcataaagcaagttcttagagacctacaaagagagacctggactcccacacaaaaatagtgggagactttaacaccccactgacagtattagaaacatcactgagaccaaaaactaacaaatatattcaggacccaaattcagctctggattaagtggaactgatagatatccatagaattcttcacctgaaaacatcagaatatacactcttctcatcatcatatggctgttgctcaaatcgatcacatatttggaagtaaaacattcctcagcaaatgcaaaacaactgaaatcatgacagtctctcagatcacagttcaatcaaattagaactcaagatcaagaaattcacttaaaccacacaactacatggaaattgaacaacctgctcctgaatgactcttggataaataacaaaattaaggcagaaatcaagaagttatttgaaactaatgagaacaaagagacaatgtaccagaatctctgggacagataaatcagtgttaagagggaaatgtattgcactaaaggcccactacaaacctctgctcaaagaaatgagagaagatacaaacaaatgaagaaacattccatgctcatgggtaggaagaatcaatattgtgaaaatagccatactgtacaaagtaacttatagattcaatgctattcccattaaactaccattgacgttcttcacagaattaggaaaaaaaactattttaaaattcatatggaaccaaaaaagagcctgaatagaaatagacaagacaatcataagcaaaaggaacaaagctagaggaatcatgctaccagacttcaaactatactttaaggctacaataaccaaaacagaatggtgctggtacaagagcagacacatagaccaatggaacagaatagagaactcagaaataatacgacacacctacaaccatctgatcttcaacaaacctgacaaaacaagcaatggggaaaggacttcctatttactaaatggtgttgggagagttggctagccaaatgcagaaaattgaaactggactccttccttacaccatatacaaaaattaactcaagatggattaaagacttacatgtaaaacccgaaactatgaacaccctagaagaaaacgtaggcaatctcatttaggacataggcacaggcaaagatttcatgacgaacatgccaaaagcaattgcaacaaaagcaaaaattgacaaatgcaatctaattaaactaaagagattctgcacagcaaaataaactatcatcagagtaaacagacaccctgtagaataggagaaattttttttgcaatctatctatctgaaaaaggtctaatatccagagtctgcaaggaacttaaacttacaacaaaaaaacaaccagacaaccccattaaaaagtaggcaaaggacgtgaacagacacttatcaaaagaagacatacatgtggccaagaaacatttaaaaaatagctcaacatcactgatcattagagaaatgtaaatcaaaccacaatgagattccatctcatgacagccagaatggctattataagagtcaaaaaacaatggatgctggtaaggttgcagagaaaaaggaacacttttacactgttgtgggagtgtaaatgagttaaaccactgtggaagacagtgtggtgattcctcaaaggcctagaggcagaaataccacttgacctagcaattctattatggggtacatacccaaaggaatataaatcattctattataaagatacatgcatgtgtatgttcattgcagcactgttcaccatagcaaagacatggaatcaacctaaatgcccatcagtgatagactggataaagaaaatgtggtgcatacaacatggaattatatgttggcataaaaagaaatgagatcaggctgggcacggtggctcatgcctgtaatcccagcactttgggaggccgaggtaggcagatcacgaggtcaggagattgagaccatcctagctaacacagtgaaaccccatctctactaaaaagacaaaaaattagctgagcgtggtggcgggcacctgtagtcccagctactcgggaggctgaggcaggagaatggcatgaacccgggaggcgaagcttgcagtgagctgagatcgtgccactgcactccagcctggatgacagagcaagactccatctcaaaaaataaataaataaataaataaataaataaataaatagaaatgagatcatgtcctttgcagggaaatggatagagttggaagccattacactcagcaaactaatgggaacagaaacccaaacactgcatgttctcacttataagagggagctgaatggtaagaacacatggacacatcacagggaacaagacacactagggcctgtcagaagacggttagtgggagggagagcatgaggcaagaaaaggtaatgaatgctggcttgatacctgggtgatgggatgatctgtgcagcaaaccaccatagcacatgtttacctatgtaacaaacctgcacttcctgcacaggtgccctggaacttaaaataaaagtcgaagagctccctctccctctccctctccctctccctccccctccccctccccctccccctgcctctgcctctgcctctgcctctctgtctcccctttccacggtctccctctgatgcggagctgaggctggactgtactgccgccatctcggctcactgcaacctccctgcctgattctcctgcctcagcctgccgagtgcctgggattgcaggtgcgcgccaccacgcctgactggtttttgtattttttggtggagacggggtttcgctgtgttggccgggctggtctccagctcctgaccgcgagtgatctgcctgcctcggcctcccgaggtgccgggattgcagacggagtcttgctcactcagtgctcaatcttgcccaggctggagtgcagtggtgtgatctcggctagctacaacctccaacctcccagccgcctaccttggcctcccaaagtgccgagattgcagcctctgcccggccgccaccccgtctgggaagtgaggagcgtctctgcctggccgcccatcctctgggatgtgagaagcccctctgcccggccgcccagtctgggaagtgaggagtgcctcttcccggccgtcatcccgtctaggaagtgaggagcgtctctgcccggccgcccatcgtctgagatgtggggagcgcctctgccccgccgccccgtctgggatgtggggagcgcctctgcccggccacgaccccgtctgggaagtgaggagccctctgcccagccgccaccccgtctggaggtgtacccaacagctgattgagaacgggccatgatgacgatggaggttttgtcgaatagaaaagggggaaatgtagggaaaagaaagagagatcagattgttactgtgtctgtgtggaaagaagtagacatgggagactccattttgttctgcactaagaaaaattcttctgccttgggatgctgttaatctataaccttacccccaaccccctgctctctgaaacatgtcttgtgtccactaagggttaaatggattaagggcggtgcaaaatgtgctttgttaaactgatgcttgaaggcagcatgctccttaagagtcatcaccaactccctaatctcaagtacccagggacacaaaaaccgcggaaggccgcagggtcctctgcctaggaaaccagagacccttgttcacatgtttatctgctgaccttccctccactattgtcctatgaccctgccaaatccccctctccgagaaacacccaagaatgatcaataaatactataaaaaaaataaaaaataaaaaaaataaagttgaatcaaagaaaaaaaaagtcgaagaaaaaaaaagaagataaccatttgaattgcctcatcaggtggcttgttatgggagaatgtatatttccaagactcttgaaattaaagagagtgagctatcataaacagtgagctcctagacagaaataatttagagtatgtgatagtaagcacacctgtcaaggctctctcctttgaagaaaatgtaatgaggaggactctgaaagaaattagagcatgtacacacaaagattcaaaatcaatcaacattattattacaaaagctgagagcagaattaaaagaatgcctgtgcttggaatacttgttatggagaattttaatttgctaagaaaatggatgagacactacagtattttgaagtgatacttccttctgatcatcagaacaggagcaaaggaagaatatttaaaattgaaagcttttatataattcttactgtgttttgggcatttcaagtgggttcattttccaagtagaaaatattcagcatctacttagaatgccttattttatggaagagtaaactgaagtagagagaagatacataattttcttcatgtcacatggctagtaaatggaggaaagagggattcaaacacaagaatttggggactggattccttttaaccatttataaactattataaccaaaattaaaaatataggttcattaaaatggaagaggaacaagacttccttaggaatagttctaacttcttagaagacatatttctcatatgaaagaaagaggaggttctcggccgggtgtggtggctcacacctgtaatctcagcactctgggaatttgaggcaggcggatcacttgagctcaggagtttgagacaagcctcggcaacatagtgagatcccatcactactaaaaataaaaaaaaattatctggggattggtggtgcatgcctgtggtcccagctactcgggaggctgaggtgggaaaatcacttgagcctagggggtaggggttgcagtgagccaagagcatgctactgtattccagcctaggtgacagagtgagacctcacccccaattaaaaaaaaaaagaaagaaaagaaaagaaagaaagaagaggctctcatatccaggaaagatcaattttagagggaagaggaaatgcactcagggtcaactgctctcaaggagttattagaagagatttattttggttgttactaaggcaggcaagataactggatgtaaagaatcttcatggaggaaaaacaaagatacaggatctcagaggggagactagataaactttacagaggaagacaggatttggggatttgttaaggaatgacttaaaatcaacactatataaagggttatatgcaatttggacatttttgagaagagatgccctgagacatcaattgaagactctcaaattatttgatgttcagctctagcctgtgcttgaaaggagcctgcttaattatttttaaaattatgagtcttaagaaagtgtaagaaagatggaacatattaaaggaaaagcaggcaaacaaaaaatgagaataccttttagatacaattgctcaaccaaggaaattaaagatattcaatatttatcttaatagtgcttgctttagaggatccagacattgttaattgcacatctctcaatagagaagaccacagagatcaaatctagaatattttgaaaagactagtgacaagtacaaacataaaatttaagaaggaatttaattctagtgaatattgctaatactacatgtgcttgagaaagaacaggacaaatttacaaagcctttcaaacttctagaaattcagcttaagctagaccaggcccagtggctcacgcttgtaatcccagcactttgggaggccgaggcgggtggattacctgaggtcaggagtgagagaccagcctggctaacatagtgaaacctcgtctctatgaaaaatacagaaattagcttggcatggtggcacaagcctgtaatcccagctacatgggaggctgaggcaggggaatcacttgaacccaggaggtataagttgcattgagccgagaccacgccactgcactccagcctaggcaacaaaagcaaaattccatctcaaaaagaaaaaaaaaaaaagtagtgagccaactctttattcagtaggggatcctgtccgctaaggaaaaggtaatggaagggcatattcgattcaggagaatgctagctagcccaataagctgcaaagctcagccccttctttaccagaatcaaagctcacatttccacttcagttgatctgacatgagtatttttctctcaggtgttttgaatcttaggtcagaaagagtggttacccctgcgcatgaccactgtgccaatgtaacacagcatatattactttgggtcttgacaaagggctcatttttagtgactgagtccttctggccaccaggagacacttcagtgccacaaccactcactgacactttagagttgctaagaggactgtcaggccatgggaaactaagaagaagctcaggcttggtacctgaatcatgagtcctacctgttgagcactgaaaaagcactggaaagagaagggaggacccaaaaacttctaaacctgtgcgaatgggctaagaccaatagtgaggttgggattttaggcaagtttgggatggttgtcagacaaagaagccactgatataccactagtacaatgcagttcgaattacaataaaaagttatagggggtttttttgggtcagaaagagaagaagtaaaagagcacacatgattcctatctccttttatcctccaaactaactctcactaacccacagaaatgttttcataggtggcacaaaggtaggctgcaacaattgtggccaatattatggtagagaaggaccctgccctgtaatgctcaacatattaatgttacgtgagagtgggacagggtcatctctgtgacagtatagtcacagaagcctcttcctgctcaaataagtggccttcattaaaagaaacacagaagaatcttgtttcataagctaatgccaatcactgagacagcaacggtttcaggaacatgagggaagctgttggaatgggctttcctttaaacctagcctggttccatcatgctgagtggtgggggctttaagtcagggcctgagaaggacagcctaactgtggtataagtcagagggctcctcattcctcataagccgacaaatacattaatatcatcagaaaaattaccagggcctgtggtgtcccaaattctgatttcattttccattgaagatcagagcacagaggaaggagatacctcactcatgtgctcttcttgttatatgctcacagtttctttgtttcaatgactctgtaccctggaagaggttagacctggatatgctaaaaaaaaatttttttaatccctatcctagaatattgtggccttgaatcaaagtgttttctatgtttgtgttttcatcttccttcctaagccctatatctaggttttgccttctccatccacaaatctcaggatgctatggagtctgaagacacctgattgcagaaagcacaagaccccccaccagcgcgcgcacatacacaaacaaatacaggaccagaaaggagtggttactgctgattctctaacattacaaaaatatcacggttgtaacttctcaccctgccagtcatatgtttctctgtcacttgacatactcccctctttggggtgttggaggaaaaaatctctgtgccaacagcagagacatggaactagtgtgtcacatccactctatgaacagaattcttactactatttataccctaaaaagcaggccattttctagagtttcaccccctcaccagaaagaatttatttgtgagtattggttgacttactataacaagagactcaagtgttaatcattaaaggaacctgttagtgctttcttagaagtaagaggaagatcacatttaactggagagtgccttattgtggttttcaaggaaggtcaaagctcttacttatcactgctcaatcttcacccgatgcccaaagaattaacataattttgaaccttaccctggagaagcgaaatgggaccttgtcctccagaaatgcagaagacactgtgctgtgggctgggggagtcacggagcacgagagtatccatctccagccctcactggaaataaaatctgcacagttctatctctttccagggcagccaccttgttctctgcatgaggagcatggaggtccagatgcttccaggagggatctggggcaaagctctaactaagcaacacattattttgattttgtgtgtctgggatataaggatggccggtaaggggaacaataaagttcttgagatttcacaagtaatttattgatgtccagaatttgaggtgctgatggtacacctaagtggcaatatgcaccaggcagatcaatatgtgactcgtcagagaaagcagaatgggtgatgtgatgtgcaatgccacagaagcactgcagccaggagaggtgacagctaatggggatgtttggagtctttgagtgaaccaaacacatcccagagtaattgtaatttatttcagtcaatcttctgtacagacttagcattcacctttggaggaaggtcctttgagcagggacagagatggtgatgtcactgacagtcccccttttactctgggtgagaggtctagaatcctcagctcctgtattcgtgcccacaagggcctcatctaggtgaaggctccacctgccccaccctgccatggccaccaggctcctctgctgtgtggttctttgtctcctgggagaaggtgagtccccacaaataaagcacctgcatttttggatattgccagttatgattccaattatgtttcttattctgtccccaaattctatctcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgccgaataggcatatttatccattctcttgtaggaatgataaagatgaacttccaaggggaaaatattttcaaaataatccatggcacataaaattatttaagaaaaaataaatcaataaatatccctgttaagtttatatatagttttatatgcttgggtaaggaagaaaaaaagttgtgatatattttgctggttatttggagagataaaatatagaaagagcagaaagaacatgattagctttgtctttgtttaaaatttttgctttttaaatttgatacactatttaccatcaaaatttaaaacaacaccactgctataaaacaatatacagacaaactaaaaagaaaaaggaatttactatgtaaaaaaaaaaaaaaaagcgagagcttataggcagagtattaaggggaatttaaaattataaagacctgtaagttttcagagaggtataggcctcacagctggagctgggattttaatgtccatatgaaagagatgacagaaaacagccagaattacattgcttgccttaatcctggagcttcaaaatgctcccaggctttataaagtaaaagtattacaccccaaagacccagaaacataattggaaactggatgtttggtcaggcctttgggtgatagataaaaaggaaaagttaggagagaaaaattgaatcttcagactgtgtctcacatgtgtttggaatgaaatatactctgcatggaatgtacaccatatacccaaaaactgacaaaaaggtccataaccattaaaacccttggagaccctggcattaagagattcaatacggttctggagtaaacttctgcttccaaccaagatagattaacgggaattagatttaacttcttgcttgaaacagctaacaccccaacccccaccctgtccccctgcacacacacattcacacaacatgtggaataacggttgtcaagacattggaagtaggcaacagaagacagtgatctctgagagatggaaacaaccaagctgagaactatgactgtcttaatacctggagggagtttccaggccctgggccagaaagaggaatccaagcagagctgggtgatctcactgagctgagtcagagttggaaatacaagatcaaagcagctagatttcacatgacaggccattgaaaaggcgattgctgcacagagagaatcctggagaccttcctagggtctcccttaacccttcagctgtgctgtaagcagtacatgtgtgaggaaactccctaaggttggagaaagagccactcagcaagattagaggaaacaatgcctggagctcacaaagggctgagagtaatatatacatatattactctcatatatatatgtatatgtatatttttgcattgagaatgggaaacttaataattcatgggtcaatcagtagaggtttcagatgacttatgcctcagtataaaagcaaaataagcccttcactaaataagccacatttggctcctggcctatgtgggtgagacttcaaaatatcaaactgtttccgagtaacttaagtctcagagcaaaactaaagaatatttctaatgtacaagaatacctgttcggagatatcagtatgaatttattgtttttaaacgtatagatacaatggtaaagaaatgaatacatacctgtgtgaataatgggttggtatatatacatgtatttcatacttctgtccacttagaagaccactagtgcacagatgtttgttgccaaatattattctccaattaaaaaaaaatgaaaggtggttctaggaccctgaggtaaaaaatacaagaatgttgtaatgaggttttccaaaaaaaaaaaaaaaaaaaaaggatgggacatatctcaaaaggacagaggaatcaatctgaaagagcttccccaatgactaaggctggaacaatttgtaaaagaaaattcacaagttcacactgagaatgaaacgattaaataaataaataaataataaaaaatgtgagaaaggacaatctcttactgaagaattccaaattgcatatgtagaagaaacagagggaaatagaaaagtcactgtgacaacaccactgtgagtaactgccacacataaaacccaatagtgagtgctaaaattagtgggtgtagctaattttaattactaattaataactaataactttaataactaattaagaagaaatggatcatttgtacagtcacaaagtgtcatccccaaaatattaattaatatggtggttttaacatatgcccacacattcttttatactcatccctctagattcccctctcctggattcagtggcctgcctctaatgaacagacatgggaaatagaaaaatggtaaccgagtgatccaaagtaaataaactgacccataataagtcttgttaacctcatgtgcattctcttatgatgcaatgttgtgatgttatcatgtgactacatatctgtaatattcctcccccaaatctataattcctgtctaataatgagaaagcatcaaacaaatcccaaactgaaagagattctacaaaacacctgaccagtaatcttcaaatgtcaatatcgttaaaaacaaggaaagagctgtcacaaattgaaggacactaagaagatatgacacttaaatgcagtatgggatcctggattaggtgctagggcaggaaaaggtcattattagaaaaactggggaaatctgagtacagtctagcttagttgtgccaatgtcaaattcttagtttgtgtgatgttagcactagtgggtgttggatgaaggatataaagtcacttggtagtattgttatagctacaggacatcaattctccagctttgggtcacctgagtccctatcaagccaatttgtgaagctgctgttagttgtccttactccccagtcttggagctctcagttagacctagaatcaacctcttcttcctcttgacctctgcttcactgcatcctaaacgtggtgaggtggaggggtggtgagggaggctgagcagaagcccatcattcagaagcccatcactagagcttctctgatgattctctgagacaggggctccctctgtagtctcctttgtgcacaatcccaagcacgctgggccacacagactccaccaaagctagttttgtgaggaggcaaatattgaggctccattgtgaagagaatgtccatgtcagatttaagtacaaaagattaaagttgatgcattactattgcaggaaaatgatacctgtgagaatttccaaaagccagattttgtattgtgtggctggctgagtaatacccctccccacaaagacattcacatcctaatccctgggatctgcctctgttaccttagatggtgagagtagactttacagatgtgatgaagttaaggatctggagataaggagattattttggattagtctggtggccctcaatgcaattacatgtgtccttataagagatagccagggggagatcagacacaaatggagaagagaaggcaatgtgaccacaggagaagagattagagtgaggtgaccacaagccaaggagtgaggcagccactagaaacagaggcaaggaacgaatcctctcctatagcctccagggggaatacggtcctgatgacacctggattttggtccattgatactgattttggacttttccagaactgtgagaataaatctctgtcattgtaaaccagcaactttgtggtaatttttatagcagccactcaaaattaacacactccaatatgtccagttaacctgagactaggccaagaaactcatgttcttataatattttctgcaaaccttgctgtcatgtttttatctgacacccatctcaaactataatgaaagaaaataattttgagacttcaatgtccccctgtctggggtgtgccttccatagttcattggaaaagtctagtctcctttcaagattttattccagcagtacctcctcttgaaagaattttaggcattgttttctgttctcagtgcacatactaaaaagaaaaagacaaagactcatgtctacttgatgtttacatttttgcggggagggagagacagagataaacaaataagtaaggcatatagtgtattagcaggtgatacctgcaatgcagaaaaagaaaaggcagactaaggtgagggagaccaggactgtcagagtaaggagcgttgaaatgacaatacattgttcagagtagggcccaatgaggaagtgacctttgagcaatgatttcaaggagatgaaggaaagagacatgtaggtatctgggggaaaagaattccaggcagagggaggagccagtacaaataccctaaaaaaatattttaggaccaatgaggaggcccatatgactgaaaaattaaggaagggagtggtagactttatttccaagcggtaatggggcaggatggatcatttaagaccttgatggccttaagtgctttgttgttttgttttcttattccaaataaaactgggagctagtagatgatttggagatgagtgacatgatctagcatgttctagagggctgagtttgagagctagttcagaagtaggtgaaagcagggagatcagttaggaatctattgcagtaatccaggaaaaagatgatggtggccttgtcctgagggttagcaaagaaggtgatgaaaaaatggatggattctgagtgtattttcatgatagagccagttgaatttcctaatggattggctatagggtgggatagaaaaagaggatttgggaaccactctaaggttttcagctggaaggctgttggtggagtaaagttgaggataatctttcatgtttagagcatgctgtttgagagtggtggggggaaaatgttgattggagtgcattagagagataatgggaaaagagaatttggaggtaagtattgatcattagcaatagcaacaatagctaccgtagattaaaatgccccacagtctatggggatgtgatacatgagggaagacagggccagatgggatgaggtaggatccagacatcagactcaggagctacgagtggtatatataaggttaacacctagtcaaatgcataaacaggttgattttaattgatgtcagtttttctccattgccccctctagaggcaatcttcttcagagaaccctggctaggtcttctatgtttcatgtccgtagagggagctcctgagactgtggacattggctaatatgctgatgtcactggaggccacatcttacagggccaagagacagatttgctttcctttttctcatacttgtaagctccttcatctggaaatgtgatttacctgggtcctgccatggtttccaggcttctcagtttagtgtccctttgtctcctgggagcaagtgagtcttcaggtacttaaatatctgtgctgtaccctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgccacgcctgttgcatcaataactattccacagaacagcatacatggtcaaggaatatttttaatatttacaatgaggactgagtgtttgctaaatgaagaaatcaaaggagtacattctggagggctggtagactcccagagccagggtttttgagatgagagtgaaaataagcaggctgagagcagaaagaaagaaagttctgcagatagaagttaggatattaccacttcggccccagcccagccagtaaatgtttagaagcatagtagtaattagcaggtaggagttgtggggaggaaaggaaactgacatgatgggaagcaggaccagctacaaaatcttcaggaccagctcagaatgaaaatgccggggctcgtgttaaatcttaggatttcaacatggtgacagcagagcactaaaccaagcagggggcccttctagcaggaggccccatggggacctaggaaggaggtcacatccatacaaatgtaaagaaatgtcagagtaaatttcctccattgtccaggagattcggaataggttctcctaagactgatatttcttcattttaatagagttgctcagaaatgaaaaacaatcaatgggaagaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgtatcaacacaactagtagcaagaagttactctgatgatatcagatgtttatttgggaaacttgctagtagagaaagctacatataatatttggatgcaaagggacacagaaggttgaagagtccctaattttgaaataagggaagatgactaactgtctgagctgagaaaactcaggggtacctggaggcagaggaatggataagatgacttcatgcaccacaaaaagaaaaaacctcacattctcatgaacgcactgtaaaaccaaaggatgtcctcatgtgaatgcaaaaaataggccatctgtaaatccaaagaaagcccccagatctaaaatgtctccctcatcccagattccccttcattcctgagcaccttagatttggtataaataacctgcttgggagggggctttttgaattcgtacataatttaaccttcacacagtttctgcaaagtcagaatggtgattattacctcacatgcagaaaaaagtgataggaatttctgtcttaaaagtcttgttggtggacaaaggaagttctaggatttggatcttgtttttttgggttccaatcccttgctccagttaaaaaactaccacataaaatggtgagaagtaggtaggcaagtttttattgatagagaggaaatcaaataatggcaatgaggagacatcacctggaatgttaggcagtgcctaactgggggatggacagacaatgggcagtgccaacccatagggtggatacaaaagacaggcaaggaaggggtagaaccatcaaagaggaataggctggtgaccccaaagcaaggaggacctagtaacataattgtgcttcattatggtcctttcccggccttctctctcacacatacacagagcccctaccaggaccagacagctctcagagcaaccctagccccattacctcttccctttccagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttggg

SEQ ID NO: 37871 - DNA, 3688 bp, Homo sapiens
gcagcccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacaggtatctgaatcacctggggagtttgctgtgcgcttcttaggccctatctttcagaatcgtgacctcgcaagtctagggtgaggctcagggatctgtgtttggcaagtgcagtcctacctgctgcttcctgtaaatgttcatcgccctcagacagcacgctgaggaagtgctccctcccgaaggctcgcctagacccctctggccaccgaccccttcctcctgagctgctgttttctagtttgttttggcgcttgaaatgctctagttttgccaagccagaaggaactcctagatcctcccatgctaccaaggaagaaactgaggccctgggagaagagacttgtcctaacgtctggagcttccggtggctcttgttactgacgccatggccttgaggaggagtcgggatttaggcccacgtgggccacttcccaaacctgtgcttaatgcagcccctcagcccgggcaatatagtgagacctcgtctctacaaaaaattgagacagggcctcactgtatcgcccaggctggagtgcagtgacatgatctcggctcactgcaacctccgccttctgggttcaagcgattctcgtgcttcaccttcccaagtagctgggattacaggtgtgcaccaccacgcccggctaatttttgtatttttagtagagacggggtttcaccatgttgcccaggctggtttcgaactcctgagctcaagcgatcagcccgcctcggccttccaaagtgctgagattacaggcgtgagccactgcggccggccttacaaaaaaaaattaaaattagctgagcgtggtggtgcgtgcctgtagtccagctacttgggaaactgaggtgggaggatggccaaagtccaggtggtcaaagctgtagagagcccagattgtgccactgcactccagcatgcaactatatggggagaccctgccttaaaaaaaaaaaaaaaagtcccagggaggttattatgctaatccctgctcagcattcttttcagaatcttttttttgagacagagtttcgctcttgttgctcagcctagagtgcggtggcgcaatcttggctcactgcaacctccgcctcccgggttcaagggattctcctgtctcagcctcccaagtagctgggattacaggcatgtgccaccacgccgggctaattttttgtatttagtagagacggggtttcaccatgttggccaaggtgttctcgaactcctgacctcaggtgatccacctgcctcttcctccctaagtgctgggattacaggcgtgagccactgggctcggccctttttcagaaactttaagtccatatgaggtgaggattaccaaagccctttgtaaaaggaaaagtattgtacacctgtgacatatcaaaatcataagcatttttccttagggaagttatacttttagtagagacggggtttcacagtgttagccaggatgttctcgatctcctgacctcatgatccgcccgcctcagcctcccaaagtgctgggattacaggcgtgagccaccgcgcccggcctccttagggaagtcataatgccctccacttatttgtgtttctatattgccacggtacccttacaagtacttaatgagtgtattgatgaccacctccaaagcccagatttccttatgcttcagcaaacacctctgttttctattcttctttccttcacgttctcattactgagtaacagcctcaggtccagggaatctctctctctgaggaatcagatgacacctggctgttttaatgacacacttgtactttgagttgctaggtctgtagaagtggaagccatgactcagccagaacacctgttcagcccaggggagaagggctagagtctttctttactcatctccttaaaagagagaaaacctaagagcctaccccctcaactttccctctagagcaacacagagatagttttcattccctctcttgatgcaaatgtttcatagtgtgcccagcagtttacccacatcagtagtccagtgaaatagtaaggaaaagtgtcctcaactcttcttttctaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaagtaagtcagcaaaatctaagtacacaatatttgagcagttctcccagattttgtgtgttaagacatttaaaaccatgatacagcagcacatgtaagttggcacaaatcttatggagctttgtgtaataatgtttgtaaatgaggtaacattctactgaatctggggcatttactgttgccccattttggtaatggaggtgggggtataaaaggaaagtggccatacctcttagtcataagtactggggatagatatgcaattgagatctgattttaagtcatttttaagaatttgctgttttgaggccagcatctttcctgctaatctgtgatgcccttggccaatacagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtc

SEQ ID NO: 37872 - DNA, 2105 bp, Homo sapiens
gcggcggcatccgggacggcgggcgggctggccaccacgggacaggaaggtgagatccgggacctcagctttgcaagcaggctccgccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagcgggtctccggcggcggcgacgggggccgggccgcgcgtgacccgccgcagtcacgccgttcttaatcactagtagctggtgctccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgtaagtgcttaggagttactgtcttaacttgggggcttgacttgtagcaccccgcgttcacgtctgaagcagtactgttatgccagaaagtgtttcacctgtcaaagtgaaatgtgctgtgagaaactagtttaattccagtttctggagggcgggtattatggacctgtttaagtaggatgcagtgatttattctgagggattcccgttaaaaagcagaactcagtatatactgaaatcaatggttttttgtttttttgtgtgtgttgttttacttgattgtaagtattacacaaaacaacctgtaagttttacatttcttaataggtgtttaatttaattattttaaatcttaagtgtgttagtgggatattttagaattctttttttttttttttaattagacagagtctcgctctgtcgcccaggctggagtgcagtggcgtgatctcggctctctgcaagctctgcctcctgggttcacgccattctcctgcctcagcctcccgagtagctgggactacaggtgcccgccaccacgcccggctattttttttgtatttttagtagagacgggatttcaccatgttagccaggatggtctctatcacctgacctcgtgatccacccgcctcagcctcccaaagtgctgggattacaggcgcgagccaccgcgcccggcctagaattcttggagataaagcaagtacatttggagtagttgccgtgacagcattactagaccctaattgtattttcttttttaatttgaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaatt

SEQ ID NO: 37873 - DNA, 439596 bp, Homo sapiens
tcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggtgagtgggccgcccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctctgacagcttcatgaaactaagcacctatcagtcctgcgaggcgtggaatggctgggggctttgtctggtctctctcggggctggagacgggcaaaggaccatctgttacgtggggctggaaattgcacagaaatattgcctgtcaagtgggaacttggaagttagggaaactttaaactccacctactcctaaaaggatgatggatgtctgggttggcttctcccttctctctcctacctcctcccactctgcataaaaccgtagcgttgtatcccaattagcagctagcccctgatacgcataaggcaaaggcatttttctgcagttcaaaagttaagaaggtttgtgtctagtggtcttggctgaagaggagtggaagagaccgggtcagttttacagcccgcccccagaggacagttggttacaaaggaggggccagcgcttgcagactggtaggaatgcaggctagctattcagcctgtggcctggaggaaactcttatcatcctgttcgaaactttgagctgtggccacagaatgtgggtgtctctcctcgtttctcagcagttttgtgaaattacagcagaaaccgaccctacaaaaaccatatccacaagaaccttttctttaagtcattctttttccagatcatcatgttttgacttccatatgtgcatgtgtatgtgtgtgtgtgtgtgtgtgtgtgtgtatctatgtatatttccttgtcttgggcagtgatttgagtttttttttttttgacaattttttttttaaagttaaaggctgcctttttagatagcaaatgtgaaagtatgccaaaaaagattattggagaatctgggccactccccaaaacgtcttagagttaatattataaaaatgtgaggaaaagtaagtgattaagccttcttactccgagttattaaaaagctttcaggatataattgtagcatgtgcttgtcagttctgggtgtatgctagttgaacactgtcggggggagaaagacagcccaaggggtacatagaatcactgctatgagttctttcttgaacaatcccctgcccccaccccacccgcctcccgccccagcccttctaatcctctgcaacttgttcttctatcccagcattctcgtattgtgcagtgtgtggtatatgacgacttcctgtctgaacagcagaattttcaacccttgggagagaaaaggagagacagggaactaatgttctccagctgttatccttaaatgctacctctgcattttcacttcagccgaagtgaaatttcactgggatcagatttagatgcactgtggactttttataggaaaaacctcttgtgctcagctgattcaagaggaccaataggaagctttacaaggtaactgtgagttttggctagaggtacacactgtgtttagttttcatcaactttcttcaaatgcatcgagattcctctgttacaggtgaggaaaacagaaatagaatgaccttcttttttcttctctaaaccccacctatactgtggctcctcccaaatagggatgtaatatatgtaatgggttatggtcaactttgttattccatggtagattgcaaataacctgctgggctcaggtgtggcagtgccatctttcttatctaaaatgttacatttcaaagaaagtaaaagcaacccctagacatagtatctttattatcaaagctgactgaaaattaagacagttttatagagttagtggattttctgtatggtatatctcaaacataaggaggaaattatccatgagtgcataacaataaaatacagtgagagatttattaaagtaaaataaatatggcttgagaagtactctgtacttctatatttgagtccctgtgaactgcaacctaacttaatagctaggcaagattgaaaaccttaggcttatgtacctgtaacaatagctgaggtcgggcgcggtggcccacacctgtaatcccaccaatttgagaggccgaggcgggcagattacttgaggtcaggagttcaagaccaggctggccaacatggtgaaaccctgtctctactaaaaatacaaaaagtatccaggcgtggtggcgcatgcctgtaatcctacctacccagaaagctgaggcaggagaatcgcttgaacctgggaggcggaggttgcagtaagctgagatcacgcaactgcactctagcctgggcaacaggacaagactccgtgtcaaaaaacaaaacaaaagaaaacaaaacaaaacaaaagctgagtcttggccaatcccagcagccatattcaaccagtcatacactgctgagtgttcaaactgtgtttaaataaggcaaacgccagcctgtaaccaatcttgctgttttctgtaccttacttccgatttttgtatgccattttcctttttttgtctctaaatcttcttccaccatgtggatgtcctgaagtctctgtgaatccactgtgattctgggggctgcctgatttgcgaattgttcgttgctcaattaaattcctttaaatttaattcggctgaagtttttcttttaatagatagctcgactataaaatattagtgtttatgtttcaaaaatctgcaacttaagtatattttacttattaatgacagttgacatcgctgtgcaaatgtttgttgaatattacaaatattgttgaattattagaacttttaacacgtcaatattctgttggtaatctcattatcttctgctcttggaaaataccttttcattaaaaacagttattcacgaggcttaccttagcagatgtaatgggcagaggcctccaactcagtgtattccaaggactagcgctatccgcatcacctgggagcttgtcaaaaatgcaaaactactccatcatttatcacgtgcatgttaaagttgagagaacttactgtgtagagtacagagcattgacttgggagtctaaaaatttaatttcagcatcaactccggggtgtttgttctctaaagtgaagagagaaatttcttgacattacttgttattatgtgttccttgaatgtgtagtcattcatttcatttttctcttataatgccgtaagggaccacttcatagagattaactttggaaagacattaactaacagggaagttaagactgttattaccaagaaatcagtaaatattcctcccacttttgtcatcctttttgatctctcgtctctgtcttcctcacgaactcccgcctcctcttctaactcaaccagtcctgaaatccttgcttttctccatagatcaaaggtatgtgtaaatcgataatgagtgtttccaaagtgttttgttttcctaagtccttagtgaatattcaggttattggactaatttgcagccccatctcctattgctgttagagagacttggattttactccagggataaagctaatatctacgtgattagtatggtctggtaaattcttttatggaggaatttttttgtgtgtgtatatctctttcataaagtgtaagtccatgtgtagaaatctggagaataagttggggtgcttcaaagtcattagaaccattagctttgactccagttaagccaaataaatctcagttcaagtgggaaaagagaagctgctctccctgccttttaaggtttctgagcctcaccatcacttactcagtggtttcagtgtcttgtttattctgcttcagcaggtcagaggcagtaccattttcactgttaacagcttgtttgcaaagccgaggacattgttgaattggggctgatgagagaccatagggaaagggcgagatccttggtaactctgctgctctaccaagggcagtgaattcctttcaccatctcagatcggtgctgtcagatatgaggagagccatttgcctgagagcataaatcttcacaaatccatcgccacctcaggaaacatatcttgaaattataataacagtggcagctaacatttattgaaagctttctatgtccgggcataattctaaggacttgccatgcagcgacccacttcatcctcgcaaggatcttgtggggtagttacttgtagattccacattttactaatgaggaaacataggaccagagaggatgatcattttcccaaggtcattcagtgagtgtaggctgaatggggacccggggccagctctatctaagcccagagtcattattcattcattcaacttaaatatatgttaactttttacttcccgctatgggcccaggactcatagattcttaggataagtcagtaaacagatgaaggtcctgtccttgtcattcataaatgcttgtgtgtgtgtgagcttatgtgttgggaggaaggggaactagaatggtgaacacccacacacagtaattcagtaaaccatgtggtacactataaggggctaaggtccctgaataaagaaaattgtcagattaagatgattgggaatatgggcgtagggtattacattttaattagagcaggcaccatgagccttactgaaaagttggcatttagaccaagacctgaaggacatgatgggctgagctttgaggatccaggtagcatgctggctgctacttttaatcactgtgatgaaccgagggacattcaagtgtcccccacatccgctggggatgaattctgaaaaccccagtggatgcctaaaacttggagagtaccgaacctgattgcagtcagtcggaacgtttctgtccatttcttcaaccctcaaatttaattccatcttaattaagcacttatcatgcatggtggctctaacttttacagtttgaggtaagacagcaaagctagcaggaatttctttttccttcttcacagttttacggatagaatattcattcttactgtaaatcttagcagcctcagcatacaattttttttttttcctgaagaactttcaacttttcacttaaaggaagccgtttatgacttcttggtctattttaattgccagcatcattcctgtcacactttggggccattaagaagtagaataagggtgacttagacacaagcactgcaatccctccacagtcaattcgatcaccgagatggctattccgtgactccagggcaggaagtgtctacagtgtggagttgctggacctcccaagatggtgtgagattttatcacgctacttggaaagaactcaaaatttaaaacttaggaattgtctatttctggaaatgtttatttactatttttgaaatacaaccatgggttgctgaaactgaacagtaaaactatggataagggggacttctgtacagtttatgcttgtcttagacagttcaagctgccataacaaagtaccatgaccaggtgacttattaacaacagaaatttgtttcttacagttctagaggctggaattctgagattggggttccagcacagacaggttctggtgagggccctcttctgagttgcagattgctgtcttctcattgtattcttgcatggctgtgagggaaagagagcaagctaactctctggcctcttcttttaagggcactaatgtcattcatcagggttctacccttgtaacctaattacctcctacaggccccacctccaaatgctatcacgttgggattagagattcagcatatgaattttgggagggcacaatcattcactcctttgcaaagtgtgagggcataaatttatcattttgcacaaagtataacattatccgtcttctgtagtcagctattaatccaatgcaacagggtcagtctggccactgggcatactagattctttgctaatatgtttcatccacttataacagataatttgtgacttcattcaagggaagggaggagaaggcccagggcgtgctcttcaaacgtaatatcctattattgctttgactactgaatgctgcctgacttattggatatgtgcatattggcctaagatatctcaaaaaatcaccctagttctgagtagaggtaggtgttcatcttttgcctctagtgactaatttcattctgatgcaagtcagagttaagtgatactgttccactgttagtttcaaataaaagcattagtgcagctaacaataacgtctttggtctaacaatgagaagatattttttcgagatttggggatctttttgcacatttaaaacaaaacagaaaatagaggtagcttttcttttcacttggaaatcaactcacataaactgtcttaactctctttgccttttgaaatagaatgaattctggattgattttgagtattaagatgcacttttgtcctaaggccatatccactggtgtctctgaaagctgcttagataactttgcctggctttttggtagaactttctaggtattatgcattttaagatggccttagggatgtaataaaatatgtgacagcatctggaataaaatctagagtgaataaatttcttgaatggatgaagggaataaataaagtttagatacttatatacagatgctccttgacttatgacaggcttatgtcccaataaaaaaagtcttaagtcaggtggggcatcatggctcactcctataatcccagcactttgggaggttgaggcaggggatcacctgaggtcaggagttcgagaccagcatggccaacgtggtgaaacccggtgtctactaaaaatacaaaaattagccgggtgtggtgatgggtgcctgtaatcccagctactcaggaggcagaggcaggagaatcacttgaacctgggaggtggaggttgcagtgagccgagatcacaccattgccctccaacctgggtgacaagagcaagaatccatctcaaaaaacatatatatcttaagtcaaaaatgcatttaatacccctaacccacccaacagcatagcttagcctaccctactttaaatattctcagaagacttacattagtcttcgcttgggtaaaacatctaacatcaagcctgttttataatgaagtactgaatatcttctgtaatttattgaatgctatactgaaaatgaaaaacagagtggttgtatgggtactcacagtacaggttctactcaatgcatgggcttttgcactatggtaaagttcaaaaaatcattaagttgggacattatctgtaccttagaaaatgacatttgaagagctgtcatgaagaaaattagacttcagagtgctgaacaaagaatatacataagttacaagaagttatatttggctcagtctaaggaagatctgtctaatgattagagctgcccaaatcgtagctgggctacctaaggaaagagtgagccctctcaaatgggaaggtggtaatcacagtggaggaggttgtgctagagatttctgcattgagtaaggggatcaactatctgaccctgaaccacgttccctaggaaacattctatcacataatcacatgtgattatgtttgatgaagggttattagttctaagtcatgctgctactttttctctttagtacttctttctctgtcatattagttactgattagaaaatacttccctcactttttctgggctaattatgcatgtgagtgtattatacatacgtgtttatatctatctaaatatatttagatattaattttgaaaatctaccaattttctttatttctttgcctttggtgggagataacctgcaccaaaaattggatgtgataaatgatttcctattttcagtgcagtaatggataccaagtaaacttacagcgttatcgttacttttattactgccctaaaacacgtagatctactaaacttgaagcaagacccttaattgtgtttatggtgaatgacttgaataaatcttttcacttcgagatgacttttaattgatgttattggtcagtgatatttgatcagaagctacagactagaaccatacaaaaagggcatcttcctcagggagcgctgaggcacttttgtatagcacagggtctgctgggaggggcagagtggcagttcttcctcctggtaataaaatcagtgttggtggaacttcctcagaatgtagcttctttctttttttttattcctgctatagctacagaaattcagatctcctctttcatctcttactgcattaatctctagatacaataagatgtactctaaggaagttcagagtctaattgagaagctaggcatggaggccagtgatttccaaacaagataatcttcctgattcacagaaagactctacttccccagtgtgctaaatgtggacatgagtgagaagtgggaagtgcgcctaagaattgagttaccctctaagtaatgacaaccctggacaacgtctttaattcctgaaatgtctaaaagatgtgcctgttttctaaaaacaaaaccccaaaaccaacaacaacaacaaaaaaaagtgagtagctgggaggaagtagagtgtaggctcttgggagaagctaaatattttgtttagagattctccctggttatcctcaaaaccatcatattccatttctcatatggcttggtccatggaaggtgattcctgtgggttccgtgtaagtgaggaccatggtatgctttagcaaatgggcggaaaaacctggcctgcctgggtgcttccccagcctgtgtaccgcagagaataatagtggaagctggtgggcagctacttctaaaacgtgctagttaataccccagagagggacagctttaaaacttttgacatgaataatcactgaccatctctgaattttcctgggtaatgaaaaacaagcacatggtcagcattttccccgttccgtagttgaaaaagtgtagactgtttctggaactgcaaatctctattaggttgtgaattacatttactcattctatcagttcctctttaaattcttaaaccagtaacaaaatgaaaaacagttgttagcactgcgtgaactcataattgtaactgtagaagccatgagcaatgtgtagaaatgttattaaaacattttttgtttgctaccctttctgtggtaaattcctttgctgcagtttctgtgcagatgtagcagtggaaagggagtcaaaatttctagagaaaaatttcaggaatttctctgatatttgtggattggcccttttgctgcaagtaagccactttttggcaaggtggagaagtcaggaaaagtctacttatatgtgaagttgaaccttttggttctattgagtactggggtcaagtagtagaagcatcttggttaagtccaagaccaagggcaggtcttaacacattccagctgtcagtggtaactcagaccccaggaagaagaagaaggtatgcagctgagggaggggaggaagaaagaacataaaaataaggagaggagagaagaggacaaattcagggagattgggaattagagcatcaattgccctctaatgtaaaaagaacaaaatcaatgttctacttaactctcttttcttcaaaagaaaacttaggggacaaaaatgattattaatagatatttggtaagcttggctattgccaagtttattccattttcaatcattttaataattatagctagcagttattgagcacttactaggtgccacttgctcccagagcaccttaagtcattcatgtaatgctaaagacagccaatgaggctggcactggtgattgatcccactttacagttacccacacagaagcttagatgccaactccctacccagggcacacagctggtgtgtgactgagtcacgccggatttccccgtgtttgctctggagaccatgcccctcctcaccctgcccatcaccctcattttggttgcagcccaaatctttcccaatctttgttttgtttgtgtgtttaaaggaattgcagtgactgagaagtggccccttccaaatgacagttttatgggctaggtgatcaaaaatgaaaggcatcttctgagggaaacttttaactcattttgttccctttccaaaagaaaaattaactgctcattaggaaacaatctgctgacaaattggcaggttatccagtgtctgtaataactttggcatataaaatgatgagcatattctttagagttcacagagtgaaagtagagctgagagggtgttctctaggttctccaggacattagtaacttttaattggtctttgcgctgaaacagccctttacctggggtagcctttgtgcctacacacaagcaaaagctcatggagggctgagaagagtgtacacatttaacttctattctaaatagctgagagtttatacctcatattttcctctggtttcaaagctacaaatttaaaacagcagatgctatggggaattatctcaacatatattggagaatttgcccttctttctcaccagtccctggcccaggcttctccatgattatttttgtgaaattgctttgtaaattataaggcatttcaggaattaatctcatttatcatcacaggaatggtggcaggggcatctatcattatcattagtttataggtgaggaaactgaggtcttggcagatgaaaatagggacctgcaaagaacaatggggatcctttcatcacttttgcagctgtattaggaatagagaagtctgggtccttattggtcatctcaaaacacagggccaaaacccagaagtgtagctttgaagtggtaaattattatgagaatgcggagtgaattactataagacaaaagatcatgacaaaatgacattattcattacagtacacttcctgcttaaaacaactcagcaggggctccctcctctgcaaaactctgtttgggacattaagacaaagttattttactattgggaagatcagagaatcagctctaaaactggggaccctcagcatcaccggagtctttattttcttcagtcttctcttatcctttgttgttgaataactgcatttcacagaggtctttggaagtgtttaggtcctggggtaagccctttaggatgagttgatatcagaactcattgcttttctatcattgttgaatagaaatccatcttattcatttggtctttaattgctttactttccattcactatcctctagtttaatctctatttcttttactgttttctatttctttgtgtttattcattgctcatccttccgtatatgcacactcatgtgattgtaaccctcctcacactgtaggtcttcaatatagttttgttaaatgaataaataaggatggatctatagccatgatctttattgagtctaggaaaacaccctatgaatagccgtgtcatattttctgggaacctttcttaaacttggacattttaccctcgtaaaaagaagtttctctggacatatgtctttttctgaggatattctagtttggaactttatttgtatcaacataattacaccctcttatagatgaaaatagttttgcttgtatatttaaggaaaaatgaaatatgtgtttttaagcattgctgaagacagttgctgaagactcttcagcctcacccatttacagtattgttgacctattttcaatgattagtattgagtagaatctactatgtattttttattgaaaattatgttgttttgtagtatttgttttatctgacttggaaattgggtttatatggaaacttcagtcaatcattaatctagaaaacatttgttctttaaattaataaaatagttctttggcttaatgttctttctctgtgttaaagagtcttagggttatgaatccttttagattcatactaatcaaatgtggctttgtagctctagttttatccttttgttttacaaaatacagaaaaatattgtgtgtatctggtgtgattggaatggtgtctagtagatctgcctctagctgcagctgcccacattgctaaaatcagaagcaaaataaccaatgtaagaaaaaaaagaacaatattgacctgtaatatttatggacatgcacacatacatgagaatagatttaaataaccctttcctagaaattgagcaaactccattgtttctattttttttttctatctgtggtaagaaatacagtatctttctacaaggaatttaagaagtacaattaaaatgaaagtgttatttctttctttaataacatgatatccattagaggaacagcttcagataaaggatcaccataataatcaagctagagaagaataaaatagcccaagatgtgagcttttggagttggaacttgaggtgaaggcaactgccttgtgaacaaaggacttggaatggttgcattgaaggaatcattctgtgatgtggtatctgcctgcagctgtatgttttagtttgtttcctgcatgtgtgttcagatcagatggatggatgtgatgtctcattggtggaggggattttactctgcatgacacgagcctgggtgaccttcattttgaagtgccagatgtcaatgcagattcataggcaacattcatatttgttttttttagtttttatttttaaagatcaacagctgctccgctggtcaaaaagatttatgtagcttcatttggataatgtatattgtgcatactgctctgaaataaatttcaagaaatgacatttctgttctgaataacatacttttcacattttattttgcatccactttgcttatttaattatattttaatacttttctctctgttttttttctctctcttgaaagacctctcctgttgattaccctgcaatcctgtttggagaggcagtatttccttggggagtctttctgcactcctaaagccataacaacatgaactgagcaataaaaaaccaattccctccccttggttgtgcttcaaatagtcatttctttgatactggctaataaaaacaggaaaaggatcatttttaaatgctttggttggggttgccttacttccaataaggaaaattgcctcacaagggggagcatgggtaataaagatacaactaactgaataattgtattcaatccaatgttgaaattcccaagttgctgcctgcaaatttaatttaatcttgggatagctgtgtgttcactgtagtgtgtagatttaaattttgctgtcgctgaagatcatctctttgcattcaacaaagatgaacttacaaatgctactggagatttttgatgcccctcccccattaggaatacctgtaagctttttggtaggtaacaaaatgggacattgaccaagaatgaaatactgagtagaattatggatgttataatggtgaagatgacctcagagcaccttccaaacaaagaggttgaggcacaaagaaaacagctttgctaaggtcatacagatagcaaggccttgggatactaaaattgattttcttagtctagctgtgtttcattgtaatccatttctctcttccccatcatacttctcccattttttccttactttgagaagatttgagatgaatagagtggctgccctactcgtctgtacagatggcctcttcaggactgacatgtccctgcccccggctgcactgtgttagccactgaaggttcacagcccagtgcctctccagaaattactctcatccaagacagggaggttcagggagcggggagccacatgcagtgactagtttaggcaggggtacaatttgggacaattctgaagggtcattttgggtccagagcgccccatggagtttgcagagtcccatgttgcaactacatcatagaccaccttctctctgtccagtttgccttctctccttgcctttcataaggtgatcccacgggtattttccaataaaccacctgcactcagaccatctcagaggctgtttaccaaggaacccaacataagacagcaaagaaattggaacaggatgctgttttggcagtggccatggatggaccggatgccactgttaggcaagtcatcatcttcctgggaatctcagccattcttaaaggggagccttcagctgacagttaagagatatgcactggttttctgtttggggacctagtctaattctttcatcttatagatgaggaaattcaaattctgtgcactaaagtgacttgaccaatagcacatagctagctggcaaaagaacaaaaaacaagcttacagttcctggctgctgccattggtgctgtttttgaagagccatcatggaattttttcagagttctgctgctgctataactcagaattgactgcagatgggtctagagaccatttgcctgatccgtttgctcaactggtgtggaaaacagatacctcaatcattcctccatggtcctgttttactgattgtctgctgtgctttgaagagtgatctctgaagctcacaatagttggtgagtattcagtagaatactgaagaaaaaatactgaagaagcagcagatggttatagttgttattgtctgaaatcagcatttcgtgttactggttattaagagtattggggaatatgcaatgcttattaaacgagggaccaatggcaagtacagattcatcaggtagaggaaacaagcaggagtgagttgaatcataagcaagatgaaaaatgactaaaaattaatatgtactcatgattatactagtttattagtcattttattacactcaaataacattccactgagattatcaaattactataagctcagaatcactatgatactgagaaatttggaattaatttaaaaacagatgattagcttattattatcactactacggggatccaggttttatatagtttccctggcataattaacccagctactactttagaaaacattcttagactcccattgtctgtaaattaactcaaaattgtctgtaaattaactcaaaattctttttttttgatacaccgagtactttgtgccagattctctttctttcagtctgctcttctatatttactctatattctggccaaaccaggaaactcagtgttccctaaacataccttttattttcctaaatttgtgtcttgtatcatgctgtattttttcttggaatattcttcccatgtgattacccgtcatggtatactcgattcaaacccaattcaatgttaacactttaaaatgaaattttctttggtttcccttagatatgtctgtttaaaatactaaacttcgtactttgagaaaatatatcaggtgctcctaactgcattcactatgtcttccctctgaactaccatggcagtttatttgtatgggatttttatgtcttactttgcatatagttacttgcatgtctttaattcaatatatttgtaggtatccatgtaccagagtctattctagattgatatggtttggctgcatccccacccaaatctcaacttgaattgtagttcccataattctcccacatgtcgtgggagggacttcgtgggaggtaattgaaataattctcccacatgtcgtgggagggacttcgtgggaggtaattgaatcgtgtgggtggttaccttcatgctgctgttctcgtgatagtgagtgagttctcacgagatctgacggttttataaggagctcttcccccttttggtcggcatttctccttgctgctgccatgtgaggaaggacgcatttgcttccccttctgccgtgattgtgcgtttcctgaggcctccccagctatgctgaactgtgagtcagttaaacctctttcctttataaattacctagtcttgggtatgtctttattagcagcgtgagaacggactaatacatagatattgggttttttatttttttatttttatttttattttttatttttattttttgaggcagagtctcgctctgtcgcccaggctggagtgcagtggcgggatctcggctcactgcaagctccgcctcccgggttcacgccattctcctgcctcagcctccagagtagctgggaccacagtcgcccgccaccatgtccggctaacgttttgtatttttagtagagacggggtttcaccgtgttagccaggatggtctcgatcatattgggggttttataaaataaagagttgtttttgacttaaggggcccacagtctggtgggtagaaactaataaagtactggaggaaccatagatggtaaactaaagcattcagtgaaagacgccagcctggccgtggtgagctttggctgtgggtgtttacaagggctttctaactgagtgtacctagaactgaatctgggaagaataagagcttgccaggtgtggctgggaaggcagtgggggaacaacatgaggtcagacaaggaggcgggaaccagtcataggctctgtggggaggaaagggtgatgtgagctgagcgtcacacctggagaggcagacaggttcaagtgatgatgaaagcaaaatgaaggcaggtggatggcaggagagtctgtggcaaatgtttagcaaggggagccttgaatagatttagaaaggtcactgaagaggcaggtggattacaggagttaagggggacccttctccactccttatgtttacttccacatgaaggaccatcattaatttaactcacggcctggagtacttacctgatttgtgaatttgggagaaaaaaattgacatctcagcttcatcctgttttcctctttggagggagctgccctcaggaagcacccttatcttgggggagctcttctgcccatgggtagactagcattggcgtcttgctgctgacacaggttcagtgtttttttgtgtgtgtttgttttcgttgttgttgttgttatttttgagacagggtctcgctctgtcacccaggctggagtgcagtggcatgatcttggctcactgcaacctctgcctcctgagttcaagtgattctcctgtctcagcctcctgggtacctgggattacaggcccacaccaccatgccgggctaatttttgtatttttagtagagacagggtttcaccatgttggccaggctagtctcgaactcttgacctcaagtgattcaccagttacagacatgagccaccgtgcccggccacaggttcagttttagctactttgctgtagacctaaaaccacaaccttcatactagactcaccagaagtgaaggtaccattttcctttctacctgccacttatttttattatttcctcggtttgttttggacctggcaggggaagggagatgctattcgtgagccctctcgataccctagcagtgatgtgcaatgggaggtaggaaaggcagctcatggagagcaggagaacgtttgaattgtggctgggatataatgcctgaagaggagggtgaggctttcatgggggaaatgaaggtagaagctacaggacttggtgacgaattggctgaagggattgaggagatggaagattctagaggtctccatcctcctgtagaggactttggcttgggcaattgggtgccacattggctcctgcaccttaactttctgtttgacctgagtttcccttaagttggttgttgaggccgggagagtgaatcaggcccttcgtctctccttgagacatcccacccaggatctgagaggatttttcagggactgatacacttgggcatttgttcatctaaattgttcattcctttcttaattcctttggcttgcacatatttattaatctccttctatgtgtcagcgcttgtttggcccgcccacgagaaacaatgacaaatgaaacgtttacttgtccctaggaacttgcagtccggtgaggaggccagaagagcatacagtgggagttgctgtttaagcaacttcagagccaaccagcatgagttagaatctgggccctgcagcagggcgcggtggctcatgctggtaatcctggcactttgggaggctgaggcgggcggatcacctgaggtcaggagttcaagacctgcttggccaacatggtgaaaccctgtctctactaaaaataaaaaaattagctgggtgtggtggcgtgtgcctgtcatcccagctacctagaggctgaggccggagaatccctggaacctgggaggtggaggctgcagtcaaccgagatcgtgccactgcactccagcctgggtgacagagcgagactccatctcaaaaaaaaattcttactctgcactatttttaaattctcccgatgtggtccagtaaactagtgagttggcttatgaatatattctgccagagacttagaaaacaaaaaaaaaaaacaaacaaacaaacaaaaaaaacttgttgaaattaatttttgagacaggaacttcctgtctgtggctcaaagaagttgtcacaggagagcaaagttatgctctatttcttcctcctttggagaatcccttcagatcaccatttgacggaaggaagttagaatgtgacttattttttgtgaagttttcctttgtgggtactaattgcatgaaaaatctgagaaagagtttgagctacccttatgttatggcaaatttggacattcctagaaggaggagaaatagtgtattggtatgatttgaagacagagctggtggtaatggaagtagcactctggttagtagtttcctatccccttttgttacaggaaaggagtccagatccagaccctaagagaaggttcttggatctctcacaagaaagaattcagggcgagtccatacattaaagtgaaagcaagtttatgaagaaagtagatgagtaaaagagtggtactccatagacagggcagccctgaagactcctggttgcctatttttatggttatttcttgatgatatgctaaacaagtggtggattattcatgcttcccctttttagtccatatcgggtaacttcctgatatattgccatggcatttgtaaactgtcctggttgggggagtgtagcagtgaggacaaccagaggtcactcttgtggccatcttggttttggtgggttttggttggcttctttactgcaacctattttatcagtaaggtctttgtgacctgtatcttgtggcgacctcctgtctaatcctgtgacttagaatgccttaaccatctgggaatgcagcccagtaggtttcagccttattttacccagctgctattcaagatggagttgctctggttcacacgcctctaacagtttcataccataatgaactttttaatagttctaaagttggcgggggagaatttcattgttctgagagccctcaattcaatgggaaatagaattgtatttatgttgtgggtatgtgtgtttatggtttatatgtatacgtgcactatttcagtagtcacaagatcaaattacatgctatatgccagattctggcacatttatatcctgtagttttagttagttcactaaatccaacacttccaaaatcgaaaaagatagctgaattaaaaggtggtacataagtagtgatcaagtttcctaacgggaaatatttccgatatttgctttatttaaaattacctttatttagcaaagaacaaaaatgcctcagttttttcctaccagttatgttttttctgtaaattgaaagaaatacaatatccttctgcaaggaatttaaaaaatacaattaaaattaaagtgtcatttgtttctttaataatctggtcctgtcctccaggggttgtgtggcatgctttcatttgtatcagagaaacctaagttttaaagcaggacagacatctgtaaatgacctagttcagtactcttgttctggggactaacaagaagcccaggtaccgaaggcatgaaagagttttgcaaaatcccgtatgagttacaacagagagcgtagttgctaagagcagacttggatgccagacttcccaggattcaaactagctggactaattgctagttgcccgatcttgtgcaagtttcttaacctatctgtgcctcaatttttgcatctggaaaagggagtcagaagcagttcttccctccaagagttgtcggggggtgaaatgaattagtaaatacaaagttataatgcctggcacataacaaacactgcttattggtttactatgatctgcaattcagcaaatctaagatgctttgatgctgttgctttcttgatcttagaagcatgactggaaggtttcacacatagcagagttctcatagtgattgtaagattattggttgtaaaatgaaggtattaaataagcagtgagagatggtggagcttggtgttgattaaataggatgttactggtattgtcatgatttaacttacttatgtcagagttggaactggaagctgcattgtctagtctagcccttgtccattactctgcattgtgtatttgggcggtggttatatagatttagatgctttcactttgggaaacagaaactttagctgtctattgtgagaacacagagcctactcctctttggattatatcatttaacttaaaactgtcgagacactgaagtgtttagatccaagacgtgaagatgagtaagtgcagtgctctcgtgggaaaaagaaggataaagaaactctcaaattcccttgaaagaatgtgcctcttctcctgcgtgtacttaacagcctaagggggatgatggagctgcatttattttcctcgaattgttcttgctttatgttggataaattaaatccttaaacaactatacatttcttcgtactgagcaaagatgcagattcatctgaagcttttaatagtaattagaaaataccattttcattgctgttatatttcatccaaaaatggaggctggggtgtccatttgttaagatttatgaatacactcactctggggcaagtgccatgtaaattttatacgtgtctatgtaaatcccccatgggaatgcctaaatgagggcttttgtgaatatgtttaaaactttgggcatgacttctcagtttgattggctccttcattactattttattattcttccagctctagtgggtctctcctgcccctcccttgccctcaccatagttcccccttctcccttttccttatcctccctgttagtccccttttgtcccacacaacccctgccccaccatcttctgtctgtctccaaaatctgtatgtatttgatgggtgtttctgggcagtgtgcccagtttggtttatttgtttctcataattgtattcagagcttcagttacatgtttcagatcgatgctccgaatgacatttgtctcccttctaacatgggaggtttcctggaattttgtagtgttttaaaatgcaaatgcatactcgacctctctaatgtgaagttttacaaaaggagcccccaaactgttcagaaaatattccagacatccctgacttaggttttactgccccaggtctctgtgtaatggaataaaaatagtaacattagttagcctgattgctgctggctgtgttgcattgatctcttcaacaaaagcaatctgctgagtatagttttatgatgagcgtgtgaaagaaccccaggtgttcttcttgttgaaatataagctactgtcagctttaaaatgccagtgcaactctaaacacttcatactttagtctcagcccaaagtctctttctactttgagaaaattctgtataattcttacaacattctagcaaaaactctaaggtatgaaatatggatgtttcaatgacaatagtgggtcttcatagttatttgacattcataattttagatgtttcagacactataatgtcccatacggtggcaactagcaactagctacatgtggcttttaaatttaaattagttatgtgtaaatgaaatttaactttgcattctccaggacactggctacattctccactaccacatgtgaccacctgatgggtggcacagatagaacatttccatcattgagaaagtcctattgtaccgcaccgttacagaggatttaagttagggtaaatggcactaactaatgccagatttcaccgagtttattagagtaaaacagctgctttaacaagagaccatagaaatacagtaaatgaaaggatttttaaaaattcacatagtaggctgggtgcggtggctcacggctgtaatcccagcactttgggaggccaaggtggatggatcacgaggtcaggagatcgagaccatcctggctaacacggtgaaaccccgtctctactaaaaatacaaaaaaattagctgggtgtggtggcagacgcctgtagtcccagctactcgggaggctgaggcaggagaatggcgtgaacccgggaggtggagcttgcagtgagctgtgattgcaccactgcgctccagcctgggcagcagaatgagactctgtctcaaaaaaaaaaaaaaatcacatagtagcttggaggtgagcagtccggatttcacgtggggctcctctttgtaagtcatccagggtgaaggctgcttctgtcttcttggcctgttaccgtccgtggcgccttctgcacatatgtatcccagtttacagggagaacaaaagaactccagtgctggtggcttgcttataggttgacagtgacccagacgtagacatcatttccactcacatcctcttgccccagatggagttgcgtgtccacacccagctgcagttgagtctgggaaatgcggcgttctgctggcagcatgtgtgcagcttaaactagccttgtggaagaggggagaatggattttgcagaagaatcagaagttttacagtatgagctaatgttgcatatagagatgtgatctttaagatgacagttcatttgccatagttaatttgggtgttaggggagatgatataggggtttaatttagatagtacctagcttttattatgttgttatctaaccaaataaggacataaaatgccactaaataacaatagaaaattttatgcacttttttttccccatctgtccactaagaagcatgtgcgtatagtggctcagtttagataccacagggctgtgactcccctgaatgctttctagtgttagatagactttaggattgatgacattgaccatctccctactcaaagaacaaaacttgaccaaagcagccaggtatactttaaaggaatggattttatcgtccgtttgtgtgagtaaatgacacttaacttcttgggggggctgaagggctcatttctataataaacagacctcttccaaggaaacctaagacattcatttccaattagtggaattctattttaatttcctttttctcttttgaatcaaaatggtaactgtcattgcatatctgtgtgtgtaatttctcagctacttcttgctgctgaccctgacctctcttagcacaaacttagtaggattgcaaagtgttgggatacactttacagagttagttttttattcattggtgatagcttggaacaataaatcatgctgttacattaattgctgtgggtcagtaagttccctctttttcttattgttactgacacattgaattttatctcttcttagatgatgtgttagactccattttatccatttatcataggagattaaattataatgtgagtaacccacaacttgcctacattaatctttctgcagctattgtacattgaaacataatgtcctgtcccatgctgaaggaacaaggagtggcctctggccggtggaaagagaagatacttggctgagatgattggtggacccatgctgatggctgcacctgttcccattcatcatccgccctactaggttcaaagttcccagggtgtccacagaagcctctctccatcacatgtgtttatcattgcagagtcagaatcctggctttgtcacttatgagtgatgtgaccttgagccagggcagtaacctccctttgcctcagtttccccatctttaaaatgagaagagtgcttagctcatagggcaatggtgagatttttaaatggattaaacattcccaaagtgagttgaaagttcctggcacctcctaagttttacaagtgttaacaattctttatttttattcattttggtacatctttatgtcaaaaagtcatggaactatttctcttggacaatactgggaaggcatctgtcttaaaatctttttctgtttcatatagttattaatgaatacgaatctaaacttttccatttaaaaaatccctaacaatggtttcgttttattgtgataccttagtcctggactctaccttctctaggatgtcttggtcatgtttttctgttttgcaaatgaggacattgaagctggagaagtgcaatcacctatgcacgggtacacaagttaagtgtttgagttgtaccttagccaacttatcttgctttccaggatagggctttttcctccacacgtctgcattgctgtgtgtgtgtggggggtgggggtggtataaatacacgtatacatatccatacatacatatacacacaggcatgcatctgtagccaaggactctattgtatgagagaaggcgatattcttatatttaagaggagtcctcaaaatgtgataagaagagacttttgaacaatttgagctttgtcaatatggatcccatgttaaagattccagcctatggcatctctctgactcacctctgaaaatgagcagcctcttccctgcaaagtattgcacaagattatttgaagtattatacaagcactacatatgcctcctgctgttatagagctcttggttttgcagaggacacacactcatacacagagatgtggaccagttctgagcatgaagtcacccaccagaaagtaaaatactgttctgtgtccttgttgaaaatgatgtgggggtgatgaaagacatgggggaatgaatgaggtcatctgcaatggtagggtggggtgaaagagggacttctgcgaggggagcctgggttttgagttaatgtgtgaggtcagagggactttggcttggcagacaggatgagcaacatttcctgccagggggacgcaatgtgtgatgcaggaggctgggtgggggtaagttccaattgtagggaatggctggcagggttggtgggctggcacagtgatcttgggcatggaggatatgagaagagtccacacagattacctcactcgcttctcaacagaaaccctcctgaggattctgtgtcagggtagctcattcacatacaccttgtctgggaagaaaaggagagtgcctgtttgtggggaacaagaattccaaaggcgtctttcggttgcccttaaagctttggttagcatccagtcctgggagcaatgatgaagaagccatttaatcagtgtaaaacagtgagtatctcatgtcagaatctcaaaacaattagagcccttattcaaaacagactgggggtactcaaaggaacatggcaagtgcttgctgttccgctagagggaagcctgctgaaaaataaaagtccacaaatagaagaggaaagtgcctgcataaaaggaaactctagctaaatgaagagagtatgaacacatcatcctctggaaggggaaacctcataatcattaaacctggactgagagaattaaggggtctaaaagtttatacctcattttagactgttctgagcacaacttgttgcttcctggtgcctgtgaggatcatctatgccaaggatggattttggccttcctagaaagtccttgaaactgttgtaaacttcctggagtgcttacaatgtcgggctctccgtgtcattcatgggtttatttcaaaatgaatctccattctttcaaggttgggtggagttggcctaagtcttgctaactgttcacattgtagtagttcagttggtttatggacctccacccatggtgacttgtccttttagaccagtacacctagaatagaaaacgtacactgttttgtttctctccattttcagcttttgttttgttttgcttttaagctaacttgagcttaaattaactaaatgtaaagtgagattcttgttaagtaagcattcgtcagtaatgtcaggtataataagactattaggtcttttcactgccctacatttaattattatagtcgagtatcataatccctaaatttaaaacagctgagtcaactgaggaagaaaatgaagtatctgtgatggtgatttttttcttattattagcttgacaaatgttaaaatatttgtctccgagagttagcatataccagaaattaacgttttcaatattattatgccatgatgatttttaaattcagttcatcagagattaaaactaacgtgtttttaaagacttgtggcttatcttttggagacagaatttttccttttactttaaagagttttctctaaaatgttctgaaatatttactgtaaaacatttagaggacataggtgagccaaaagtataaaactataatccctgtaatctcactacccagtaataatcactgtcaacatcttaatccatttccttccagttgtatggttcataagctttactcatagaattgcttttaggacatattaaaaggagtgtcataggatcgtaaagtcgcagggaactgtaggtcatctgtacaacctcttatccaagaaggagtatcttccataatactgccttaaccgaacatacccaatatctggactctcatatttctcctgtttcaagatacttcctatgtcagaacagacctcttttaagggtggaatgttttttaattcttcaaatattcttcactgagagaaaagccgttctcttgacatttcaacagttgaccatcagaaacaatatctaacatgtttataattttcatatattacaagtcctaattatttggatatgcatttccagtttctacttggttccttcttcgagtaaatgtttccctttcctcttctttgttcctgtatcctctttctggttttgaagccccagaatgcatagcagacattggataggaagagtatcggggaccctccctaatctactaagattatctacagggaaacttctcctatggacccaggagtttctcttcagctcatttacgtaggatataagtccctttagcttttattttccccagaatatcttatggcctagtttggtggaatctagcaggacatttatgacttgacttcttacctttcctcacatcttggttctcacattctgtattggtccattttcatgctgctgataaagacatactggagactgggtaacttataaagaaaaatagggttaatggactcacacagttccatgtggctgaggtggcctcacaatcatggcagaaggtaaaaggcatgacttacatggtggcaggcaaaagagaatgagagccaaatgaaaaggtaaaccccttataaaaccatcagctcttattagacttattcactaccacaagaacagtatgggggaaactgctcccattattcaattacctcccactgggtccctcccacatcacacggtaattatgagagctacaattcaagatgagatttgggtggagacacagccaaaccatatcacattcctaactggaaatactgaagtctgaaggccggtttttttaaaaattatttatttagcctttaattgacaaaattgtatatattcgttgcatacagcatgttttgaaatatgtgtaagttgtggaatagctaaatcaagctaataaacgtgcatgacctcaaatacttatttttctgttataagaacataaaatctactctcttagcaatttttaagtatacattattattaactgtggtaaccatgttgtacgctagacctcttaaatgtattcctcctttctaactgaaattttgtgtgctctgaccagcatctccccgatccttctacccccggcacctggtagccaccattctgctctctacttctgtgagttcaaattttctagattccacatgtaagtgagatcatgcaatatttgtctttatgtgcctggcttattgcccttaacataatattctccaagtttattcgtgttgtcacgaatgacaggattgcattcttttgaaaggctgaagagtattccattgtgtatatgccacattttctttactcgtccatccaatgatagatacctgggttgattccatacctggctattgtgaataatgaaagctaagtgttgtaacctaacttctttttttttttttaagacagagtctctctcagtctcccaggctggagtgcagtggcgcgatctcggctcactgcaagctctgccccctgggttcacggcattctcctgcctcagcctcccgagtagctgggactacaggtgcccgccaccatgcccggctaatttttttgtatttttgtagtagagacggggtttcaccgtgttagccaggatggtcgcgatctcctgacctcgtgatccacccacctcggcctcccaaagtgctgggattacaggtgtgagccaccgtgcccggccaacctaacttcttacacttttttaaaggcatagttgcaagaatattatctttcttttatgtttttattgccttccttcttaatgctcagtttcctctttttcttaacttgcactagtatgttgaagtatcccttccacagatggtgttgtatatactctcgttgcctacaacatccatatcccctgccatcttgctagaagtaacccaaattggggtggtagtttgccaagtaaaatagtttccccataactaggggtggcttcacggtagctgtaaccaaggaagtgtatattgatatctgtgggagttctgggaaaacttagctgacattgcagtgtttggaactgtagcaggaattttgtatctcttagataatacccttgatgatgaaatctagcatgctggagaaggtacagcagaatgatagaaacaactttgttccctgtggtaatactgagtagttgaactaatgtcaacaattccttacctccttactttacattaagtgagaaaaatgaacttgtttgtttgagtcatttttcatgaggtttgcctttatattctgacagatgcaggtggtttaaaaaactgtcaaccatcctggttacccttctctatacaaactccatattgttaatgtccttcttggaatacaaaaatagaataagacactatttattgttagtggctggtacataatgaggcttagtacatatttgtctagagaattaataaatgagccttatttgttcattaagggatcctagatcttgttcttagtatggtgcataattagattatgttggagttttggtcaactaaagcttacagattcccagataagtagatatgttaggggtccctaagaacaccctaatgtttggtgattcactagaaggactcataggactcagaaaagctgttatggttatcgtttattgtagtgaaaaaacagattaaaatcagcaaagggaaaaggtatatgggacaaagttcaggagaaatgaggtacaagcttctgggtgacctcttccagtggacttgcatgggaaaaatgtgtttaattccctaaacaatgatgtgtgacaacatgtacaaagtattggcaaccaggaaaacaacccatgctttggggccagctggggaagccccatgaccctgcatgttttttgcaggtctgtcatgcagccatgtaacacccgtagaactgatcttagcttcttagattgcagtcccccaaagaaaacactgtcattgaccataaatcacattcttagaataaacttacctgatcacagtgagacaggatagcttaaggtcttaggcacagatatgccgtagatctatagaacatacacattggaaaagaatcaaaatcaagtgcatgaaaatattatcaagagctatccctgatccagacatgcgctactagcaaagcttcgaacaatatatatgtccaaaaaagaaagacttgataaattcagtatagtacagtatagtattgtatagcatagtgtactatactatagtaataccatggaagacaatagattaaaatgaataaaccagatctatttgtaaaaacaaacatacaaatacacaaaaaagagctacctctgagtagtgagtaggtgatttatattttattcatcatgctttttataatttttcaaaaattctcgttaaaataaaggacttaaaaaagatcattatgtgtaatgtaggatgatatagagactttatatttacatgaaagacaactctaaaatttaatgtcaaagtttgctaatagaacccctgagagacagcaagctgagtgtttcaggaatggctggttgtttggtctggctatatggcctggccaactggcatgggagcaggctgactctggccataagagggcatgttgaagacacaactgttcagctgtctgtaaatcctattactctgagtggtttcttataatgtaattttaatttcagttttgtaaaagtttcgctcaggattttaccccatttaacctaatttcctttaattacacattcagcttagtcatagtttaatgaagcctactgtgtacctggcactaaatccatccttgtacactgccatttttctctccctcccctgccttttctaggacatgaactatatccaatttaatttatatgcttcctcttcttgctgttcctctgcagtgtgggtttatgcttaaagaaaccctttgctggttcaggattaagagtgtgtgatcattgattaattactaacatctctaaaccatagtatcttcagctataaaatggaggtaattttagtgagaatatcataggcttctgtaatggtgtcacatgttatgtataaaatgttaacaccatgcttggtacacattgtgagtgctggataaaagttatctcttgttgttaatgaaatgaaaccatgtgtgcctgaatatatttttactgaacgtctgtcattaactgtgtagtcatttacatctttttgcagtggctatttctcatacacactagaaatggagagccttgattccctgaatattcttagcctgtaatggcgttcccattttaataatattgccctacaccctttaaaaactattttgaagtgaaaaattaatacttcccaaataacctggacctgaactaattggttgttaagaggaagaagctgtgactgaaagctctttcaaccgcatctgttattctgaatcaagcacttggataaagaccacatttctaagatgattccatgagattgtattctgatggacaaattattgtctgtattcatcagattatttccttggctaagttgaaaggtaaaacaatttaattaaggctagatagaaatcatcccttcaaaaactttactgaccaactgggaccaaagctgcctggtggccagaaataaaatgtcagtgaccggcatcctgccttatggactctgtttctagcatcatccctcagcatctgctctgatctttggctgtaccttctagatccctagccagagaacagagaactttggcttccatgacttttaaggaggaaaatccgagttaaagaacactgatttcacatcagcgccatgaatcctgtgcagcccaagcagtggctgtagtggtggatgtattcaagaaccactggggcttcacattggcagagctttgctgacaaatgggatgtcaggatgataaggatgaagatgtggaagagtcacagatgcctcccacttatttgatgtggttgaatggtgagtggagttgccagctactgagagaggagatgcagggagaggatcaagatttggggaaggctaatgtgttacagacttgttgagtttggggtgactgtgggagacccgaatggggatatccagtggacattgaagtctgaagcttggggagaaatctgggccagagaggtttgggagcatcatcttgttggaaatcactagattacatgacattggccaaagggagcatttcttggtgaatcacactgtgtgtctaatcaaaccacactcttctcttaatgctctgtgtactgtggctgttccataaatatttggtaaaaatgatgaaaaactgattgactcgtggggacaaattgttttcttatttgggctccatagaaacgacaaaacatttttgtggtaggataaagagggcatggtgtgtggttatgagtgatattaagcattgtttacttggtggggagccaaggggatttgtgaatgagtttcagagaaactgaaattagatacagaaatgggtaaaggagccataattttcatcagattctgagtcaggatactttataaaaaaagaactgattgaatcaatgcctgttatcctgaaggcaaataaggggaacaaaaatcacatcagaatatcggagaaagccagaaaaatcgcctaaacaatgagggatcccagttcctgcgggctctgcttttcctccctgtgccagtattgtataagatgggaagaatttggggtcaagagtttcatagtgtggcttggcagaatcaaaggccaaaatatgattaatgcttgatgtggataatcttggaaggataaggaatatagggaggattagggttttttcctaaatctggctactttctaagccagtaggttcactttcttgtacactacagataatgaggcaaagaaggatgctttggggagtattgaacaaaacattcctagttaaagtgggaacagcacctttttttcccccttttttgtctctttattattaagtctgtttattacttaaatctatttatgatttaagtagactttacattttagagcagttttaggttaacagcaaaattgaacagaaggtacagagtttctgtagattctagaccccatacaggcacagcgtcctgcactgttgacacccccccaccagagtggtatgtttgttacaatcagtaaacctacattgacacatcattatcacccaaaatccatagtttacatgagggttcactcttggtgatatacattctatgggtcttgacaaatgtatagtgacatgaatctaccattagagtatcctgcagaatagtttccctgccctaaaaatcctctgtgctctgcctattctctccctaactccttggcaaccaccagtctttctgccctctccattttgcctttttcagagtgtcatgtagttgaaatcatatagtatgtagccttttcagattggcttctttcacttaatagtatgcatttaaggtttcttcatgttttttcatgatttgatagctcatttctttttagatttgaataatattccaatatctggaagtaccacaatttattaattcatctactgaaggaaatcttggttgcttccaagtattggcaattacgaataaagcagttataaaatctgtgtgcagatttttgtgtagacttgatttttcaactcctttaggtaaataccaaggactattatttctggattgtgtaattagagtttacttagttttgaagaactgcaaaactgccctccaagtggctgtaccattttgcagttccaccagcagtgaatgagagttcttgttgctctacatccttgccagtgtttggtgttgtcagtgttctggatgtggccattctgataggtgtctggttgtggtatggtttggctctgtgtccccacccaaatctcatcttgaattgtaatcccccatgtcaggggagggacctggtgggaagtgactggatcatgaaggtagtttcactcatgctgttttcctaatagtgagtgagtctcatgagatctgatagtttaaaagtgtttggcagttaacccctcactctctctccctatccttgctgtggccatgtaagatgtgccttgtttcccctttgccttctgccatgattgtaagtttcttgaggcctcccaaggcatgcagaactgtgagtcaattaacctcttttgtttataaactatccagtctcaagtattctttatagcagtgaaaaaaagcgaaataatacagaaaattgttacaaggaatggggtactgctataaagataacctgaaaatgtggaagcaacgttggaactgggtaatgggcagaggttggaacagtttggagggctcagaagaagacaggaacgtgtgggaaagtttggaatttcctagagacttgttgaatgattttgaccaaaatgctaatagtgacatagacagtgaagtccaggctgagatggtatcagatggagatgaggaacttattgtgaactggagtaaaggtcattcttgcaatgctttagcaaagagactggcagcattttgccctggcgctagagatctgtggaactttgagcttgagagaaatgatttagggcatctggtggaggaaatttctaaggagcagaaatttctaagcagcaaagccttcaagaggtgatctggctatttctaaaatagtatgctcatatgtgttcacaaagagataatctgaaattggatcttctgtttaagagggaagcagaacataaaagtttgaaaaatgtgaagcctgactatgtgatagaaaagaaaaacccattttctggggagaaattcaagccagccgcagaaatttgcataagtaataaggagttgaatgttaattgccaagatgatggggaaaatgtctccagggcatttcagatatcttcaaggcagcccctcctatcacaggcccagaggcctagaagggaaaaatggttctgtgggctgcgcccagggccttgctgctctgtgcagccttgggactgagcatcttacctcccacctgctccagctcaggctgtggcttcagagggtgcaagccccaagccctggcagcttccacatggtgttgggcctgcaggtgtgcagaagctaagagttgaggtctgggaacctccacctagatttcagagtatgtatgcaaacgtctggatgtccaggcagaagtctgctgtggagccctcacggagagcctctgctggggcaatgcggaagggaaatgtggggttggagactgcacatagaatccctctggggtactgtctaatggagctgtgagaagagggacaccatcctccagaccccagaatggtagatccaccaacagcttgcactgtgcacttggaaaagctgcaagcactcaatgccagcccatgaaagcttctgtggtggctgtgccctgcagagcgacagaggtggagatgcctaaggccttcagagcccatatcttgcatcagtgtgccctggatgtgagacatggagtcaaaggagatcattttggagctttaagatttaatgactgccctgctgggttttggactttcgtggggcctgtagcccctttgttttgcccagtttgtcctatttgggatgggagcatctaaccaatgcctgtactttcattgtatcttggaaataactaacttgcttttgattttacaggctcataggcggaagggacttgccttggctcagatgagaccttggtcttggacttttgggttaatgatggaatgagtttagactttgggggactgttgggaaggcatgattgtgttttgaaatatgagagggatacgagatttgggaggggccaagggcagagtgatatggtttggctctgtgtcttcacccaaatctcatcttgaattgtaatcccatgtgttgagggagggacctgatgggaagtgattgaatcatgggggtgatttctcccatgctgttcttgtgatagtgagtgagttcttgtgagatctgatggtttaaaagtgtttggcagttcctttctctttgtctccctcctgctgccttgtaagtcatgccttgcttccccttcattttctgccatcatgagaagtttcctgaggacttcgcagccatgtggaactatgagtcaattaaatctcttttgtttataaattacccagtctcatctattctttatagcagtgtgaaaatagactgatacaagtcatatctcagttttgtttttattttgtgttttcctaatggcataggaagtgaaatatcttttcatatgcttattttccatctgtatatcttctttggaggagcagcatttttaagaagaagtttttgaggcatgaaaacacagtagataggacacaccaagactccagaccaaatacagagtttttaatgaaatttgaaaagccagttttatataaacccttaaaccattcactgcatagaagctaaaaaggattgtgttattgaagattaaaagagaatacaaaagtggatattcttagcaagagccgttcttccccatcccctgcaggatggggttggtgaggcaagagagtatgcacatgcctctcctttccctcaaggccattgagaaggctccaacaggacaaattgttgtggtccccgaagggggagggctcatagaagtacggggtttattccctagctataaatctcctttctggctagctacttcagtgtgcaaagcaaaggagagagtgtgtggcaaaaagatgttgattatttctcaaagacctaatgtaagtctcccatgagcaggagccaggggccactggttttagatggtgtcaaataggttcacctgggtttgaccagctcttgtcagaaaaactggtggtatcattggatctttgggtcatggaaagagttagtggccagctagagaaaagggcctcatttgtatcaagagagctgtcatgaaagaccctgagctatggggaggatgagtaccccagataatccagaaaagtgccttaaatatcaactagacccaggtttcatcagtaccagtcaaatcagatctcttctgcacatcttgtttctcttccctgtgggacttagttccttgaatttttatccaggagcaggagataaattctcccctattaaacacattctaagggggtagtggaggaccaaaataaattacactttgtgagtcctgcttattcagtatgccagctacacattgaaattgtgacccaatgagaaaaacagtttgaagtgtataacgacctacaggaaaaaattcctgatcccatttaatactgagaacatgattttcttttggaaataagttaactgatacgatactattcttcatctgctaacagtgagtagaaatagcccaaattttgcttttcaatggttcgttattagaatattcaagtgaggactattatcttcagggggtgaacagaaaatgccaataaacccctttttgtgtcttgtacacaacacaattgtattggtaggactggaggaggtagaataattgttttttgctaaatcttaggacagaaatcaacagatttaagttgacattggaaatcaagttttcaagaagttactggcattcatgagctcagaatattaatggcaaatgtgctttgggaacctgatactctgtcttccttgtctcctggcagagccttctatttaaagctatttaaatgcatctgttctgattttgaaaggccctgctcaggcctgtgtgcacttggagggctggtgggcagcagtggatcaatggaattgttttggtgtgattccagccaaaacgtgggagaaatcagtttgtttgcttattttgagatttatacaaactcagaaagcatgtctcggtaattcttctgtacagctttagagacagcatctattagaggagcctgtgaaataatgtagatggaggagaaaataaaaatctattctgatgagtggtagaagaaaaaacttctagaagataaataggagaaaaaacacgtgcactttttattagcttacagaactaaaatgatttgcagatggttggctgtttcacataaaacatacttatatacctgagctttttttctgctcacttattttaatagctgaagcatccttctcttgtgaacaatttattctaatggcaataaaaatgcaacagtaccatctcattatgcccaacagcaaatgacttagacggatcttagcttggtttgtagggttaagctccgatggctgcaggaatgacgtcaatagggattcatagttaaatggcacatcttttaaaatgggactctgctttcaagtttctcctcacctatacacaacagaaagcccaggttgaggatgctggaaaatcttagatttcacacaagggctttccaagactgagtaactcttaatggtctacactgtacttggcttacttgcttcctctttttaagcagattgtaagtcatctgtgagttttccatttgggctgtgttgctttttagcttgttttatcttccgtagaagcttctattgatgagggaggcagactgaggactcttggtcccctagaagagagattttactagatattctacaacattattttaagagggtatgggctgaatattcctcccatagttcacactgctgggtccctcctgctggggggcatttgtgaaaggagccacttttccagctaaatctcctaggctttttttttccccctaattaaaagatattgtacaaataatactatatttattacagtggcactctgcgtttaactcaggattattcttctaaaaactctttttaaaaattcttataaacaattgtttataagaatcctgcattttattctgtttatggatttttagaaaatacaaagttgggcgaaaacctgctttcctggttgtatttctcattattttatgataatggctttttcaaaatggctttattctccatttttcacatgtaaagacgtaaaataagtaattctgcccgatttgacagtggtcactggagtaggatataggacagttttggggtgatgcaaatcccagggtagaagtaccttcagcttcatcaacaaggaaaatatcatgcaaaagctcatgagtcagggttgtggttaaccttctgttcttgtccctctaatcaaatatttgtttaaatgaataaaatacccaaggtgtatatcactgatcagttatgttattcttttgtagtacaatttggtattgcccatcagaattttaaatttgcatgtcttttactcagccacttcactaggaatctcacctgcaggaagacttgttgtgaatttgtttgttcattcttctaagacaaagtccacaggtgtctttttagatttaaaatctctacaacccaatttcatatctcaaggtgcgaactcctacctgcctctctaacttcttgtcccccatctcctaccaatgaggccagcaagtccccagaagttcttctaagcttggggtaaaattctatgcagtggtagaagaaaaagaataaaggtaaatttatttttgatgatgttcacctggtatcttgtccattcaagatgctataacaaagtaccataccctgggtggcttatagacatttattctttaaaaagagcagacatttatttctcacagttctggaggctgaacgtctaagatcagggaaccagcgtggtcaggttctgctgagagccctctgccaggttgcagattgctattttctccttgtatctgcacgtggtggaaataggatgagagagagctctctggggtcccttttataagggcactgatcccattcatgagggctccaccatcatgagctaattacctcctagggaccccatctcctgatagtatcactttcagggttaggattttgacaaatgaattttggaaagatacaaaccttcagaccattgaccctaggtttattatgttttaagattttctttcatttactttatctttcttttccctccttatccatatatgtatatgtgtcggaatgtgtgtgtgtgtgtgtgtgcatatatgtgtgcacataggagtatgtatatgcatatacattttcttttggctaaactatttgcaaatgagttgcacatataatgacgcctcactcccaaatcctccagcatgaatctcttaagaatgagacattcctataaatcatcacaagtatcccatccagtactgcttacattcaacaatggagtttattttttctcctcattttgttctaatgtaattgtatttttgaatatgagaaaatacatattttgaacacttacgtggttcaaaagtccaaactatatgtatatatacacatatatatatacacacacatatatccatatatatgtgtatatatatacatatagtatatatgtgtgtgtgtgtatatatatatatatatatatatatatatatatatataaaggtatagccacagaagtattgttcccatcttacccccacccctattcccactcactcctctttttttttttttttttttgagacagaatctcactccgttttccaggctgaagtacagtggtgcgaccttggcttactgcaacctctgccttccaggttcaagcaattctcgtgcctcagcctcccaagtagctgggattacaggcgcccgccaccacgcttggctgatttttgtatttttagtagagatggggtttcaccatgttggccaggctggtcttgaactcctggcctcaagtgatccgcctgcctttgcctcccaaagtgctaggattacaggcatgagccaccatgcctggctcccactcacctgtcttggtagcccttgtcattaccttctggtttaccttacttaacccctgtttctttttgtaaaaatacatgtgtaaagtgtggattcctttcctccttttttttttaattacacaaaaggaccatgttatacacactctttagatgaagctttttattcttattttcttaaaaatacatcctgaaaatcactgtctatcagttcctggagatctttctctaaatgaagactcatttggtgtcaggtaatactctttaagaaatggtatatttgagtcagaaaccagaatcgatgcattattacactttataccgtgatgtgtcactgaaagttttttttttaaataccaattcatttaaatgtttattttcagttagtaataaaacatttttgttctttatttccaaataactttcttgcagatttgtttcatttgcttttcacataattctacatgtgatacagtgtgagtatgcacatatcaaaattttcttggttatcccattttagctgatgaatgaatggaggtacagaatgcatagaagatttatttttttgccaacatccatcagactttcctatgagcattcttctataagcctgcaataacaaatgattttctgtcataagtgatcacacgttctataatttaatattttttccagtataattactatctactaggttcatacgatcttctgtacattacaagtataactgtcattattcctttggcacaatttcaacatgtgggaagagccagagattccaaacttctaattttgcattccctaaatcacaaatgaccttttgtgatgtcagtagacatggagtggagagataaacttcagaatctataagaccttttgcatgttttgattgagacaaatctaaagcattctaaatgggaaattcctttcctgcttttaaaatcataagatacattaaaacatgaacaagtttaccctgttttatattgatgtccctatgattttaatgccactttacacgaacaagatcagagttgtgctttcagagtacagaacagctggtttcctgaactaaaagcaggttggggaatcaggcagggaatggggtgatctaccagttgtcctttccatgctgaaaggaaatttaaggttcctgagcagtgaagttacaaatatagatttaatagatgtccatttctgagtaatacagaaaggagttgtccttggaagaaagtaattttcttccacatttccaaaagaaaatcagtgtattagtctgttctcatgctgctaataaagacatacctgagactgagtaatttataaagaaaagaggtttaatggactcatggttccacatggctggggaagcctcacaatcatggcagaaggcaaaggggaagcaaaggtacgtcttacatggtggcagacaagagggcatgtgtagggaactcccctttataaaaccatcatatctgtgagacttactcactactaccagaatggtatgggggaaaccaccccatgattcaattgtgtccacctggctccacccttgacgcttggggattattacaattcaaggtgagatttgggtgagattttggccaggtcatatcaatcagcaaccccaatttggttcaacaatcatagatgctgttgttgatacacagcaggcttcaagctaggcatgggaatggacattccctactcctaagagtagtccagcaagggctaaattatgcactcaaatttgtatctccatgatactggaaacatgcagggagaaactgctggttgatgaatgggaatttgacaagtcagggtctggttatcagtcgcatgtgctaaacactaaaaattagctaaggatcaagccaacctcagtataaagggcatcgggtagcaacagttgttgggccattgaactatagatgttatatgcatttcttttaaagtcttccaactgttttgaaatggttctcaaagctaaataggcccgggaaataaatgtcctgttctgccaaatttgcattttctttgtgctctgtcagcagttgatgaggtaggaggcaagactcaactccggaggtgggactggggcaccataccaaatttaggaccagctaaaacagggtgggaggtggggaagcagttttctgtaagacacgcagaccgagaatttctgcataagctaccccttaatttgcatgtaattaaaagtgggtataaatatgagtgcagaactgcctctgagaacctactctggacacattgccgatggggtagccctgctctgcaaggagcagtgcctctgctgctgctctgacactgctacttcaataaaagttgctgtctgactcaaccaactctcccttgaattcttttcttggcaaagccaagaacctgcctgggctaagccccaattctggggctcacccgtcctgcatcagttagattgcccttgcttatccatccaggcttctcccttgtttcagtacgtcaagggaacctcacatgagaactcactggaaatacaactggcacagcgttatgtgatggtcaaaggcatcctttttaagaatcattatttcatatggccattttgacaattactgtttttctttgtctggtttgattttgcagttgctctatgtcattgagatatctggtaatacaggctcacccatttttagggtagcctgtacattacacacacacacacacatcccccaacctgccacacatgccaccaaatagaaaagaaggaaaaatatattaactttaagttttgggcctaggctgatgctcatgattaatctcagagtagagtatggatacagagtttgcttgtgagtagggagattaaacagcccagtgggaggcatttctagcctgggaacattcattgtggcccttattgtttgggagcatggaatagtatcctgttgactgctcagcacagtttggcttgctccatgaattatgtgaattgcatcttcatctgacttcattctttttagccgtcttattcattgagttttggataagcagattattacatatctcctttagcataccaaggtaagaccttctaacattttattatgaaggtttattgggattctgtatacacagagaaagaaagaaatgaatcgttctagaggcaaagatcccagattctgcactttctttacaagtggaggtgctgtctccctgccttattgtttctgatccatgggaatctccttagaacaattaggaagacttaagcttatttcttctgactccattctcaatgctcacattggacccgtatttcacaacacacatgtcatgcttattttttatcattggaattcacatcccagatctatctggtaccaattcagataacaaaccttaattgagtattggctctgtgccagacactttactagttctcctaagttaacataagactatcttagaggtggtctgatattttattagcgtatctatttgcttataatttagaaaaggaaattaggagcaatggagtaatgagactgaatgcaccatgagctgaggattcaacatgaacaagacagacaatcccttctggacactacagtctagtgggtgactttgctaaataatcatatagattattattttcttcaattgaatgtcactgtgtctttacttcttacagtttttaatgatttcaccctcaatttccccctttccttaatactggcatataatttattggtttattgatttgtcatcaaaaaattagtttatatttattgaatggatatatctggcatcataatagatgtgctggggacaaaacagatgttgctctttatatgtttgtagcctggttgtgaagataaaatttatagtcatgaaatacatggaattagctaattgtgcaacagagtgtttggttatcaagttaatggcaattcaaaaagtaaaagatgtattagggctgtaaaacctagtgaaactttcttgcagagtggaagagttgagctactctttgaatgttgggtagagttgacatctgcactgaccactatgataactgctagccacaggtggctactgaacatttgagatgtgcctaattagaatcaagatgtaatacacacactggattttcaaaacgtagtatgaaaaaggtaatgtaaaatatcttcttaatatttttatcttgattacatattaaaattatagcatgcatgtgttatattaaatgatacatattataattcaatttacccttttacacttttaaaatattgtttctaggacagatgcagtgactcacgcctgtaatcccagcactttgggaggctgaggcaggcggattacctgaggtcaggagtttgagaccattctggccaacatggtgaaaccccatttctgctggaaatacagaagttatggccaggcacggtggctcatgcctgtaatcccagcactttgggaggctgaggcgggtagatcacctgaggtcaggagttcgacaccagcctggccaacatggtgaaaccccatctctactaaaaatacaaaagtcagccaggcatggtggcgggcgcctgtaatcccagctagtcaggaggctgaggcaggagaaatgcttgaatccgggatgcagaggttgcagtgagctgagatggcgccattgcactccagcctaggtgacatagcgagactctgtctccaaaaaaaacaaaaattagctgggtgtggtggcaggcacctgtaattccagctacttgggaggctgaggcaggagaatcacttgaacctatgaggtggaagttgcagtgagctgagatcacgtcactgcactccagcctgggctacagagcgagaccctgtctcaaaaacaaaacaaaaaaaattgcttctagaaaacttaaaattacatatgggtctcacattctttgctcacatcatatttctattggatagatacatatgcagacaagatggggcattgaaaattaattgggtggaggggcacataaggtaggggagagtgcatagaggcctgtggtgtggggatgtaatcacaaaacaaattgaaagtcaggaagaagaagctttttgagcacatcgtagttgacacaccaatatttaaaagccaggtggatatttccagcagggccatggttgagcagaatacccatgtccttgattcagaggtgagacctgggtcagaggtatggatttcggagatgtgatttttgcagttaaagttctggagtgcatttgaggttgcccgaggagaggtgccttggagtagacctatagtgctcctggtttgtgagctccttcccaggaagtttgcatctgcatacctgtgccttcttgttctgcttatgtttgcaatcttggggataccccctaagtgtttagagaaaatgaagaaaactgattacctcttgggaaaatttccctttcatcttagcagacaactgagctggtgtctggggagccacgcttagcagctgtgggtgtgaagagcaggagtccgtgacagatgaacgaagggaccagtgtgcagcagtgcaaggtgtgaagcagtttcattgtgcactgattactgacttgtctgagtctggtgagacaggacacccccacacacaagttacttgaagcagtttattagttagagagaggcagccaggaatggcagatgcctgggattcattgtgagctggttgctccagaaaggggcctgggctgaatagagtctcatctgcacacactccacttccactgctgctcagggaccttggaaagcagcctgcccttgattttataccccagggtcattgggcctgctgggctaaagcactgaaggacatcctgtttccagagggagaccagaaagagtccgggatattctggccagtccctccttgcctcaggatggtgtatccccagcacatcctacagttattcttgtcaactactagtaaagaaggggatagaactaagtccacggttacctggaggattgtcctttgctgggggaacttgaagtcggcaacatgagtgataccacctgcaggcatggttagtttcctgacctgggctgtctagcactgcagaaagatgagagtggggatgatcccagaaaggatgtaggtggcagatcctgaaattgggaaacatcctccactggcattctaatttcccatttacatgaaaggatactagaagctcttcttttcctaaatcaacaatagactatcttaggagtgctctaatatttcattaactgatctattaccttataatttacaaagggaaatcaggagcaatggagtaatgagatcaaaagccctccgtggagttaatagaccatagctttgaagggtgaaaccaagaacattttgaacaatgatgctttatttggaatgcacaaagccttccaaggtaaactcctttgaaggacaaaattcattttgatgtttatgttctggaatgtacattaaaattcatcctaattacttaattgacatacctcattaacaagaataaagtgataatagttaacattcatcaaacacttcatacaggtcctgggtagtaaggaggtgctctcagtatgcctctttctgtacctaggtatttaaccaggagcattttgcttaacctcactgttcctcagtctcctcatctataaaatggggacaaaaatggtaccttgtttgtagaaatgtattggccactgtcaatagagaaaaaccacaaggcaagtctcaatcattttagaaggtttatttgccaaagttaaggacatgtgcccaggagacaggtctatgcctctctccaaaggtgattttgagggctccaaatttaaagtggaaagggtgggatattgagaagtatacaattttcatgtaagaggtgggtagggaaaaatattcatttatttgtttggctcaaatggagcagaggaaaaatgcagggaatctacatttttacataagataacagaggaaacaggataggggaacaactggatatgcatttgtgtttggtgggcacgggggtgactgcacctgtaaagataagctatcaatttacattgccatggtgaaatcttagggtgaaagcagaaacaccttagggtaaagatcttgccaggtcactaggaatttctttgtgggcaaaatatgggggaggcttgtagcgtttcatcttgtagccatgttatttaggaaccaaaaaggggaggcaggtttatgtgaccctgttccaagcttgaattttccctttggtttaatttagatttaagatttaatttcctttcacatcactaaacaagctaatacatgaggcatagcatattctacacatagcatagaataattcccatcacaaagtaggagttcaacaaatgttggtcattcatttgtggaacacgtacagttggcctctttggaaagaggagaaaagtatatcttggagaagtgaagtcagaagctggcagatgagttgtagcactagcatcaacccaagcatagccagaatctcaagcttgtgactgaaaccaccttgatttagtaaattacatcacgtgggccaaatcctgccccttgcctttctttgtaaggccagggagctaaaaatgtttctttgcatgaacattaaaatcctattgatgagaggaaacactaattttgaatctccattaaggaaaatgttatcccctcaccaaaaaatattcacatctctcattagtcaacttgtaattacaagcaattgtagtcaattattattgtatttgaattttatgaatacaaatgtaagaacttgttttctctcttgttatataagtagctacataatatccttgattctgactccaggcccacaaagactaaaatgctttctggctctttcaaaaagtttttgcatgatgccactctaaccaccctgcatattgcctccatttctgttagatgctagggtggtccctatggagaaccttttgaaactagaaatctggccattgcagttggggtgcaggggacagaaactggatagccaaggtgggtggaaggggatgcttagaaacgtaggcctgcaggcagtcatggtactgctgcatgcaaggtacctgcagagatttgggtagaaacctgagcccagcagaaacttctgtacaaaaaggctttagatagtatgttgctgaagacctcttgtgctagagaatattggctaactatgttgaaatactaacattctcccaggttacacttttctttccacctctcaggggtgcactaaataaaaatatccttgaagaatgtaagcctagaaacttggcaggacttttcgaaagcaactttaagtatttttattttcccttgaaggaggcttggaaaactcatttatatcactaagctgttgggagatagctggtggctggaatgaaaatcatgtcacaaatggcttctgggacatatttaacaggctcaggtagctgagatggtgtgattggtagctgagatggtgtgatgggtgacaaggaaccatggagattttgattgttgccaaataaaaataggccaaaggatagacttctggaaggcgctgttgggaaggtgctattgaggcacccaaaacttaggcctgaaaagagccaaggagaactgcaggctgtgtcatcttcttttcttccacagatgcaaagatggggactctgagaactcgggtcatctcttgccaagctgctgaatagccagaggtagacccaggttctttgcaaacttccttatttacatagccatcaaactgctttaaacctttgtatttctaaaactgacttaacaagttaaaacaagttcagatctctttgtggcaacccaagttctcccaaactcttggctgaaaatgccttgctcattccgggactgcccaaaggtaatgagacctctgtcatctcatccctcacttgatcctgactccagtgtgagtcctgactccactgggccatgggcctgcccactcgccttatttctgacctcccctttggagcagctgaaacagttcaagacttgacttaaacagtagcatatgaacaaatgttgaaatctaaatctgggcttttggccatgcaaaacagggtgggagttattattttttgccaatttgaagtaaatgaaaatccactttttttggattgggcgaatgaggcaaaaaacctcctattaggaagatccttccttttgcccctcattgtttgtgttgtactcagccctgccacagaattgtcatgttacaacatgacaagggctttattagagaaatcactgcctgtgtaggcccctgttggtttgtgcccatgggtttgtgttctttacatgtcccttgctttctcagaacgtgtacttgacccggagcatctacgttgccatggaactcctttactttagctgttaggcagcaacgtttgaatagttcccctttcaaggcagaaagcctctgttctgtgcaaagttctttctacaaagaattggaacactgcattatttctgcataattatccaactggtagtcacactgggggtctgtagtgtatttattatgtgggatattatcaagagcaagaattttcctctttcagacttgcaagggattgttagcaggcccaagaggaaaccagtccctggcgtctcgcagtgtgccttcatggcagcatggagatggacactcctggttgggactcctgtggatctttattcatttatttaaatacttttaactgtttttgatatgggataaacctttagaaatttataaaacatattaaggaattttttccaaaaaatccattttatgcctcttcattttttctgtatctggaagtggtgttacatttttgtgtatatctgtttctgaatatgtgtgtggatacagtgcttttgatctatctctgcttctgtcataggctgacactgggagaagctcgcaagtccaatttactcttgacttatgtctctaggaaacacccttctttcttgtaaagagtccctttccttccattctcctctgtcgtcttgttcttatatggtcttgtgtatttcatggttttggaggaatttataaacatgaaacaatgcatcccgttttccaaagggaagaatgattactacttacatttgttgaaggtcttcttttcaggcactctgacatacagattgtttagtttgatgttcacaaaagtttgtgagccattaataacagtaatcaccattttttcaggctatactacactatgctatacattgtcttagaggagttttgtcagatattcagtttaatttcatcatttatcatctcatttgatgaatgccattggccacttcttcctgtcctggtagaaatacttttatcctctggtccatgacacaacagtctcctggtcttgcctctgcctgtcttgtggctcatactcctctgtgccagtcactgaccactggacacccttttcttctcatgccatcatctctcccttgacaaactcacctgttctcatgtctttcaggaaggctacaaattggtctcattgactcacacatttgtatccatggcctagatttccccaatgggttttatcctcatatactcaagatatcagtctcatcctggccatttcagagacagtctcatcctggccctttcagagacaactcactcagtacatcctaaatcagactcatatttttctcctctgtatctggccttcaggccctgggctattgcagccaccttctgcctgatccacccatctccactcttgcctcccacagttcattttccacactgtggcaggcatgatattttcaaacgcagatctgactgtgacgtctttttatttaaaactcatcaccgatcttaggataagtaccataatgatcaaaacaatcaatcctggccaggtacgatggctcacgcctataatcccagcactttgggaggctgaggtgggaagatcacgaggtcaagagatggagaccatcctggccaacatggtgaaaccttatctctactaaaaatacaaaaattagccaggcgtgatggcacgcacctatagtcccagctactcaggaggctgaggcaggagaatcgctagaaccctggaggtggaggttgcagtgagccaagatcgtgccactgcactccagcctggcgacagagtaagactccatgtcaaaaaaaaaaaacaaaaaaaaacccaaccaaacaaaaacccccaaaaaacaaaataatcaagcctgacccacatagccctgctcatttggaccccagccctcttgtccagcttcattgcctatcgtggtttcccttctctctgcaacaccctggcccacttgtcttatttaccatatgccttctctcctaggagtctttgcaaatgatctgctctttgtcgagaatgctttttctcttccctctttaccttgttggcctctacttagattccctcttaaatttaatgttaagtcattacctcttgaatatgtgcgtattgtatcttcaacttctccagttgcttacccaagttgtaattttacatttattcttaggattaatttattcattaaggcttatatcttctactcgaccagaagctccatgaaggtagggatactatcgggaatttctaaccagtgttttcctactatctagctagtgcttcataaatagcaggcactcagtaggtcttcattaacaaatgaataaatctctgttttacagatgagcaagctgaggcttaaagaagttcacttaacactcaggtttcttagacatgcattgtttagttgtaaatataaaaaatccaaagcaaaggaaaaaaaaaggtacacagggtaattatgcagaatgcaagggtaggaattatagctaagccttacaaaggacttgaaccaagacgaaaaatctctcagtcacctggagggaggcttagtgggtttctttctgtcctttccctctgctcctgttcttcagctctttctcttcctcagtgggtgggactctcatctttgtttctttatgtttgtcttcacaattctgcttggttgaaatggccttaaagcccaattactttcaaaggagccactgatccaagagtcaccaggaaaagtgcagaaaagttatcgtctgattcaattcctgggggagagagagaattggcttgatattgcctctgaatcatttctgcctattaggtgtccatcccagacccactccatatccagtctgccctgagggggccagagcctcctggttcccatcttgagaatggatttgttgaggtggtaggcgtgggtgagccgccatccctgaggcatattctgtctcaaggtcatggggttcttaggtggcagagctggaatgggaagtccatggtctttatatccttcctcactctatatctccccaattcaagcagatccctgtctaattcactggtgaacattgaagtccccagtaaaacttgtgcttcgatttagaacagtcgtaactaccaactgtaaacactccttatttgccagtcattctaaatgtatttaaatgctttctgtcattagacctcaaaacagcccagtgaagtgtaggtacttttctgtttttatatcccttttgtcagatgagaaaacccagaataaaagaaagataatttgctgaaaaaatttggctaactctaaacattgtagttgcaaataaagtgtcagccttgcctgagagttctttacaaagggagagcctcaggccccacctgagaacaggtgggtcagaatcagcatttctaccagacctccagctgatccatctgcatattcaaggtggaagagcactgggttagaattcctgggatcagattctaattgtgatctgagtgagactgtcatggggaagatgtttgacatcataacgtcccctttcactcatctgtaggaaggtgatacagaggaatatgaacaaatgcatgtaaaagtatctggtgcctagcaggtgttcttaaaggggaagttgagtcagtaaagcacatttagagaaaaagtcagagtcacgctgtgaaatatgtaagtccttggtgaaaatgagtattgttttagcttaaatatgactcaaagcaattggacagcataggcatttcaaaatatattctcctgtattcttgcttgtgagggtgtcagactctggaatattgacaacagaatgttttccattcatccaaatttaacttatagtaaataaactttccactggttcttctgaaagttaaacacacaaactcacacatgtgtgcacgcacagacacacagacagacagacagacacacacaccccccacagaacatccagttaaaggaaaaataccagtttcttacttccggtacagaggcctctcatgtttcttagaaatcaaaggcctgtgttgtaggcctggccatacagcaaaagcacagctgtctaatagtgtgggtgtgtgggaagcaggcatcaaagccagtaactgtggaacaggtgggatcactttggttacaagccgtagttgggctcgcagtctttaacacagtggggcttttctggggaccttacccggcatcctgggttgggcagtggcagcacagttgttgcctggctgaaggtgtatgtccctccatgattttcttggctttgccccttagacacagttgctgtcacacaattgtgttcaggagagagtcaggaaaggaaattttataccctttttttcaagaagaaaatattgttccccaaaccctgcacctccattctcctttgtcccattgcagtcctctggttaggtctgtcacagtcttaagataagagctatcttctggtacctgacaaaattggggattggttagtggagaagggtagatgagatagatagatagatagatagatagatagatagataggtgatagatgaaagatagacacagcagtgcccacagaaagggagattccttcatacttgatataatctctaggcattttagtcagggttctccagagaaacaaccagtaggatccatctatctatctgtcatctatctgtcatctgtctatcatctatctatctatctatctatctatctatctatctatctatcatctatcagtctatcatctacttatcatctattatctatcattatcttcatctgtttattatctatcatctatctatctacctatctatctatctatattgatccatcaattgacatatagaaggagctttactctgaggtattggcttatgtgactgtggaggctgggaagtctcacagtctgccatctgggagttggaggccccggaaagctggccgtgtaagtcaaaggcctgagaaccaggagtcctaatggtgtaactcccagtccaagggcaggagaagacgtgtgtctgagcccaagcagccaggcatagagtgagaattcaattcagtcttctgccttttgttcatttcaggccctcccccagttggatggcacccacccacatgaggagggtcatctgctttactcagtcaccaattcaaatgctgatcttttccaggaacaccctcacagacatgcccagaaataaagttttaccagttatctgggcgtcccgtggtccagtcaagttgaccatagaattaaccataacacgaggtttgggatgaatcccaaatagcagaacagaaaggataattaatgctgtatttactactgtcataacatacatatatgggagtactcagaacagaattaatactttatatttaattcaatcaatttttagactcctcttcatcttctatttgcatgactgtgccaatctctcaataaatcatcagctgagaatattggcgttttttgactgtggcaaataaaaaaggaagtaaggtatatttattaacctggttttggaactttctctgatcttgatgatatcaaggaacagccactatcttttttgtttagagctagagtttaagtggtgttttaaagccagaaccaatcatcaaggtgagaagtgactaaagaagccagattgtggttttttttgaaggagtcttgctctgtctcccaggctggagtgcggtggcgcgatctcggctcactgcaagctccgcttcctgggttcacgccattctcctgtctcagcctccccagtagctgggactacaggtgtccaccaccacgcctggctaatttttttgtatttttagtagagacggggtttcaccatgttagccaggatggtctccatctcttgacctcgtgatcccccagccttggcctctcaaagtgctgggattacaggcgtgagccactgcgcccggcggagccagattgttaattcaacctgaaatacattcaggcacaaggaccttgtgtttattaggctttattggccttgctgctaagccctacaaaaatgttaaatacagaagtgagactgtaatattataattaataaatgtttaattaagagtctccaaactgtatccttaactcatcatggagtaacatttgtatataattatatttaaagtgagccgtgcatcattttaatgtgatatcctatggcataaggcttctaaaagtaagatgtgtaaggctaatgaagatgttacaatgaccccattacactgtttcataaaaaagagccttattttacttgatattagctgctccattagtgctttggacataagagttgtttagcctgcttcgtgaagggtaaggaggcctgaagactgcagagataaatgaaggaaagttgccagagagccttgtatttcagcctagtggagcaggctcttgggattgctcttcctgttggatcaatggaaacccagggacccctgaggggtgagatgacttcctggtggtcaggcagtgggagagaactggagtcctcctcagttctcactgctctctgaccacctggtgaaaagtgcttgtatttaattgtgctatgaatagattatcataaaaatcttaatgtgacacaaattgtgtgatttcacttataggaattacctaaaataggcaaattcatagagacaaaaagtagatccaagttgccaggggctaagtggagggggagaaggaaagttattggtttacggatatagagcttctgtttggggtgacggcaaattttggaaatggtggtgatcttgcataattttgtgaatgtaatgaataccactggattctacacataaaaatggctagaatcacatgttttgttatatatattttaccaaaatttttaaaaagaaagaaatacaaaggaaaagaaatcacagtggaatattttactcagtgatgatcttattaacagcaccatgcacggtttgcagggccttagctgttctcctttggagccagagaggattaggttgatttttcctttgctttccaagaggattaatcttcacttcccttttctttaacacagaaagaatcatcactcaagcccaatttctctttcaaaccttagagcacagggcatggattctggcccatgcctgtcatttattgctgctgggccaaggggagccagccaaaggaatcacacaggtgccaggccacatttgactctaaatggcatatatggtttctgagtacccagctcactgttcccaagggatttactttggaaataggcagttctctacctctagattcaaaaataaacctgaggttcctaaataaactggagctgcgcttcaaaatccaagcaatggcaacttcttgtaggtgaggccacatatgaagccttttgggtatttgaaattaaacccacattgtatagtgtccaagtaagattcattttatagagaattattttctcctctcatactgaggttgcttgtctattctatggagtctcatacatgaatcaaatttgtgtgtgcccatgaaagcatccagagttctggcagttgtcatggtaagccaggagcatgcactctgtagctgggctgttagtgtcaaatcccgggtgctttctgtgggagccatgtgatctccacaaggtacttaactcgtcgtgggtcatgacaggaatcaaatgaattaatacaagtaatgtaccaaagacggtgcctggcagagagtaagtacacaatcaatatgaaccattcattattactgctaacagtagtagtatgtttgtttgtttagacactgtataagaagcaagttgcattttggggagaagaatgcacaggaacataaaagatggaaactaaggacatatcaggaagacatgaagcattttctagagactgtcgagaggagacacatgtctgaaataactggaaactcttcaaccaattccattcagtttaatctaaagtcagattgtgaaagagttatggtcccattcagataacataaccatttgaagcctaagagtcatggagctcacaatgaaaaataataatgtgatagaatctcacaactgtgtgcatatttatggatgtgcacatgtatctgtgtgagtgtgtgttttgtttaaaaaggtccctgaacgtgtagtataatttccttatattacatttaaatttataaatggagaaatggcatcagagaaccgacgtgacttgccccgagtattattctctaaaaacgatcctaaaatctcttatagaagaccattttcactattctgtggactggttttccacatgttcgatgaacaagggacaaaaaaagttattttgccaagttcctaataggtgagaatatacctaatatttgataaagcaaaacatctgtaaaacaaacaaaaaagaagacaaagattagtggagttagggcaaagatttgtagcatgtgtgtaattgctttggcaataaaacgcctggaggcatgattgattacgcattgatgttaagagtcagaatcagtactgaatagtgtaatgcaaggcaccatttagcaacgcacattaagttttatgtgtttctttttactttgcttgggaatgaactatctctacttgtgaattcatgcagaatccagttacacgcaatcactttcattgtttgaaggtatccctggcacctacacttacggcatgattgttaggtacatgcctcaacactagcattataagcacattgaaggcatcttacaaatatttgtaccttcccttggacctagacaatatcttgcatattgtttttactcagtaatactttgtgaatgcataatgaatgaacatgcagtaaacaaactttgagaacagattgatccatacagttataggcagttgatccttaatagcatctacccaaatgaccttaataatacttaatatttcttcttgtctgtgctgattcctcttgaccttactgattctgcttaagtagggtgagatttcttttaaaaatgctataatagttagttaaaatgcttatcttgataattgacagtagccagtgagccataagttaaaaaatacataaatcaagtgatgcttggaaaccagttccctcaaccactgcaaaaaggaggaagcattcagaactacaaatggttccaaattgaccagcctcctgggctcccaacagctcatgcatgtgtctctgtctcagagttctttcctaggtgctgaattaatctcttttcaggtgcaacttcccgaccagataatggactccttaagtgaattatgaaattcagaagcatgtttattacacatgtcaggtatgagcaataataataaaatgcaaaactgtatgcccgtgacccagcttaaagaatggaatgttagcagtctctttcaacttccctctgttcttctgcaatttcatattaccagtctctttcaacttccctctgttcttctgcaatttcattgtccccgctgggatgtctccatcatgattttgttgtgctcattccagttttgctacttacatatgtattataatattaatgttgcaggtttggagtctaatgcaaattgactcatactgtcttctttttggttatcaaagaatttcatatatatttaaggtgtacaatgtgatgttttattatatgtgtatacatactgtagtcattactagggtcaagtaaattaacatatccatcatctcacatgtttccgttttttgtggaaagaatttctaaagcaaagagttttaaagtaaagagttaagagatctaaggagttctgaagtaaagagtttcttagcagtttctttatataatacaatattattaactgtagtccacatactgtggttagatctctagacttcatctgctataactgcatctttgtacctcttgacctctatctattccttcttcctccacttttgttaaccatgtttctactctgtgttgctatgtattattatttttaagattccacatgtaagtgagatcatgcagtatttgtctttctctgtatgggttatttcatttaaataatgtcctctggattcatacatgttgttgcaaatgtcaggatctccttttttaaggctgaatcgtattccgttgtataaatgcataccacatctttatgcattcatccgctgatggatatttaggttgtttccatatcttggctattgtcaataatgctgcaatgaacataggaatgcaaatatctttactacgaggtgatttcatttcctttggatatatacccagcagggactactgtgtcatgtagtagtcctatttctaatttctttaggaatcaccatgcatttttttttacagtggctgcaccaatctgtattcccatcaagactgtacagaggttccttttacttctcaccctcaccaacacttatacctttttgataacagccatcctaacaggcatgagatggtatctcattgcagttttgatttgcatttgactgatcacaaaaaatcccaagtagccaaaacaaccttgagaaagaaaaataaagttggaggcatcacatttcttgatttcaaattatattacaaagcaaaagtaatcaaaacagtatggtactagcataaaagcacatacataagccaatggaatataatagagcctagaaataaatccaagcctaaccagtcaactaatcttggataaggccaccaagataatgcagataagaatagtctcttcaataaatggtacagggaaaactggatattaacctgcaaaagaatgaatctgggccttatcttacaccatacgtcagttcagaatggattaaagacttaagatgtgaaaatgtaacattcttagaataaaatataggggaaaatctccttgatattggctccagcaatgatttcatggatatgactcccaaagcacaggcaataaaaggaagaataaacagtgaggttacatcaaactaaaaagctgtgcacaccaaaggaagcagtcaacaaaaggagaagacagccaatggaatgggagaaaatatttgcagacattatatcagataaaggattgatatccaaaatatataaggaacttatgtaactcaatggcaaaaagaaacctgtttataaaatcagcaagtgacctaaacaaacatttgtccaaagaaaacagaaaaatggccaacaggtatatgaaaaggtgctcaatatcatgatgtattattttatacctcacttttttttagttggcattatattcatgagaattgcccatgttgcagcctgtagctatagttctttcattttcattacttttcttgctcgtctgtctgcttccctccctatatctctctccctcagtttctctctccatcccttcttctgctcctcccttcctctctccattcatccctttcccctcctccttccctctttctttcacacatatttattgcattctttccatgtgccagacactgttctaggttctgaggacagacacagcagtaaataaaacaaggtgaaaatccctgccttaatgggacttaagttccaggtggagacacagatgttaaacaaaattattacaatattcatacattagccattatgaattgttatgcagaaaggaagagtgaaaagggattaggggagcctggtatacagagatggctttcaacattagaaaggatggttggggaaaatatagcagaacttacttatcttttcttctgctgatagacacttagttgtttccttctggggctataatgaacaatgcttccatatgtcttctgctggaaaggtgcagaagtatctctgaggtgtatgttcctaggagtggaatttttgaatttcttagaaaaaggcaagttgtttttcagtgataatgatttattcctctttgcatcttcagtacttagtatagtgcttggcaccaagttgggctaacacttgcttgagcaagtggaactttgttgtagaaacgagaatagaggctggcactccatacctacttcatcacgttaattgcgctctgctatttaaacgttgaccttgcatggaaagcagagaccagactttcctttattttctgtgcgaaagttctcttaggaaatgccttctgacatttgttgagttcatgctggctgcaaccactggggctgctaaagcgtctttcacagtagaggaacactggaggtagagtctagctgtttattgcaagtatttctcactctcctgtttgaaacaatcctcaaggaagccgagttctctttagaggatgtcatccctccttccttctctgctcctggctcctaatgcttgcctaaagagtttgctctttccagcttcctctatggagtcagaagtctccacttgaacttgcccctttgaaagttcctgttgggctgatgttttggcaagcagaatgttgcacttaaaattgatccttccttgcttgtagaaaatgcatctaaggtacttagggaattatttggggttgggaaggcttgatgcctcataaaatgaagctctgggctgaaatactgttgaaatatgtcaagctccagagttgtgcctttactttctaaatatttcaaaaaaaaatgggtgcttatatccagtcactttgtgtatgagtgtctcaccaggttttcagtgtccagcctcagcatttaaaataaattcatgtcttatgaagcccttttatcgttggaaaccattcttcctggttcacacatgtaacagatgatttgtgaatgtgttttctgcagtcctttctggtatatactgaaccatttggttaccagctaagtttattaaaaattaggatagaatattcttcctatcaaagggctctggagtgtctattatgagattcctgtctatttccctttctcctccattattaaaaaattcataatttacattggtgtcatattaatgcaaaacaacaggttttatgatttttgccattttagtatagtcattcttacattttgtttccagcttttaaaaataatttttgccatcagttgagtgaataggacaattatgatgtcagtaatatctgtgtgtgtgtgtgtgtgtgtgtgtgtgtgtgtgtgtatgtgtatacaatatgtttagtcaaccccattctagattttctcaaacaagacagtaaaactaaatggcagtgttcatgggatttattgagtaaatatattttaagtagatatacacgcccaatattagcaatagcaggaaatgaaaaaggagtaaaaaagaaaaaagaaaccaacaaaaccttggactgcagttcagtaaagaaagaaaatcttatttattatttaactgctctgtgatttcagtttcttcttctctccttttagtttgaatctggtccagtatcccggatgccaaatgactttcaggaaggtttccgacactaaatctacagaaatccatttagccagagttgtgtgtatggatatacaattttgtgcacaatatgcctgaaatacattcaaaatgttatgaggtttgctattttggctcctgcgctaatgatgcacagcactgatattaaaagctccactaacagttatgtggtttttattttaaaataaataaaacattttaaatctttcagctagtaaaaatgctacaatgtatttgtgtctttttttaatataaagataaggttttagaatagtaaataaaaccaaacatttataggtgttttcaatatgctgctattaaaataatagtaataaaagtagattttcctgttttagaaagaaaaaggcatatgatcattcccactaaaatgaatggcagttggctgcattttcctgtcttgctgatacaatttttccatgccataaaaatatgattagcttgtgcttaaaaaaagtttgtcaagtctccatgaagaaaatatccattgaaatctagactgtttctaacataacaccatgtttttacagtaaaaatgtgaggaaaggaaatactcaaatgaacggaaaccttcatcctcattcagccaaactaactcatggttgggttctaagtatttgttaaaggagtaaagagaaaatggggtctttgttagagaccctctaggtcatgttgtattagtcaggttctctggagaaacagaaccaataggagatgtatgtctataaaataatatataataaaactaggatatatataatcctctatatatttattcttaattataatctttatatatataaattaataattgtgccaacttcttacaataaatcttgctctctctctatatatatgtatatatattgcacaattatggaggctaagtcccaatatctacagtcagcaagcctgaaacccgggagagctggtagttttagttgaaaggccaacaggcttgagacccaggaaaagccaatgtttcagttcaagtgtgaaggcatgaaagaactggtgtctcagtttcagatagtcaagcaagaggagtttcttttactaacaggaagctcagtctttttcttctattccggccttcaactaattggatgagggtgacccatatgagggaggacaatctactttactcagtctactgattcaaatgtgaatcttatccaaaaacatcctcacaggaacatccatataatgtctgaccaaacctcagggcactccatggcccaacatgtgacataaaatgaatcatcacacgtgtaaaactttcctttttttttaaggataggaagaataaaatatagatggcaggagattaatgacatttacaggagtctgtcttggaaaattcacatctcttctatgtcctgtattgaaaatagataaaagatggaggaaaatgctttagagattagacacttttaggttttagagagagaagagggtggggttcaagcttgctattgtcttgaaagacaatttggatgggcataggactgaaattgagtgggctttccccggcctgtgctccgctgccttttttattggagcttaagtagtaaaactggacaacctgcctttcaattataagttgagttggcagagaagcgctgtcttcttctgttttatttaggcaaaccaacttaagaataccaaacaatagttgattaattttccccaaggatgtctgtaaagcatttaattcagttcagtcaacttgagtaactaccatgtgcagtgcactgagctaggcgtgattgcaggggacatgactcagagcagacactgggagaaaaggaccttgtcttttttaatgcgaaaatgaattttggggcctaaactccatttccaacatcataaattacacatttcatacaagaagcaactttttgagaagcatattttatcgcaaatgaataaataatactaaaagcatttggaaaagcaaatgattacttttctgcaacctttgaaagattcagatggcacagacttcttaacctgagttgtgtgaaatgcagggtcctacattgtatttaatgcctttctggacctatttatggtgacttgccttcctgttggggacttgcaaatcacttttgaaataaaatgttgcatttgtacctgtagaaagattgtcagtgaaggtttattgcagagctatttattcctcccagttagacagtgagtcacacaggattctttcaatgggggatctgagagaacaatcacttttgtcaaagggatgtgcatctactactgctcatctgcttcatatgatcttaccacactcataacaattctggacctgttgcaccaggagggcaacaacatcctgaattttaactcttctagcagctcatcagcatcatttgctggagtttttttcctatagaccaaaagatgtttttagacatatttcattcatatttgggcaaaccacctaattttcctggcccctgtttcctgatgtgtaagatgaagggagttattttagtactcattaacttcccttccaatcctatgctatgattttacagataattaatgacagctgtacttctagatttctacttaggtcataaattttagcaatataaaaagatatttgttttttcttccaagctgtaaagtagaatattaaatatttttgaaattttgcgtttctctccctttattcttcttcacagtgaaacagtgtgagttgaattaataattggaagagtgggtgtctgcttgcacatcagcattcagtgaccgttacttgggaatctagataattttcactgagaaccttttgcccttaagtctgtctctttcttcttttttttatatatatatattttttattatactttaagttttagggtacatgtggacaacgtgtgggttagttacatacgtatacatgtgccatgttggtgtgctgcacccattaactcatcatttaacattaggtatatctcctaatgctatccctcccccctcaccccaccccacaacaggccctggtgtgtgatgttccccttcctgtgtccatgtgttctcattgttcagttcccacctatgagtgagaacatacagtgtttggttttttgtccttgcgatagtttgctgggaatgatggtttccagcttcatccatgtccctacaaaagacatatactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctggccagtgatgatgagcattttttcatgtgtcttttggctgcataaatgtcttcttttgagaagtgtctgttcatatcctttgcccactttttgatggggtttttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttcaggtctaacatttaagtctttaatccatcttgaattaatttttgtataaggtgtaaggaagggatccagtttcagttttctacatatggctagccagttttcccagcaccatttattaaatagggaatcctttccccatttcttgtttttctcaggtttgtcaaagatcagatggttgttgatatgtggcattatttctgagggctctgttctgttccattggtctatatctctgttttggtaccagtaccctgctgtttttgttactatagccttgtagtatagtttgaagtcaggtagcgtgatgcctccagctttgttcttttggcttaggattgacttggcaatgcaggctcttttttgattccatataaactttaaagtagttttttctaattctgtgaagaaagtcattggtagcttgatggggatggcattgaatctataaattactttgggcagtatggccattttcacaatattgattcttcctacctatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgtccattcagtatgatattggttgtgggtttgtcatagatagctctttttattttagatatgtcccatcaatacctaatttattgagagtttttagcatgaagcgttgttgaattttttcaaaggccttttctgcatctattgagataatcgtatggtttttgtcgttggttctgtttgtatgctggactacatttattgatttgcatatgttgaaccagccttgcatcccagggatgaagcccacttgatcatggtggataagttttttgatgtgctgctggattcggtttgccagtattttattgaggatttttgcatcaatgttcatcagggatattggtctaaaattctctttttttgttgtgtctctgccaggctttggtatcaggatggtgctggcctcataaaatgagttagggaggattccctctttttctattgactggaatagtttcagaaggaatggtaccagctcctccttgtacctctggtagaattcggctgtgaatccatctggtcctggactttttttggttggtaagctattaattcttgcctcaatttcagagcctgttattggtctattcagagattcagcttcttcctggtttagtcttgggagggtgtatttgtcgaggaatttatccatttcttctagattttctagtttatttgcatagaggtgtttatagtattctctgatcgtagtttgtatttctgtggggtcagtggtgatatcccctttatcactttttattgcgtctatttgattcttctctcttttcttccttttcttctttattagtcttgctgtctctttcttcttattgttagaattgtgcttttctgctgaatatacaacgagcaagtctaagataaaggaggtggccagggtctgtgactgttcagctctatgcaaggtacagacctgagccacctcatcctgtagcagcccgtgtgtgtgccagcattaacagaagtaccttccagggtggtttcctgcagctccacacacggctcggcctggacttgggagaccagttgcccctcagctgactgaactgtgtgtgctggttcctcttctggtttataactgtgctttaatttttatgaattgaaactgtgtctcatgcctgtaatcccagcactttgggaggccagggcaggcagatcacctgaggtcgggagttcgagaccaggctgaccaacatggagaaaccccatctctactaaaaatacaaaattagcagggtgtggtggcacatgcctgtaatcccagctactccggaggctgaggcaggagaattgtttgaacctgggaggcagagtttgcagtgagctgagatcatgccattgcactccagcctgggcaacagagcaagattctgtctttaaaaaaaaaaaaaaaaaagaaaaaagaaactttaaaatgtcaatgtttgagcagctaaacatccttgttctacaagtggattctgaaatcataagacctaaccatgagtttgactctgccacttaagtcaatggcctctaactttttttcttttctaaacaatgccgcctcactagcagtatagaaactgtgataaatggcctcagttagtcatccttcctttaaaattatactagcaacaatgaaaggggcttttgttgggaatctccaaaaacttctaaaccttgaccctccagggtcctgggaaaatgaagagatgtaggatgtgaaaagatgaaggtgtttgctttaagatagtcaggtggaaatagggttagagaaagtgatttgaacccagtggcttttcctctttacaaatgtgtaaactaaaatgatttgaccaggtgagagacattttcttgggaaatattttcccaagaaaatatcactgtttaatgaatttaaatcactgtttaaattcatatgagttggtagcctggcattgttaagcagatgacatttcgacagagttgctgtgggtgggtctggagttgccctgggtccacctcaatgccataagggaagagtgcttggaggcttttgggtgaggtattgtcagtcactggtggacatgtgccttctccatggtgcttgctcccattgcagaagggttcagccgtgccgtcgcagatgccagtgccctcagggagggcagataaagtgactgcgtgcatcatctggggtagtggtggggtggttcagactgtggcaaactagcccacacatgccccatctcttacccggttatgaacacacagaattagcccagaattatcagagcttccaggttccgatttttcaagcaggtctattaatctgtattcatatgtgaaatatctaacctttaaatatttaattttgtaaaagacatccactgggcttaaccaaaaatgtctgtaagtcaccaggtttttgactttgggtatcagagctcctgggtctatccaaaagccatgaacatttactatctgagtatatttggcatagtcatttaatcttcctgaggcttagtttttatttttcagagttgaaataatgatacttgctctagaaaattataaggataaagtcagagagggaaaatggaaatgatttgtaattgcaaagtcttttggtggtttaaaatgttacatgcaaggataaatcatgctcaggtatggaggagctttagcagaaacatccatctggtttctgctaaaaaaaaaaaaaaaaaaaaaaatcttgttcagggttcttgtcacatactttacagatgtgttccactggccgaaaggtgtactgccctcaaatgtgcagcaacccacctaactcctccactgaaatatcaagctgaggctgctcaccagcagctcctgtcatctttgactttgaaaaagcaggttgtgtctagattgtggaccagcaggcgtaagggcctgtgtgtgcctccatgtgggaatttagagccatggctccagttctgggctttgatggggtggagatgggcccatgtcatgctggttttctattgtggaacattgactcagaaagcaggttgcttaaagaaggattaggaagaggacctggaggctgcaacctatagtctgtcttctcccttcatgcccttgtccaagcagcgtaaaccacaaactctcccactgccccatacacccccaagataccagtatatatacctcaccctttgtgactgcttttccacagttaaaggaagacctctcttgatttatgttgaaccaggtttacccctgtaagcgtagaatttttctttgttgggaggagaatcaggaaggttttcagggaatatgtctcactctggattttagagaagccctgccagatcccaaactcatcaggcaaggttaatcacctccccttcccccaaaattgtgtcctgcagtatctggacacatctctgtgatttcacttttttgtttactgcaggtgtttgtcatccataatagactaaaatcttcaaagggagacagtacaaatgttatttatttttaattctgcggcccagtaagcagctcaataaatgctggtgcagttgcactgagagatgctgagccttccatgtctttgagtctcaggagaatgtagagtgtctacaaaagcatgtgcattcctgtttagagaactagagagaggaggaggcaaggaatattacagcacaaagtttcaaagaatcttgccaataagatggtcaaaccagctcaaaaaaatagatttttcccttttttagtgaacttttgaatcaaaaggaaatgataggtttagtttggtaaaataaaagaagggggaagctataacaagtctttttaatgatggtgatgttggccgaagaagggatttttatgggaggcatcactcagttttacaaaggaaggcagtgtagaagtcacagtttggaattttctttgtcttcctcaggaaaaaagatgttcttgttaagcagtgacttctgccaatgtcaagcagatagtttctgttgttagggaatgctcgggtcacttaatcagatactctgcttcagccaatcagtactcaggagtaatgtcagtgtgccttggatctctgcagagcatgaatgtgaggtcatcggtacaaattaatagtttatcacgaggtccttgacttgtactatcataaatgtagatgattgttaatgaacatctgtaccacttccgtcagcaaccccactgaaaacaaaaaaggtaatagctggaaacttctgagtcatataaacataaagctgatatatagaactgagcattgttcttacattcagtatattgctgagccagaacaaaacccctaagttcttcttacttaactctttaagacttctgagtggaattcattttcccagaagtcctttggtagctttctattgtctatacctgtcattattattaattcaaagccattacaaatatccagcagctcttacaggtgcaaaatctgtaataatatatgttttctaaaattcagaaatactttatgaatgaataaactctgccatctccagaatggtttatcatataacagttttgacttaaaaataaactttaatgcctccactgtaaaagtgcagatagataaaatatgctttaacaatagaaatgcttattaagcaataatttaccaggttctataaaataactcgggttcaacctaatattcagtgtaagagaaagatattttttaggatgaaataaatgcaaatcctagcagactttggatatgtacttcattattttatgtagaaatttacagatagtaggtgcaaatatttctgcactattgaaattagattaagactaaaaataaaccatttttaaacattcataaacagtgaagaactgaaataagccagtagcttcgttattcatgggtatactggacatttatacatgaatatagctctgtttgcttcaaggtaacatttcactctatgctggtatttaatatgtaatggagagagtgagagagtaagcctgcccgtgtgaggtgcttgtaagcctgtattgagtattacccttgggctttgggctggagcgttctggtagctaccaaccttaggtcatttgctttaaatgaaatactagtgcttgttgatgtaggaattggaattatggaaagtaagaaaacaacataaaaatgaaattgatctattggaagcaggatgggtcctcaactagttgctcatatctcttagccattctgacttgaaatctttgtagtcattttcgattcttggcattagttctcaaccagtgcagttttgcctcccaggggacatctggttatccggagacattttttgttttcacaattgtgggagaaaaagtggggagtgctgctggcatctggcatctagtgagtagaagtcagggatgatgttaaacatcctaaaatacacaggacagcatccacaacaaagaatcatccggtctgaaatgttacagctgggagtccctggatcagaaaaagctagctccaagaaatcacattttgtttctttcaacctgaattacagagtagtccaggtttgtctttaacttattctgccatggagatgtgttttcatataaacttgtctctttttgtggacttatttatttacttttatcatttgtgtttgcttgctttgtttttttcctgtaaatgtgaaacagatctagagtttgattctttgacgagcgcaacagggaattgaaaatcacacaaacaagagtgttttcttggttgtttttggttataatagctttctgtttttagtgatcagaaaagacagatccctttgagttctgttgtgttagaggcataaatggatggccattttattttagattagatgttcccattctggtggcttcatattataagtctgtgataataagtgagtgttcctttactttaaaacatgtttttgtttctttgtgcttggtttttggactgcttagcagaacatttcagttggcaactgtagctttttcttacatcttatacttcaactattttcaaactggcatgcaataacataagcagaatgaaatgtattaagtgtgtgtttatgtctattgggaaatatggtgtaatctgtagctacttattcctttttgttttagcacaatatgcctgtctcattgtacactgttctaggagcaaataactagtttccacaaagaacaaggaacctatcaacatagaggtaaattattggcaattgacattcctggccttcaaaaatacattctccattccctgctttagtctgcactgtgtttttttgtgtttgatttatatttgtaaatggtaagtgagtttagtgattcattaaataatgtcaaaagtaatggttgccagagaatctcattctttttttttttttttttttttttttttgagatggagttttgctcttgttgcccaggctggagtgcaatggcgtgatcttggctcactgcaacctccacctcctgggttcaagcaattctcctgcctcagcttcctgagtatctgggattacaggcatgagccaccatgcccagctaattttttgtagttttagtagaggcggggtttctccatgttggtctggctaatctcaaactcctgacctcaggtgatccacccgccttggcctcccaaactgctgggattacgggcatgagccactgtgcctggctgagaatctcattcttaatgtatctattttagcattaggctgggtttatcctgaagcactttcccagaatatgaagggaggtgccttatgaatctgaaaaaagttttgtagtagaatgataatattcaagtagctagagtttattaatgagcaagaagctatatctttggaaagtaagaataatatttatgttgttactgctcagcatatggcaaaattcaccaagcaaagaagcagtggatattaaaggtttgcttaacttaatggctggtgtggatcactgacattgaagatacctttaaaaagattgatttttttttttggtccttaataacttgatgaaaccataaagtttagatgaggtagttggccgcctgaggtttgggtcattagcttgaatgatcattcccaggtgtttatacatctcattacaacagtcatccaccatttttctgctactctgattatctgtttatctgtctgtctttcccattattttgtagctgctctaagagaggaggcattttctgatcatctttgtatcctgggcattccctaacacagtggtgtgaatatagcaaagattaaaatttttttaaagtaaaagctgagttgaattgaaagaaaatagtatcaattattttgccataaaggctttattaaacatgaagattccagtgtcctgagattttatgtgaaatcttctgagaagcagcctggataacaatgcgtcctaggagcctggcttcattttaaactgcctaccatgaaatgacttctgacaggcgtggttcactctttacggtccggtgactagctgtgtcccttcctgagaactctgggtcagcgtggcctctgacaatgtcatccacgtcctcgtggcgttaattatctacaccatggtatctgggttcttcagagattggcctctattgtccccaggggcaggggggcatttattttcttccccatgtgagtgtgagcttcctgtgagtgccactgtcttatcagagaagtcaggtaattatggaaagtgtctatgtgacagagagtgaccgctttctatttagctagctgcattgcatcatcgttcgttgcagcttctggaagggatatgttctgggggacacaatcatttttaagtaaattaaaatatattctagttgtttttgttctgattcctataatgaatcattactatgtaatgcattttgtgtgtgtgtgtgtgtgtgtgtgtgtgtgtgtgtgtgtgtgtctatttatagattaaggaggccttgaggtctaaagataccttttgatcaaatttgtgttctaaagttgttaagaaaaatgaacccagagggtctggataaatattttgcaaatgtagtccattgtatttgtctgccactgtccgtctccaaggaactctgccttcctgctttaatctgtggtcatgtttcatccaaaccccatacattataaaaataatcataggttattggggttgatgtccatgtttcctacctgtaattatacccttgttatcttgtttgttatgaaaagattgttgcatattgcagattgacatggagctgttcttctgcagcacctgtgggctttgttctttggattctgggtccttgtttatgggatgtgtggtcatggatgtaacacgggaacacagggctatgcaggtgtttcccttggctgataggaaggctgcagttcgtccacagaaatatagatgttaactggccatcacccataacataaaatgcttctttattatactgggaaagtgcctagagacattcttgggagaatagagaaatttctgcaactttctgccaaaaacaatcttatacaaaagagatgagtggagaacagtatgtagttcatgttttgaaataacgaatgtatttcttgagatgagacatagcaatgtattgaaaaaaaaatcccctttcggcaacaattaggatgtcgctcccaagagagagagacatgatctcaaagaaaaacagtggtgcttgtatcatggcaccaaacagcaaaaagacattgggagtctgacagataagccttgtggttttgtatcaaactggtggattttgaaacttctgaatttccttagagaaagtctcaacacactaacccatagatatggcctcaggtgtggttctggaacgtgagtgcactaagtgtctgcatcatccagtgtgtttagtattggatccctcatgagattttcatgaccccccgtgatgctacaagggatccaaaacactttcataacttgagcaggaaatagcccaatcaccatgtgtttaaaaggaaagttgacacaattccagtccattctgaagcaaacacaggtgtactaattctgcaaaataaaaatgttaaacttctcctgtctcatcccatagccctccaaaataaaaaagtttggtggctaaattaactcgagatggaatatctttggattggataagtgtttatatatggttttgtcatccatgacatggaacattttgatgaaaaataaattattggactgttttagtctttcatggattccaagtgagcctgcatgtttgccatcaaatagatacatgtagatatacagcctttgccaacctgcattgctttttagtggatattaatgtgctatttgggtgagatttaacagtgtcacgttctttaactttcatctttccagatctcttggactcagtgcctttagacttacaggttcctaaacacaggtgggaggttgacaaggtaagggaggaaagcggtgctgtttcttaccttcatggaaacacgtaggaagaggttttctaccttcttgcttatgtgtaaccacatttaagacttactcccccaggctgtttttggccatagacagtgtgggaagtggatttctggaggggaatttgaatgtattactgttgggctctgtgaataattggcatcctagagggacctgggacgccagatgctgcttctcccacaggccataatttgtccatgagtatgtggctttagaatatagtccataattccttatccagaaaatcagtatgtctgagatgaaataatgaaagttacgaaacacagatgcttccctcaactaaacaatattgctttacaaaagtgcaagaaatcatctttccaaataagatgattctggtctgtttatcattgtgtggcagcatgttctagttacttttgccacattccagacaaccttaaaagttagtgacttaagcaacagccattgttttatgatctctttcagttcttgtgggtcaagaatgtgggaaggtcttggtggagtggatctggggccagtcagtggctggagctgagaatggcagaactggacaggaccagctttccctctcttttgtcctccctgtctctctcttcctagggtgtcaggcctctctgtgtggtctttctgcatgggctacttgggcttcctcacagaattactgtctcagggcagccaagctgcttacatggcaggagaagctttcaagagttgcttattccagggaagcagcattggcttttatgacagcctgggaggtcatgcagtgttacttctgggcattttattggttccactagactgaatgtttgtgtccccccaattcatgtgtttaagctctaacccccaagaggataataataggaggtggggtctttgggaggtaattagcgttaaaaaagttcatgcgagtgtagcccccatgatggaatcagtgtccttatgaggagaccagagctcccctctctctgccatgtgaggatacagcaagaagatgggcctctgtaaaccaggaggagggctctcactaagaacctaaccctactggcaccctgatctttaacttccaacctccagcactacaagaaataaatgtttgttgtttaagccccccagtctatggtattttgttatagcccaagtgaaataaagaggcaagttagaagtgagtgaggaggctgcctggatccagggaggagaatcagactccctctctggatgggggcatggcaaggtctaggggccatgtgatcgtgtgtggtcatctttggtcaatatgccatacactggtttataattacctaaaaacagagttttagtctctgttcctggataagcaaaccaagaagccactctcttttagtctttaaacaaatcttgcactatttgactcctttcttttgtaacaggcagatccacaagccatgcttgcctgggagaaaatatcaaaggcaacatgaaaattaacctctgggtccgggagtgctgaaggtgccagaacaggaagggaggtggtgagcctgaagatctcacaagcttccctcctggtgtgtgtttccagaccgtcaagggtcctggctgctcatggtctatctcagttgcccaggtgagcagagtcatgggcctggagactatcccagcgacactggttgatgcatggctggaaggggcatggaagacagaaggttggaatcctgtgatccactcttagctagccgggtgacccagcagaggcctctctctagatccagggattaggagttacgccaacaccagtcatggttgataggttccagtacctggggacagatgctgctagctggtgagcggagcccacttgcttccttacatataattgaggtcacacttaaatgggcatcatatttgaacagttcacaaaagtcatattggaagccagttcaatatattgatccattttacctcgaagcctactgagtaccacattaggcatgtcaaatatcatttttaatgatcagatcagcaattctcctactggcagatttattggctattctttattatgtcattaaaaaaaatcaacttatttcaaattaaaccctttcccaggaacttgaaaatgcatgaaagactaaattcagataaccactggctgatgcccaccgcccatcctccatctccccacccctcacccccgggctgtgccacagtcaggccagtcctgcttagcctggtgctgccgccatacagtgctactaatgttggctagtgggaccctccacttttcctctgtgatgtgttcagcatgctgcctttcagagagaaaacagccgttagggtcaactggaaccatagcaatgggggaaaattgtagcagattttgctcgttttatggaatcttctgtctttgctctggaaagttctcccagaattgaaacacttaagtcctactcagcagactgtcctgatgcagctgcaagattctcagactttggtcttataagttagactctcttgtcttttggtctgtctccttctttccctctttccctctgcttgtttatgtgcttgcgcaagcattagtgggtgccacacagttgtgtgtgaatttgtgtggtggggaatatggatgagaggtgggaaagcaagctagtttctgtcagatacccggctccctcccagaagtccagaccttgcaatctggacatggtcttgctctgaccatactctttgagctaaaatacattccagatagatgatttctttttttgaaacaggatcgcattctgtgtcccaggctggagtgcagtggcatgatcttagctcattgcaacctccatctcccaggttcaggcgatcctcctgcctcagcctcccaagtagctgggattacaggcatgtgccaccatgcctggctaattttttgtgtttttagtagagatggggctttgccacgttggccaggctggtctcaaactcctgacctcaagtgatccacccacctcagcctcccagagtgctgggattacaggtgtgaggcaccacacccagcccaaatagatgaaaggttgaaatgcatgcactgaaaattgaagaggtactagaagaacataagcagagacttttttctactctggataagagaaatcggcttaatattaggatatgctgaatcataggaagcgatggatcaatttgatcttctctgttcttgtatgatggaaaaaaggaaagagaaatctcctatatgttcatacaagggtaactacatatatgccactccatacctgtggagttatcccatctgtgacctcttttcattcagcagtttcatagacaacattgccatgccaatgagagcatcaggacttcctcgagatgtcagtgacagtttacttgaccaattccatgttattcttcctcatttcttcactcatataaatgattagataaacagctttgagtataacacctttagaatgtgtgcagtttcttaggttaaattctgggaagtcttaggtgaaagactctgctgcgtttacattcaatacatgatgtgcaattgcccttcatttccatactactagaggctaccaagtgcttgagccccctcaccctactaatgaagtttcagtcaatctttccaaatcttttatagtctgactaacaaaacaatttccttttatattaatcattatcatcatcgagacagaatattggtgactcacctaatcctctccttggctcatgtttttttttttttttgtggggatgttgtattagtctattttcatactgctataaagaacttccctgagactgggtaatttacaaaggaaagaggtttaattaattcacacttcagtatggctggagaggcctcagaaaacttacagtcatggcagaaggggaagcaggcatgtcttacatggtggcaggtgagagagagcaggggaaactgccacttataaaaacatcagatcttacgagaactcactcattatcacaagaacaacatgggggaaactgcccacatgatccagtcacctcccagcaggtctctccctcgacacctggggattacaatttgagatgagatttggatggggacacagaaccaaaccatatcattctgctcctggcccctcccaaatctctttccaacattcccccaaagtcttaacccatgtcagcattaattcaaaagtccacaatccaaagtctcatctgagagaaggaaagtgccttctacctgtgagctggtaaaataaaacacaaattagttccttccaagatacaatgggggtgcaggcattgggtaaacatactggttacaaatgggagaaattggccaaaacaaaggggctgtggtccccatgcaagtccaaaatccagcaggggagtcattaaatcttaaagctccaaaatgatctcctttgactgtatgtctcacatctagggcatgcttatgcaaggggtgggctcccacggccttggacagctgcttcacaggctgtcgttgagtgcctgcagcatttcctggcacatgatgcaagctgttggtggatctaccattctgggctctggaggatgatggtcctcttctcacggctccactaggcagtgccccagtggggactctgtgtgggggttctgactccacattttcttcagactgccctagcagaggttctccataagggcttcacccctacagcaaacttctctctggacatccaggcatttccaaacatcctctgaaatctaagaggatgatcccaaacctcacttcttggcttctctgcacccacaggctcagtattgtgtggaagtcgacaaggcctggggcttgcactctctgaagcagtggctcgagctgtaccttgaccccttttaaccgcagctggagctggagtggctgggatgcagggcaccaaatcttggggctgcacagagcagctgggccctgggcctggtccacaaaataatgttttcctcctagtcctccaggcctgtgatgggagggactgcggtgaaagtccttgacctgctctggagacattttccccattgtctgggaggttaatatttgactccttgttacttatgaatttctcttccagaaaatgggtttttcttttctaccacatggccaggctgcaaattttccaaacttttatgctctgcttcccttttaaccataagttccaatttcagaccatttctctcaagttcaaagttccacagatctctagggcaggggcaaagtgccaccagtctctttgctgaagcatagcaagtgtgacctttgctctagtttccagtaaactctcatcttcatctgagaccacctcagcctggacttcattgtctacatcactatcagcattttggtcaaaaccattcaagtctctagcaagttccacagatgaccacatctttctttctctttctgggctctccaaactgttcaaaccctctgcccattacccaatttcaaagctgcttccacattttcaggttacctttataaaagtaccccactcctggtaccagtttactgtattagtccattttcacactgctataaagaaattccctgagactgggtaatttacaaaggaaagagtttcaattgactcacacttcggtatggctgtagaggcctcaggaaacttacagtcatggtggaagggtaagcaggcatgtcttacatggcagcaggcaggagagagcaggggaaactgccaatcacatactattacaaattagttgtgtggagttgttaacacaggtgcagcaaagcttcaattggtatccctttcaactactctgctgcctggtactgcaaataatttatgatttataatttataattaattattaagaattaaaatttctgttaacttctccttaacttaaaatgcagatctgtttaagcagtgcagtttgggagatagaaggattgctctctgtgaagtctgagagcctccaacacattctataagaaggggacacatttgtaatttgcattagatgaaaggaaagacagaaatgtacactgagaccaaaccatgaacctaattgtaatgcatggttactcattgtccatgcttgtagggagagatgaatccaattaaatgagtcatataaaagataagatttagaaatgatgacaaataagagtcatgtttgttccagggatagaagagctacctacttacatggaaaattcatcaccttaacacacctcaaaggtattttgcagagcaaagagaatgaaccgttcaaaattaaaagttaaatttcaaaagtgccaacagtcatcgttagctaactcactttactataaacatagtagtttaaataacattttcaatcacatttttctttggggttttagtagagaagctcatgattgtatgcctgagctatgtttataggaagaagggaaatttatactcatttttcttctatccaaggctcagataccattaactctaactccatcaagttgctagctgtgcctaatgaatcctgatgccttgttaaaagtgatatagttttatgttagagttgtatcatattaaatattttttcagacccattggtatgcattacacatgagcatgtatcttattaaacgcaaatcaaattcttgttcaaggctggtcacacaaatgtgatcttgtttttaattgttaaatgccagtgaatggctattcctggaggaagcttccctttggcttattttaaagtagatgatgtaaaaatgattaacttaggaatcaagaaaatatgtgaaactacaaggcctggagccagtctccttagtgagagcccaataagcccttaaaaatatgtgctgtcattgcaaagctcatttttccaagttgggctccaatatttggctaagaactttcttttctttccatgtttgctctacacagaatctggggggtattaagattgatgagggaatcagagcttgaggtttgggagccagcgttagcacttctgggtgatgacaaatcatgtcttaactccctcccttttaaaaagtttctcccctcccctcccctcccccctcccccttgtcttctttctctctctctcccccctcacctccccctccacctccctctccatctctctctttctccctctctgtttctcttcccctccctttctcaatctctttctcaatatctcttgccccctccttttctttcccaaagcacaaagtgatgggttggaatggaaacatataactttcatgaagtgttccctactttaacctctgggtggaaagctgaaaacaaggttattacttttggacactttaccaagaagctatgatggagaaacctcttattactacccctggttgaaccagatctctagctcatgtttcaaaaaactactcagaattccatctaaagtgaaaacaatgaagaattgtctacagtccagggatagcaccattacacatattgaatttactttctaaataactgagtcttgcagctctcaatctaaactacacatagaagtcaggctaaactgtcaaatcagttcatgactgtaaatcatcctggtaaaaacactttaaaaatttcatgaagagagctatctggagaattttaatagaatagagaccgtttaaattttctttttagtcatttatctggttaacgtttacacctgagaataggttgccaagacagacctttagggagatttcgagaggtatctcaagttctatctgtttctctccatctccacagtcattacctgtgccaagccaccatcatctcccactgcaatggcttctttcacctccctgatatttccttctgaacctcagtggcccgttcattactcagcagctagcttcatctttcataactaaaacctgccatttgtcctgctggaaaatccgcctgtgacttctacattcatatggactacagacacaatctctgttgctccttttgggtcttgcatgattcatctcttcccagtatctccccacttactggaatgcacctggctgatgctaagatcagggcctttttgtatttcaaatccttggcctagaatgggcttgcttcttcactctgcagggctgactccttctcattccttaggtctcagcccaaaggtccacaactcagcaaagccttttactatgacccctttatctaaggaggcctctctttcattgagtagtatcctatgcattttctccaggcaccaggcaggatttgaaattccatgtttatttatttttgtttcctaattatgtactctgtgtctctgaaggtgggaatccggtttcctttgctcattattgcaaacctcagcttgggcattgtgtctgagacagagtatgtgtagttatcgttcaagagtcctgtgagttatgtatgagtcttgtcccccttttatagatgaagaaactaaggtacctcaaatttaaataattttcttagggtcccaaagctattaagagatgaaaacactatttgttttaacatagattggatgaaacaatgaatgaattgatgaatgtatttttattcatccagcatgtgccctctagagataatagttttaaagattaaaaaagaaaatcttaaaatgggtcaaataaaagaaaaagtcattaaataggatatttttctagctaaggtgaaggctcttcacatcctttaatttctccatccccagctgtttagcatatgtttttgtttttcaaactttttttttggttgttgttcctaaaaactctctgaattctgggatccttgacaaaacctcactgttatgccaggttgaaactcagccacccttatttgctcattttgcatcagatttaatgtccagcagaggcaaaactgaggtcactgaggtaaaactagacttttactttacagcattatgtctggtgtacagttgaatccaaagatttattgctcaatggtggtagattgtggagacactgtctggtgatttatttactgtcagaactgaatggtcatgtttttaacatgaatgctgttattcccaaaataagctatcactctgaaatattttaggctgattttactgcacattgtaaattactgatgtgtaaatcagtgacttcactcatcacacagagaaactgtggcacatggcaaaagctatgttgtaattttttttttttttttttgagatggagtttcgctcttcattgtccaggctggagtgcagtggcacgatctcgggtcactgcaacctctgcctcccaggttcaagcgattctcctgtctcagcctcctgagtagctggggttacaggctcccaccaccacgtctggctaatttttgtatttttagtagagacagggtttcagcatgttggctaggctggtctcaaactcctgacctcaagggatctgcccaccttggcttcccaaagtgctgggattataggcgtgagccaccgcgcccggccgccatgttgtaattttgactcattaacaggttgtatgaaatcgggatatttgtatttaactttcttcccaattgtaatgtgtatctctgacttctctagatgatctgtttccatgcaggttatggtaaaattattaaactatgagtttttgaaggtctatacaattagatccttactttgttcaaactgtgaagattttaatccaacctctttctttttttaaaactcaacttatttttgtgttccttctaacacagctaatctgttttctttatgtagaaatcagtgagctactgtggatcacagaagcccttttcctgagaaatttcagatgatttcttgttgttgtaactaatagaatgacgtacaaagtatgctaactgagaaagaaaggtggatatacaagaggaagaatagcgagaaactccatgctcctgacccagcgtctagtaactttgggtattagtaagcaaaccatttgttgtctgtatttctgcctggacactgtggatgcagtgaggggtacatcatgctgtatatttgatatggtttggatttctgtccccgcccaaatctcatgttgatttgtaatccccaatgttggaggaggagacttgtgggggatgattgaatctcgggggtggatttcccccggcttttctcatgatagtgagttcttacaagatctggttgtttaaaagtatgtagtgcctcctcctcctctctcttcctccttctccagccaggcaagttgtgcctgcttcccctttgtcttcggccgtgattgtaagtttcccgaggcttccccggctatgcttcctatacagcctgcagaactgtaaacccactaaacctcttttctttataaactacccagcttcaagtatttctttatagtagtgcgagaagggactaatacagtatttgtgcataaaaagtcttgatgaattgcatgatttatttttctattcttcaaatcagaagaaaaggctttggaagttattatcttaagaagcttaaaagagagggtaccttggtggggtaacatcaggccatgcattgatgtttttgttttctggattcccctgttggttttccaatccagccatggcatagccagcgtgtcctcaatgtcatcatcagaggtgatgatgcacaaatgagattcaggcagtggctgtggaacactatgggtccacatgcttcagtggcttctccatctgctctgcagctcatgaatgttgctgtgaataattgccttcacttgatcctctgtgtttctaaaaacaatgaaggttgggacttcattcaccatcccatgttcctaccatgttttttcttaaaagaatgatctttgttttcaatctctcttaagatatctttgaccttgggagtaaatggtgttaggaagatatgcttggaagagggaagtgggagagagaagagctatggagtaatggacagactgggccacgtttactcctctgaacacttgagaaaatcatcctaggtgccacctggaatttatctgctgcctcatctgtccaatcacaaattccttgtgtttctactggatttacatctcttggatttattgatttattttcaaccatcattgctacctccataacagctttctaaccagactcgctgcctctacttttactacctccagtcccttctctaagcttgacctagctttctgcaatctgatatgccagtctgcttgttataatccttcaaagattcctcactgctctctggatagagttcaagttccctaccatggtctgcaagacttcaagtttcacctctacctcccacctcctttttctcttttatctgtcttctctagccctagtaaataatctgtggttgttgaatgctcaatgttcccttttgcttctgggcctctcattctccttgggatgcccattttctattgtgtaactttccagaccaccttattgcccccaatcaggtctgagcaacttgcctttatttatagccactgtagtggtgattacagtgatcagattagtcctcccctggactgtggatgtgttgagaggcgttgagagcagagatgatgccactgttaggttcccagctcctaagtcctgctcgataaagcaggaactagatcaatataaattactgagtcacatagctttattggggaaaatgcttctagttaacctaaaagttgtattattattttatgttctgtctctttttcctttctatttttataggatgaagaattctttataaagaaggcagatttttagttgtgtaaataacaagtctaggaccacaaggaccacagcttgccctttttattcccatagtatttcataaattcaggtctgcatctcctcagacttgaatgattacaattccattttgcccatgggtggtagcagattgtgacagtttttcattaagagtggagaatttaggccaggcgcagtggctcacacctgtaatcccagcactttgggaggccgaggcgggtggatcacgaggtcaggagatggagaccatcctggctaacatggtgaaactctgtctctactaaaaatacaaaaagttagctgggcatggtggcgggcgcctgtagtcccagctactcgggaggctgaggcaggagaatggtgtgaatccgggaggtggagcttgcagtgagctgtgatcgcaccactgcactccagcctgggcaacagagtgagactctgtctcaaaaaaaaaaaaaaagactggagaattttaccatggggctaggcattcaagtagaaattgcaccttataaaatgaaaataatattcttgttaaaggtttgggcacctaggaaggctgagggtaaatggaaggcctaggaccaaagcccgagtcgagaagtggcagcttccatttttctcccacaattggcagggacaggagctcaaataacatcagtcccctctgccccagatcttgtgatgtgagtcttgaaatttgtgaggaataaggttggcctcttattatttatttatttacttttgagatggagtcttgctctgtcaccaggctggagtgcagtgtcacgatcttggctcactgcaacctccacctcccgggttcaagcgattcttctgcctcagcctcctgagtagctaggactacaggcacgcaccaccacacccagctaattctttgtatttttagtagagatggggtttcaccatgttggccaggatggtcttgatctcttgaccttgtgatccgcccgccttggcctcctgaagttctgggattacaggtgtgagccaccgtgcccgaggttggccacatctttagccatctggctactgtggtaggagggtcactctaaatcccactacactgaagcatctcagagacacataataacctttgagctgaacaagtctacattggacacctactgtgttcatgctctgaggaaatgaggctcagagaacttaagtctcttacctgcaaaattctagaacgtggcctaggatttaggccttctatctgtccatcctctgccccagttttatattcttcacccacaaacttgataggtcatctgtttaacttttgatggaacagcagcagcatggagatgagttttggagtgagatgcacctggctctgggatacagttgcccagggatcatgggcaatttaagttcctgcgctccagttctctcaccttgaaaatagagagcttagcccataagctcattgtgaagatttaatgtcagattatatatataaagtgccaactacacagcttgacgccatcacaaatattcttttttttctatagagtgcctgacacctacactattttgcagtttaagttcaggctttccattttaaatgtgagtactgctgacagcctcatggaaatgttgtgccatttgtccctaagtgtgttttataataacggatttgaagaccgggcttatcagagggaggagaagatttgtatacacatctagtccggacctttagtttttggagttgtttgttttctgtataaatttaaaatggaaaattatgctcctaacctttaggtcacacagagaaaagaagttttattagtgagaggtcattatttgaagtgtataatggatagtctgtttacctcagattttagcctcgagctaaaattttgtttgtacttgtaaatgaatagcaaaaagagtagtgatgaaagacagagtccaggataagatgcgtatcacacacaagggaagtatgatcagctgtaggctgctgtatggttaggcatttggttgaatactgggaaatacttaaggcgaggcagtaaaacgattctcctgatagagtaccagtcctagaaaacatttgaaattttagagcctttaaagtgaaaagtggacagactgaagccagttagctttacagggatcagctggtgaatatttgcttgacattttgttccctgcgtgccccttcctccctctcacttcctctggattgtttctgctagttgcctctcctttagaaataagcaggcctgggcagggtgcagtggctcacacctataatcccaacactttgggaggccgaggcaggtggatcacctgaggtcaggagttcaagacctgcctggccaacattgtgagactccagctctactaaaaatacaaaaattagccaggtgtggtggtgggtacctgtaatcccagcttctagggaggctgaggcaggagaattgcttgaacccaggaggcggaggctagagtgatctgagatcgccccactgcactctagtctgggcgacagaggtagactccatctcaaaaaagaaataagcaggccttagtctttctctgcttggtgtggaattctcattaagtttgctggtgcaaagatttagattagcacttaatagctgattttcctagcttttataaaaagctaaatagtttaagagatagacataaaaatgtacaggttttttgttttaaatttgtttaatttgtgtaacaaatattttttatccctttttggagttggtgaatttgttctctttttgctgaatatatgctatttctctgtgctaattggcaactcactatggatggcactatatactccagagaaaaattcagtgtatgtaactacgtcttgggcactatccaatgaaatttagttattttcatattcaataccaaccttggaaggtaaccccaaagaaatgtttataattagtttgaaccatatgacagtgttgattttgaacctttttaacctatgaaaatggcaatttcttatggttcaacattatactaaagattcattctactcatttctttccttagactaaatgactttgtccagtgctcacaatatgttctatatacattagacacttagtatttatttgttggtggagtttatttgagtgattaattgggtaagtttttaaggcatttgcctccactgctacaccatgcaatgaaagggaaatattgtccttttgaatgaggttgagaaggctaaacaggaggtttcacatcttggttttccaggcttttcattgaacgtggagggcggacatatggtgggtcagagaggtcaagaatttggtaaggcatttgaaaagaaaacagttgaaaaggttaaaagtgtatctgttctgatcttgggcggtccacgctagaaaactactctttgaaatggtgtttccatttcttacgcggtggtaagggaggtatattttgcgtgaatgatgggagtacccattggcctctcaccagacagtctgaattcctgatgtgtgtcgcccagggctagaaacaggagcatgactgctactcccagctcacactggggatggaggtgggagatagtgggcttgtccttggtattggagctgcagtacggcttcagagacctgaagaggctgctgctagagaaggggccagtccaaaatagagactcacagactgctttggaaatgttccgggaatcaggttttcagagttatagactggctctttgcgtataacctgtaccagtgacatactatatactccagctattgctgacaacaatatcagaatgacctctcttctttgcatgttgcagaagttcctgattgcaggagaaacgctgtcttctctctgattctctgtgtgtccattcccattgctaagtttagctgccttgctatgatcctctgtgcatctgtcatagtgatgtggaatcctagtcagtcttacatttaaaaatatatacctgtatgtgacaagaggttcaccctgacctttttgcttttgtttcccagtatctagaacattgccatcagcagcagtaaacttctcccatgggctccacgtgtagtcttttcgccagctgcagtgtgtacaagactatgatcccagggcatgtaagaagataggaatgcagtgcagtgagaaaatatacataaaaacaaattggtataatcccaagagtactataagtgtcagttgtgattattactacgttaagtgccaaatgactgtaaatggtacaacattccaagtggggaagggatctcagagacccagaaaggctgctgtggaggagttgaaaatggatcgggaggggaagagatgtaattcgaagcttggaagagttggaacaggggtatgaagcagtgctgcatgtgacgagtgtggggaattgcaggcagaccagatcggctgaggtacagggaggaaagaagcacctggagagatctggcctgaattctttaatttgataattaattcagaataaattatttagattgcaggctgagggagggatttaattttgaagtattatacaactgtattaatctgcactcttgcaacagtattactaggtaacatttgttgagcacttactatgtgccaagcttccaactaggtgctttacatgtgttaattcatagaaaatctgggataccattttataaataagaacactgaggcagagagttaagcatctttccaaagtcaagcaaatgaatagtagcaaaaagatgtaaatcgaagtgcattgactccagcatctgggcttttcatccaaggctacagtaaaaatctaaggagatgatgtggtgtggtggtgaggtctctgatgcctggagctttttcttacaagctctgggacagttatacagtccttaccttagtttcttcatgaggtcaatgagagtagtcccaggggtcctatctcagcaggtagatgggatttggtgaaataacatgaaataacaagatcgcagaacacactcattagggctgctgtaagagttaaggggacatcgcagtcctaatcctcttgcatgacagaagggaaaaatggagacttacagatattaaggggtttgttcaagtacacagttggaattagaatgaagcactcttgtctgtaaaatcaaggactgttgactcaactgcattaaaccagttaaatcagaatgaatggtcatgccaaaaccgggctaaggtatgcttctgaaataactaagaaaaaggcatttttaaagtacattctgtctttagattaaaaaagcatggtataattcatttttgtgtggtatgtatagagtcttttttgtttttaatagatgagtaattattcagcactaattcttgtctcctttttttatatgggttttcttcacattaaaataaaaataaatgtcaactcagaatttaggtaggccaaggcaggagggattgcttgagcccaggagttcaagacaagcctgggtaacatagtgggaccctgtctccacaaaaataagtaagaatttggtaaggcacttgaaaagtaaatgcttgaattaaattaagaaaaaaatttacaaagttgtgcataccatatattcctattccaaacccacaagggcagtgcctgcctgaaccagagtaaaagactgactttatttcccctacattctgggcacagaatccccaaggcggggagaagggctgaaggttgagttgatcaccaatggctaatgatgaaatcaatcatgcctatgtaatgaagcctccataagactcaaaaggacagggctaggagagcttccagaaagctgaatgcatggaacttcctggagggtggtgcacccagagagggcatggacgctccatgccccttcccacatacctcgccctgtgcatctcttcatctctatcctttgcaatatcctttatagtaagccagtaaacctaagtaagtgtttgcctaagttctgtgaattatcctagtaaattaatcaaacccaaggaggaggtcatggaaacctcattttgtagccagttgattagaagtatgagtgggctggacatgtgattggcatctaaagtgggggcagccttgtgggactgagcccttaacctgtgaaatctgacactatctttaggtagatagcatcagaattgaattgaattctaggatacccagctggagaatctgctgcagaattgattgcttgcttgcttgttggtggggagaaaccaccatccgcacacattttggtgaccagaagtcacagaagcaactgtgttgtattgagagcagagaataaaaatacagcaatttggttttgcctctatttcctatatgttaaaatgggtgccagggacaggagggaaaatacttaggcccaaatacttgattgcatctcatttttataaaagatatataaatcttgaagccagtaagcttattctgcctgtcccaaaccatatatgtgaaaatatctctctagataatatcattttgtaaaaaaaaaaaaaaaaaaaaaaaatctgaaatgcctgaaattcttttaatttcaacgagttgaaggcctacaaattacgttccaacacagttttacaagaaggcgtgtgaagaaggcctagagcagagaaagattttaatgtgtagattgaaagcttcaatccctggccctgttcttcctttagactagagggaaaagtagttcgaatgttcccttcacctttatggatgaagtgatgccttcatgctagaagagtttgggaaaagaattctcaggaattttacaattattaatcaagtctcagtacatcaagaaaaagaatgagaaaaggaataacagctatccctggactatttgatctattctggctcaaaggcaaagctattatattttcaaaagagaagagagattagctcctaagttgttatattcaagaactattccagtttcaggcaagatttattttgcttaatgtatctccttttatagaagccagacctttcccttcactggctgctgcaaaccttaacttaggttatgaccgcaatttatatgataaaagggctgtaaatgcaaaatttagggggagtgattttttaaaaaatgcataaagctttgaaaaatacatcatagattataggtggaagctgaattaaagtttttcaaagaggaaagagacctaccaggtcatctgtttattacccagagtacattaaactgttttccagccttatcagattcatcatgtggctaagtataatgcttcttatttctacttggttgtgcttatttaaaacattacaatccatcactctcaaaattattactttatacttattcaacctttcatagagtcagtctaaaattaaaaaatgctcttttcatatggaaaaaagtgtcttactttaggatgaagattttttttcccttgaatttgagatacacctttggttaagcataaaattgctgcagttccaacgtttaccaccaggtgcagcagacagactgtcttttctgggttcacataactgagaaagaagtccagtggtagggtgggtgttgggacccattaactggtaatggctcagtgatatccttacctgattttttttgtcattgttttgccatgtgcatttttattgaaattgttgactctcctttgtaatacagtatggcgtccaacaaggcctatggttatatccagagagagagaaagagagcacgcatctctttctttaccaatgaataactttgatcatttatctgcccctcactccccctccttgtcttcctgagcaatcactgggcaatgaggatgggtctgtgttgatgggcttagggtaaatagagctccttgatagaatagaggtgacatcagtctcacccaaccatgtggcagcaacacaaagttagggatgaaatggattcagaattgagggcaattgctgcattcagtgtactctcgtagctcctccttcctacaaattgtagtagtagaaagattctggttatctgtgaggtactctgtagctgccatttatactttctctgtttctctgtgctcagagatgcctactggtggacgtgatcacttttactcctgttaaatagaattgcagcttcccaccatgggccaaaggaagcctcctgctgcaaggacagtggaagagacagggaggaaaataatgatgctcttaggggacatagcaggtaataaaattgggaccttcatttggggactaagaagatcatattagattctcaagttcaagtcacaccccaaagagaagagacagcagtgaaataatccagctatgctttggtggctgaaatacacatatgtggatatgtgtgtgtgtttgtatgtgtgtgtatgtgtgtatgcatatatatatttatgtgtgtgtgtacatgttacaaacagaaaatttcaatttaggaagagaaagttggctaaaaaccctatcttatccattcttccacttagcttttaggtctttttggatcatggtttgggattgtaaagtggtttgtagttttgctagaaggctgacgacattttgggcagagagaagtgaagaatgtgagtgtggaaagctgaaatgggtcttgaagatgatctcctccagttttcctttccccaatcagaggtacagaaatagatgttgagaagcattaaggtagcttactcagggctcccccagttattaagggagtcagtgtgaaattgagctgtagatttcactttctccatttcactgcttagctatatttagttttctgtggtaggaaaacttgtttgttatgtcagctgaaaaatgacgaggttcataaatttggaaaggagagctttatttctcagaaagggttgcagcctgcagggtggccattatgacaggtggggaagcatagcctctgcttagaagccagaaacagacatgtcaagggtgggaagaataacacagggatttatactgaatgagatggccaaatacacatattcaataagaagctataggagcagtcatgaatattgatgaaaggagaaacatgcacatgctcaaatgagcttcatgctgcctcataggacgcatgttcaaaaaatggcagcattaggattatccaagggtggtgttttcagccatctgttgtcaaaaggtgaagcagaggacatgaaaaccttcactgcgtatcctctgtagactggccagaaccactctgtggtcagtggtctcttatcaggaaggaatgctggtggattggattgtcagaaccacagaagggaggggcaccgtcaggcagttagttgatatcagtggtgcagtcttttgaaaaggcttatttctctttaacccttggggaagaaagtgagggaggggtataacaaggcatgcccaccctcccttcctgtcatggctgggaaatcggctttcaaggtttttctggagtccccttgaccaagagtgggggtctgttcatttggtagggggccttagaattttatttttatttctcagttataattctctttaccaaaaaggactgtttgaaccttctcatttcttgatacagaattttgatagtcaacttttgcttatgattgtttgataaatgggcaatgggaggtgggaaacatagcgggatcttaaaattgttttgcattaaataagattaagatcttacatatataatccctttttctcttgtgctgttggtaggattataccatgcatgaaaggaggagaatcaatgccttttaaaatttattgttcagaattttcactaatttagactgatcttcagtgataattaaggtaaatatgctttgtatgaaaaccctcaaaaatcaatgagtgacagtaaggcacaaaggtctgtaactgtctgtctgtcttttgctggggttgagccacctctagccacacagactcaaaggataatgctgcctctcttttcactacattctctgttgaaaggtgatactagtattttctccactgtttccctgctcccaaaatcctgcaagaagtaacctttatggctgagatggcttggttatggaattgtgtgtaacatgggatgctgaatgaatgaatgagtgactcagaagaggcagttatggatttattgacaccagaggctcttgatgccaagaaatgaacacatggcttctaaggtgctcccagattgtgtagaaccaccagtgaactttagaaagaacactggtcttttattatacatccagattatgcaagacacaagtcttttcatgatctgtgagatcttgggagtggtgcaaattgtagtgatgttattagcgtaaaaatgacttttgattgatttgtattacaatggaaattcttgtgttaatgcatgtacccttagcccgtgcagcactctgatcttctcattactctcttcagaaacccagctgtgaagcaccatctgtcagcagccgcagcagcatctgtctcagtgtcagctggcatctgtgttaactcttgcacaattgcctaaaggcctgtaggtgggtgtgtgggaaggggaagctctgccctggtacctttagtgacatattgcctgctcttttagacttgaaaccacccatgctggggtgccaagtgcctgctttttcacaagctgggggactctttgagatttctagcattccacgatacattcaatcttacttgctcatctttattttccacccgtaataatactgccattcaatgaaacttgaacaaatgatcatttgagagactcagggtaggattttctgctatttaattcggcagaaaataatgttggagtatctgctgggttggagaatgtcctcctcttcaccccacaatgtatgtccctcctggaacatcagcatgtgaccttatttggaaatagggttgttgcacataaaattagttttaagatagagacatactgagtagggtgacccttgatctaatatgactgatgtccttatgaaaagagacacagaggcacacagagggaagacagccatgtgatgactaaggctgcacctggagttctgctggcacaaaccaaccaatgccaaggattgctggcaactacgagaagtgaggacagaggcatggatcagagtctccatggagcccttgcagggagcatggccctgatgacaccttgatttcagacttttagcttccaaaactgtcagataataaatttttattattttcaatcacccagttagtggaaacaaatacggagtactttacagcatgtcaccacggggactctgtaggtagttcggaggttctacaagtagccattgtgtaaaaactctcttgtttcttggtgggtggcacagagttgaatggtgctggtaaggaggggatagtgcttattagaacatgttatggaccagggatattccattaggaataaatttctagtttattcatgcagttacttctcttatttcaacacatttaacataccctgcacagtcctacttttggagatgtgggaggggacaaggcagacatggagcctactctcatggagttgaccatcaagtgcagaagacaggcttgattgtttctaatcaacctaaatatttttattaccaatgtttaaaaaagcagtcgtactaaacaataatgaagttttgttaagaaactagtatttgtatgttggtcaaccctttgaccttggacaagtatcttcagatcccaagtccctttaccctccccccaaaaagaagaataaaatactcttaaaaaagaaaataaaacagtgtttgagaatgtcacttaaggatcccattttgaaactaatcatactggatttttaaaaatttatttttattttttagagacagggtctctctgtcacctaggctggagtgcagtggcaccatcatggctcactgcagcctcgaacactggggctcaggggatcctctggcctcaacctcccaactagctaggactacaggtgcacaccgtcacaactggctaatttttttaaattatattttttgtcaagacatgatctcgctatattgtccagctggtcttgaactcctggcctcaaatgatcttcctgcctcagcctcccaaagtgttgagattacaggcaggagccactgcccaacctcatactgcatttatgtttcattccatttatttgtctgtgctttatctccctagcctaatatgaactgtgtcttgttttttttagtgctaaccgtaatcctttgcatacaataagtttagcatgtattttttgaattaaattgaattattgattaagaatattaggatgattaatagctaattgattatttatgtgtgtaccattccaagcaatttacttgcaatttacttatttacttcattttttttctcatgatacttctatgagtctatcttgactattacccattttacagatgaagaaactgaggtatggaaaaagtaaggaacttcctcaagctcaaccatccagttagtaaagccagaattcaggcccaagccttacttctggctccatgccctccagtgggaattctccactctgtgtaggcaatgaggtcatggcttatagcgattttaaagaattcatctgtgaactgcatcctggatcactccagttatagacatgggtatttttctcagtggccccgatgccacttattagatggtttggcgtaaagaaagtaccagttaggacattcagtgtaaagaaagtactcgttagaacattcagtgtaaagaaagtaccagttaggacattcagtggcttgaaaggaagaaaggaaaacatgactttcagccttctgctaccttctctgggtttaagaggacgtgtggggccaggtgtggtggctcacacctgtaaccccagcattttgggaggctgaggcgagtgggtcacttgaggccaaaagttcaagaccagtctggccaacatggcgaaaccctgtctctactaaaaattcaaaagttagctgggcataaggtgcatgcctgtaatcccagcttctcaggaggatgaggcacaagaagcatttgaactcggaaggcagaggttgcagtaagctgagatccagaaggtagaggttgcagtgaggcgagatcataccactgcactgcagcctgggcaacagagtgatactctgtctccaaaaaaataaaagggaggactgtgtgaaagtcatgttcttttcctcttttcattattagctattacatcctctaggaataatgcacaatggattgattttaattgagatttttgtctaagaaaacccttctccaccaataaaaagttggtatgtggaatgattgctgatcaacttagataacttttattttattttattttatttgagacagagtcctgccctgttgctcaggctgaagtgcagtggcacagtcttggctcactgcaacttctaccccccgggttaaagagattctcataccacagcctctggagtagctaagactacaggcgtgtgccaccacacctgcctaatatttgtatttttagtacagacagggtttcgccatgttggtcaggctgatctcaaactcctgacctcaagtgatccacctacctcggcctcccaaagtgctgggattacaggcctgagccaccacgcccaacagatgacttctatttaattctttctctgcttaccctttagctaactcgacttaaatgatttctatgcttcaaggccctgtatgtgttaaagtaggaatttccatttcacattttcgttttgcttgtgtggtattgagtgggacagtccttccggctctctccatctcagttgaggctgtagctctggcctttcccacagagaaagtgatgagtccccatttaggcaataaggggaatcccctagtcatccactggctgttgaagaggggcgctttgcagcaggtgtgtgcagggatcctgtgatctgcatctgctctgttagcatttgtgacatctcctgctttgctgttctgaattcactgtggccagtagcactggccgtacagccctgctcagagataacactatactgggtggaatcctttccctaaacccaagctctctgcctatcctggggctgcagcagggcagttgctgactcagcagtgggactgtctcctttctctccaggaagactgctgtgtgccttgttcctctgctccagccacagagctggatctgatttcagctggaaacaacaagcagtagaagttcaaaagtgaaaaaccacaagcagtcaaattccagcactccgtcattgcagcagcattcacaatagccaaaagatggaagcaccccaagtgttcatcagcagatgaatgaataaacaaaatatggtatacacacagagtagaatattattcagccatgaaaaggaatgaaacatggatatatgaaacaatgtgggtgaaccttgaagacattatgctaggtggaataagctagatacagaagaaataatatcgtgtaattccacttgtatgaaatatctagaacaggcaaattcatagagatcaaaagcagattagatgttactaggggctaggggagggaggaatgaggagttattatttaatggttacagagagcttctttggggtgatgaaaacattttggaaatagtgaagatggttgcacgcattatgaatgtaattaatgcaattgagttatatccttacaacaattacaatggcaaattttgtgttatgtacattttaccacaatttaaaaaaattaaaaatagcaagcaccctaaaccagatcttgcttctgaatggtggcttcactttgtcatttggcaatggcgcaaatgctaaaatatgtctttggccttcttagactggacataaacccagtagaatgacagcatcttaggggaagagaccctgtcccaagtcaagtgctaatgtgaaatatgtgctcaatcattgtaaaatatatgtatatctgattatcacataatacaccttaaatatgtaatttttatctgtcaattaattattttaacattacaaaaagaagaggctgataaaattgactcagctggtcccatgtaacagggcatggttattcttatgaaggtttcagttcatccttagaaatatgctacctcactagagggctatcttttctttttctattttataggttttttgatcagttttctttctagaggttaactctgacccgttatcctagaaggcctttatcatgtcttcatgctgtgactctagcagaacacacatacatgcgcacgtgcacacacacacacacacaatgtacatgtatgcgtgtatgattatgtatattctcatgcttgcataagcacagtgacatagcaagacagcagctgtggtgggaattctccgctctatgtgtaggcaatgaggtcatggcttatagcgattttaaagaattcatctgtggactgcatcctggatcactccagttatagacatgggtatcttgctcagtggccctgaggccgcttattagatggtttggtgtaaagaaagtaccagttaggacattcagtgtaaagaaagtactcgttagaacattcagtgtaaagaaagtgccagttaggacattcagtggcttgaaaggaagaaaggaaaacatgactttagcaatttcccttctgtttcgtttcctttcctgccctctccttccccagcccctgcttctaatctttgccgcgtggaacaaagaataccagaatcaaaaacaaaggacactgtctcatgttttttgctcacaagaaaatgaaacagagtgcttaggattctctgcctcctcatctcgccccacttgaaggcctccacccctggagaagtcatctatttaatcactcccctttggcttgaaagagctaatacacttttacaatatgtattcagtttcttccaaaaactaatatgcacctgggccaggaactaagccagatcaattgtttgagataaccgatgttatattatgctgtagggacagacattgaactgtggatcaaagaagataagaaattatttcaagataccagtcaggaaaataacagtaaattcaacacaccaatatgacccaccattcccttgatctgattctgagatcttgaaaaaaattcacttacctttggtatggacacttagtattaaatcaggttctcatggtgcaccagtagcagcttgaaaataagacagtggagagaagcaggaaataaggggctgaggcctccacctgggtccgtgtacttgtgtgtggattttgtgttagaagtctgcagctgtaatccatgtaaccagtgcagtgcgtatgatctggaatagatatcatgaatcagttttgcaagagatgtcttagactcttaagagtgttggtaaccatatgaccccactgatttgttttctgttatgccctttatcttgcttgtgtcataatattaataaattaactgtcttgagcactagaaatgagaaaagagaagaaacttagttttgcatagtacctatgggaattcttaaattaaaagaaacgtaaagtccctcactaaaaggactccccattaaatgaacattatcttcaagccttaggaaaacctggcacgctctaacagacagcccaagggaatgcgtgataggaagaaaaaaccaggacattcttctgctaacattgctgagttaatagtgtgtcccatttgaccaaaattatcgatccactaactgatttcagcggctcagaattgtatgtgtatatattagcctattacagataacatttaccaaacttagtgtgttcgttttcccttgctttgatgtttgtttgtatttgatacctacttgttttttcatttgtcttcctttgggcctttggcccacttgcgaggaaattaaagaaggcacaaaattttactttaccgaatctgaccagcacagttccagtgtactaatggcccctaatgggggtttagctattggtcaaataaacaaataaactttcatgtgtgtaaagcagttagaaagagtggatttttcctggatatttaaattatgtataatgtatgtgcatatataatatttattttatcatttatctaatagtaaaataattattttaaatttcctttcttaatttgtgatataaattgaaataatgggtcaatattaataactcatagtgtgggttctcacaggcattggtcatggtttcatgctttacctgccagggttcatttttttctcatagcagcctctcccaaaccctgcaggttgggtaatgtcctccccatttttggtagagctaatggctgtcttttgtttgcgtgtgcatatctttattttatggttgacacaagagtgcttggaaagtttgagagatgttcacctgagcatgttgcttggaagtggtagctatggaatttaaatccatatgggtctgttgctgtggtggttacttttatgtgtcaacttggccaggctatagtaccaagtatttaatcaaacatgaatctagatattgctgtgaaggtattttgttaggtggtgaacatctacaatcagtggactttaagtaaaggagattatctctgaaaataataatatggatgggccacatccaatgacttgaagaccttagaagcaaatctgaggtttactaagaaaaagaaattctgccacaatcctgcagcctcaacttctgcctgggtttccagcctgctagtataacccacagattcgagacttgccagccccaactattgtgtgaacaattcaagtttaaaaaatcatatatattcacacatgcatacacatacacatatgtaacctccattggttctgtttctctggagaaccttgactgatacagacatcaaagcatgggccgtatgatacccatttacagaaggtgaaaggtttttatccccgtgttactggcaatgaaacaagacttagagtttgacagacttgcacgtgagcatatgtgtggcgtggaaatggttgaggtggggttttaagccaactctgcctccagaaacaatgctgtttaacactgtaaaccacagattccccatcactccaactgcacatgaagcaggcagccctgatgggtgatataacagtggctgatgtttattacacactccttagtgtgctactcactgggctgcccatttcacctgcatcatcctgggttctcagtacagctaatggagaggtcaagccgctgcctgcttctcacacttgatgaatcagagccacctgaagggcaggttgaggcacaggttcaacccccagagttttcttcatttaaggggagggaaatgaggcttcagcctttgaagtgggaatgccaaagaatttgtggacatattttaaaaccagcacagcttagttattgctggtgtcttttgtgagtgtcttttgtgagtgaatgtgctggtcctttattctagtcaagcatcctttcattcagtttatcactgtgccagtgtttcttattgtttcctaatgccaagttctgactgtgcctcccagttgcccctgacatggcaatctgctctcttgttgcggctaatagaagcatctcactccactgtgttgactccctaaggcaagcccccaacagactttccttgacttgtggtcatgtcagtgtcaccatgaaacccaggtgactccagaagctgcagcgaagactgccctgagctggactgtgctacccggcagcttgatgtagccatggttctagctgctggctgagcagtcttgagggcaggtgctatgcagcatccttagcatagggactgaggtgacagcaattctacagcctctagagttgctctctgtattagtctgtttttgcgctgctgataaagacatacgtgagacggtaatttacaaagaaaaagaggtgtaatggactcacagttccacatggctgggtaggcctcacaacatggtggaagacaaaaagcacgtcttacatggcagcaggcaagagagaataaaagccaagtgaaaggggaaaacacttataaaaccatcagatcttgtgagacttcttcactaccacaagaacagtatgggggaaaccacccccatgattcggttatctcccaccaggggtccctcccagaacacgcgggaattttgggagctacaattcaagatgagatttgggtggggacccagccaaaccataccttctccaacacaccctcttttttctcagaagaatcccagagagggaaaccaaagtgcaatctggctgctcccctcctgtgcctctcttgcccctggtcatttccagtgtcaccatggggtggcttcctgtgctcttcacaccacctccctcttatctggactttccgtatgtacaactccagggtctaatctgacattctcactcttgattttctaaaagggctgagaatgtaggcagttccttcctgagacaatagcttgacttgcaagaatgtcgtcatgctgcagacttcagctgaatattccccttgttttttccctctgaattccttctgtaacatttcttctctgagcaccaccctccctgcctccctctccacttgaactcaacaaggagatggttattgcttccagaagcagggcagaagagcatatcatggtatccaacataggaacctcattctacaaagatttgttggttatttcctaggtgttcacgatatcctaaatacagaaactgaattatttttctacaaagatttgttgggtatttcctaggtgctcacactaccctaagtactcaaactgaattattttatttaattttcacaataaccctatgaggcaggaattgaccctccacccagccccatttacagctgaagaaacaaaagaaactacaatagagagggtctattaatttgcccaaaactaataattggccaatccagatacaaacccaggcctcttcactccagatcttccatgctacctatccccatctacatgtaagcgggctgcaagctgcaaaatcacatgtaatacaagatgacacagtgtcagtcctcattatttgtggatttcatatttgagaatttgcctacttgctaaaatttatgtaatcaccaaattaatccttgaggcacttttagggtcactcacaaatacatgcagagtggtgaaaaatttgggttgcgcaacacacaccttcccatataaggctgaacaaggtgacactctgccttcctgtctcagctctcctactatgcacagtgttctttttggggtccatgttttgccactttttttttttttttttgctttttgtactttttcttgctgttttcattaagatgacccccaagtgtagtgttgaagagctgtatagtgttcctaagtgcaagagggctgtgatgtcgccaatatgtgtcagataagctttgctcagacacgaattatagttccattggcattgagttccatgacagtgcatcaataatatgtattaaataagatgtctttaaatagaaacacacaaaaaccaaattgatattgatcaattgataaaattgtgagcagaggctctcaggaacctaactctgtttccctttgggtcagtgatttgctaatttagtgtttatggttactttatagaacctaaatatctcaagttatgagaatcaactgtattggccaggcatgatggctcttgcctgtaatcccagcactttgggaggccaaggtgggaggattgcctgaggccaggaatttgagaccagcctgggcaacataatgagacctcatctctattaaaaaaaaaaaaaaatgctgggtatggtggtgtgcctgtagttccagctacttgggaagctgaggcaggaggatcacttgagcccaggaggtttagtctgcagtgagctgtgatggtgccactacactccagcttgggtaacagagtgagacaccatttcaaaaaaaaaagaaaacaaaaataaaaacaaaatctttacttccttaattaattaaattctcaggcatttaaaaatgttttacttatcaaaggacatagattttcagtggtggtgatattgctcctaaggggacacaatccacccccccaagaaacaatgtattaagcagaatcacatacatagtacataagagatatacagtatatctgtagtgttgcgatttcactgggggtggggtacttagggaaaaaaagtctaaacagtttccttggagggtaaaataatgagaaaatgattgagaaatactgtcatagggcataatgactatttaataagagaaagcatgtaaagcatttattagagtgctcaatgaaacatatgcacttagtgttagctattattataaataacattattatttgtttcctcaaccttatactctttcttcataaacaagcaatttttaaattggagtttgcagccctttgagggatcagcacacatgtcctcacgtgtgtctgagaagtttctctgaaatttgttgttttattttgtgctttcattttcatgataatcttaaaaataatgaataactgtgtactggttcccctttataagagagtcctgccatgagttatattgtccaagtttccccatgtttaaaggaaggcgctctactccagtgtttgtagatggataagcaataaaagagcagtcttaaaaatgtgcccgatacagtcagactcagtgaaggccacctgatgccatctctttgtaggagggaagggttccctgagttcgagtagaggaaagtgatatgcaggttgagtcctcacgcagccgggagtgggcacgtgcatgccaaaacaaagagaacattggctttagcagtgagtactgtatttaaattttgaaagacagtttaatctcagcaaaataacatcatcaatcatgttaaactaatgctgttaatttgaatgttatggatcttattgtttttgcatttaatttgttattttgttttagttttattattgaatcagagctagagcatatggagtttatttctagttttccatttgtgcatctctaagcaacaatataataaaaataatttaagtctacatattggtgttgcacaataatgttatttgccttattaaatggagtggtttggattactgaggtttgaggaataaagtaatggactcaaagaattatagactgagctgctaggaatcatttttccagaaatttcccctaccagatacagacactaggcctgcagagtgagaagtgaatgtcaaaggtcagaaagcaagggagtggtagactggggtcagaggccaggtggacatacttctaaccaggtgcccagtctgccatgtcaacccacttccaaagatgaaccatggcagataaatggccacagctgccaggccacaaaggctggttaggcaaaaacaaatggagaattgctgcattgttttggttaactctgagggtagaggctgtggaaggggtggggacgaagggaataacagatttgttcagagcctaagtcccaatgagcaatgggtgatagtgagaggaaatgatggccatttttctgagttccttggtattcccatgggtaatatcacctgagccattccctcctcaagtgatattaaccatcagcctgtattgttcggtgactttcatcataaggaaacaaaactccaaagtctaaggagttctactctgtatgaatttagactgtaagcttatgccacctaactagagttctgtactgtcttagtccattcgggctgttataaccaaataccatagactggggggcttataaacaacagaaatgtatttctcacagttctggagaccgacaagtcaaagatcaaggtgccagcagatttagtgtctggtgaggatgcacttcctactttataaacagtcttctactgtgtcctcacgtggcagaagggggcaaggaagctctgtgggatgtctcataagggcactaagcagagtcctcatgacctaaccacctcccaaggccccacctccttataccatcaccttggggattaggatttcaacatgtgaattctggaaggacataaacattcagttcattgcatttaccactgggaagaaaagactgttggaaaatgatgtttctcagctgcacatcagagttttgatcatcacttgtggagcaaaaagaattcatctgtgatataactagttggtcattagcaatagcttgcgttcttttcttttcttttcttttctttttttttttttgagacgggctctcactctgttgcccaggctggagtgcaatggcgcaatcttggctcactgcaacctccgcctcctgggttcaagtgattcttctgccgcagactcccgagtagctaggattacaggcatgtgccaccatgcctggctaatttttctatttttagtagagatggggtttcacgatgttggccaggctagttttgaacttttgacctcaagtgatccatgtgcctcggtctcccaaagtgctgggattacaggcacaagccaccgcgcccatccagcagtagttttctattgctgagtaaaaacattaccacacacttagcagcttaacataggagcatttattattccacagtttcctggaatcagaattctgaacatgcattagctggatcttttgttcgggtctcacagtgctgcaatgaaggcattggccagggctaggctgtcctctgatgctcagggtcctcttcagtgctcacttggttgttggcagaactcattttcttgtagctgcagaactgatggaggcttgctgcttcaaagacagcaggaagggtctctctcctccaggccctcttttaaagtactcacctaattaggtcaggcccacccagaataatatgccttgtcattaatttagttaacttcttagggactttacatctgcaaaatgccttaccttcacgatagcctgttggttagaggccagtcacaggttcagcccactctcaagggggaggagatgatgcggacatggataccatgagggcgtcttaggaatctgcgcaccacagtcagtaggtttctccatcactgggcagtagagtgtggttcatatttacagactttcatgtgacatctgaagaatgtttggtaatattaatgtatatgattatattaaaggttagaagagtagaaactcagccttgagctaagattatttagaccagggattctcacccttggtaccattgacatttgggctggataattctttcttgtggcggccgacctgtgcattctaagacgtttagcaacatgcctgtcctccacccactagatgccagttgcacctcctggctcatttgtgacaaccaaaaatgataccagatattgctaaatgtccccttgaacagaaaaatcatctccagttgagaactgctgcattcgaaaaatgaaatgttttttgttgtgttttgtttttgaaggaggacctattaaagcagggaattcattttttgatgtgacgcagctatttggagttagcggctcttgctcctctgattatgccttattctttgcttatttcctttactgagaaatgcataatttatagttgcaaataaaaaattaatgcaggagatgtgttccccacatgtactttcttattcacatttatgccaaaaagagattatgttatcatatttgactacgttttataatcttgtctgagtttatagtcaagctatattataagaagactttagttctcctataacatggatcagatatttcccaaaagatatttaatgcataaggcaaaaaaaaacttaataaactccattctttgtattatagctgctttcttggaaactggtgatatggcttgctgtgggaccgagtggaaggcatggtccaggtctgaaattacaaatctcaaaagctgctcattcctgtttcttccaggcaaaggcagctcgagcatctcatctgacgtgagttcaagtacagatcacacgcccactaaagcccagaagaatgtggctaccagcgaaggtaggcagctggtcttcattatctctctttcttcttcacagggctggctatttttggaacagaaataaagtgtgggagtgttagttctattctcctgagtgggagcatatgagatcttaaaaatgaggatgttcagggtctcctaagttttgttgttgttgttgttgcgctgcagttacagttcatgaaaattgatttgacgggattcaggtgcctcaattataaggcaaatgttgttttgtgaaaatggaataggctgaattaagggaaggctttacaatatcatataccttgtctttccgtataaaaaatgatattattttaaaatccttgtgctgtagttgaatgttcctggaggaactttcaaaataggcacacctggaattcaagattttgacagtggcaatatcatagtcatgttatttgtagaacttgagttaatctccaaaatttgggagtaggaaaaaagggggtttctttattattattaaagaatatgtaagaggtccttcctgtcaggacaaagattggtcgcagtgattttcttgatgaagaatttgcatgtggtaatacatgttagaattccactgcttttcaatatggaagcttttgagttactacttacttgtttgagtgtggaattaattgtttctattgtaattatttagtggaaagttgacccaattatagaatcagctctttttattttaatgttaaacatgattaaatgactttctgtctgaaaatgagttgttgctaaactaattgttggattaaagtccagtttaaacatcgacgccattgataatgaaagaccttgagctgtcagctaattttcatgacattgtgtagcgcctgctttcctaaagtctgtgggatgttgcggaagcacacttccagttttttgtttcagatatttaatttctgttggtcataatattgggcatgtacccatgggctgacattggccatctgagatccatgatttctctctatctgcattataatttatgtattgtaattgtatgtggtttacatctgctggtatgtatacgtcttctctttgatatgttttgtcttagtgtgcttcaagtagcaaagaattaccttttctgggttaatagctttacaactggattatattctccatgcttaaaaccttagcactgtttgatgcgttttcccaacatcgtaaggctggcagattggagtgttctttcttttcagtgtatggaagcaccaggtagcaatccagttttaattttctgcctgttaattcaggtatgggcattagatcattaatgaaattcagttaaggtaatgtacaaatctcgttaactgattctagacatttatttatttatttatttatttatttatttatttatttatttatttatttgagatggagtctcactcttttgcccagactagggtggagtgccgtggcacgatctttgctcactgcaacctctgcctcccggattcaagtgattctcctgcctacaggcacctgccactatgcccagctaatttttgtacttttagtagaaatggggttttaccatgttggccaggctggtctcaaactcctgacctcaggtgatccacctgcctcagcctcccaaagtgctgggattacaggcatgagccaccattcccgacctgacatttacttttgaagctttcattcttaggagccatagtggaaatcattgcagttacacatagtgcaatcctctctagtcagaaatctgttttgccagattatctatgttttctaccgttgttttacagtcactcttgtcaccataacttgtctaatttgaatggctatccaaatagaaagttaaaagcaggttaaataatctgtttttttaagctttcttattttttctccttttcaaaaatagaaaatacacaactatatcagctgtgttgcaggggttgggggagggtagtgtgggacctcatgcatttaacagtgtctgctttttatgcttccaaagggggaaaaaatctctgtaggggctttaaattttcattttcttgtgcctttcccttatgaggaggtgcaggcccagccaatgttttatacattttgtcacaatgtattttctgttattctgagggtagaatcaggcgagaaaaataggaaaatgttatgttcatatggaagagttttgagcaactgggctaaattagtgaggaatttccttctagcttttaagtagaagaggcttgtccctatgaaagatgctgcccattcccttgcataactgaaaaaattaaaaaagaaagtattaagttctgctatttgtgtgtctgaatcctttttgctgtagtttttttaatcaattaaaacaaaatattaaaaaacatagaataggtgtgggcacatgttacattaaaatgtatttcagggatgtttgcgggatgattagtttcctcttatcaggctgctttttcaatatggatccagagtagccagtgctaatttcctccacgcacaggagacatagtctcaggaagagaccattcaggataagtgattagggaagtattctctgacctctagagggtggatctcaactatggtgcataactttcttctcactgggaaacacctaggaaaccactgaggaagaagcagaaggcagacactgacttctcactcagactgttagcactggaagagatctgagttaccccaaattaccagcggcctatcccgacgggtctatagcaacttcagtccttgcctcctcagaagaaataattcgactgagggacataaaacagaaaaagaaaccgaggcaagtttcagagcaggaatggaagtttactcatataggccttagaaaaggaaagaaagaaggtgcgcttggaaggaactcaagcaggcacctgaaaattaaaaagagaagttcatgtgcccccatttaacggtgatcctaggacttttataagctcacctctttcccatgattcttcccttagggtggtcttcctgcatgcgcggagccctctttacccttaggaactgagcatgcgcagtgtgtttagggagttgtacgcatgcccatctgaggatttcttcctttttccccggtggcatggaaccggaagatcatacttagccattttttgtgttttaatgtgcattcccgggaagctgtttctccctggagtctgtattcagttaacaacttttaatgttaacaggtgtggaccatcaggagattgtctctccctggttgcggaattacactttttagagagacaatgccaaaccgtcaccgacatttctagttggggtgggatgggaagccgtctcctgccctgctcacgcctacctaactacctgtaacaagactgcagaggagccaagctaaaactgcttctcggattctcttcccactgttttctagaactatgtttaacctttgatgttaagaaaatattggatgtaattggctttccagtagccagttgattatggttattttcttcaattccttgagcttctcatgattttttcacctctgaattcgccaatatcaccttcagggagcacaggcaagattcttagtttaaaggtctgaatggtattgattttttaaaatgacatatattgtaaaggataatattcagttttccggcagtctttgaaaaccatggctatacctttaatagccaggttggaagcattttgcagaagtgttggccttttccctgatgggatggatagggagggttcacattgcttccctggttggaggtgtatgtatgtgtgcatttgtgtctgacatctacatggtagctaaccacacaggtgttgtcacttcgtagaaaactcatgcaattgtgctggtaaataaagtgaggacatggggatagagaaaacagagggccctcacataacctggacttaacctcagctgcaggtgggaatgggaattaactgtaaatggacaggaagaatgttactggggagatgacaatgttctgaaattggatagtgatgatagcagcacagctcagtaaatttagtaaaaagcattgaattgtatgcttaaaaaagagtgttggggcagctaccacttctgcatgatcttcagacttatatctgagtcatcacaaactattctttttttcttttttttttttttttgttgagacagagtttcactcttgttgcccaatctggagtgcagtggctcaatcttggctcactgcaacctcctcctcccaggttcaagcgattctcctgcctcagcctcccgagtagctgggattacagacacatgccaccacgcccagctaattttttgttttttgtttttttttttttttaagtagaaacggggtttcaccatgttagccaagctgctctcgaactcctgaccttaggtgattcacccgcctcggcctcctaaagtgctgttattacaggcgtgagccaccgcacctggcccacaaactattctttgaaaatgcttcttgcaactgtggggagagatcgggccagcagacccgttccgaggggaggattggctggtgtatagagcagggttgcacgctggccccaaaactctcctcagatgctccagctctggggcggaactggcctgaaactgatagtgagttcctggactagtgttcccagcctggcacgtggtgcctggttagaactgactcatcatggtaatatttcctggaaagttctggaagaattgtgagattgtagagtcatgggtttcccaaacattggttttggtttcttttcttggctttccctgcgtagtctctcacctcagctccgattttgtgttctagcacccaaccctaatggtaaagacatcgaatttatccactccagtaagtctgtttctttgctaatgactttatgatcttcctgtctatccagtgttccagctaatccactctgggtcgtaaggctgttcccctaggcacagtgggcacattttggttttaattcatgagagaatggcatttttgacccactgggagtgttccattccaaagtctcatgccaaagttctgggcatcttaattttgagactaaagccacagcccttgtaaagaattggcagtcagcagggctttctccctgataagtggtgtagacgttctttacagcccattgtatttcttgtgacagtttaagtttctaatttcctgacactgtagggggggttgggttccagtgtagaaggctggaaattttccattttttcccaacataatctacattccaacattgtaagacacagcttaattctttccagttgtgttactattctttctctttcatatttttcagtctttctcattcatggggtattctctcctatactggaaagaggggcctttgaccttcagttatgaaagtcacatccagcccatggttggaatagagcacacagcagagcatgttgagtagaatcagttggattaggttaattaggaagaagcttcctgaaaatagcaagctgagcctcagcttctttcatagaactgaaaggtatgaggctatggctctatgggcgggtggctcagtcttttctggagctgggggaaggcaaaactgtcagtttaaaggtcaaatttgattggctgataaagagtcagctttggccagctgttctttaagtaggacgcatattcaaatattgaacccatctacagcatgggctattaatatgatatcttggttctacacattggttatcaaaccagacaacaatgcagccacgggattttcagagttacaaagggtcttgtcaatttttggatccaatacactcatttttttttacattaattaatgaaatcaccatctgtttattgaatatgagtcattgtgttacgtgctaaaagatgcaaagataaatgagaaacagttattgtcaaggaacagcagtagaaagacatgcacaaatagctagaatatgaggtatcattttgttataaaacatgataaaatgtataatatatattgcatgttattattactttttatattgggcctgatttatttcagtatccccacatatagcacaattgtttcacatggtgtatttgctcaataaatactgattaaatgtgaaaaatagaaaggatataaaccaaatgcttgggcaggacttttcttttttattttattttattttttatttttatttatttatttatatatttttattatactttaagttctagggtacgtgtgcacaatgtgcaggtttgttacatatgtatacatgtgccatgttggtgtgctgcacccattaactcgtcatttacattaggtatatctcctaatgctatccctccccgctctccccacccgacacaggccccggtgtgtgatgttccccttcctgtgtccaagtgttctcattgttcaattcccacctatgagtgagaacatgcggtgtttgggtttttgtccttgcgacagtttgctgataatgatggtttccagcttcatccatgtccctacaaaggacatgaactcatcattttttatggctgcatagtcttccatggccaatacacttatttttataaatacctgtagcacagagaaatgaagggatttgcttattttatttttattttttgagatggagtcttactctgtcatccaggctgaggtgcagttgcatgatctcggctcactgcaacctctgcttcttgggttcaagcgattctcctgcttcagcctcccaagtagttgggattacaggcatgagccaccatgcccggctaatttttgtatttttagtagagatggggtttggccatgttggccaggctggtctcaaactcatgacctcaagtgatccccccactttggcttcccaaagtgctgggattacaggcgtgagccaccatgcccagcaagggtttgcttatgattacacacctaataaattgtcaagcaggaggttggtgcagtattgtttcgatcaaattagaaaaaacataactttcgctatttaattctcttttgctgcctgatttctagcagtctgttttgagctggttgcagagctgaagcagcctgttcagaatagtttgggagaggttgttaagcccaaatcctttggcccaagaccattattcccagtaggaggaaaggatctgccccgtaggtaaaagattcttaactttcttcagtagattagctggttacctagggttggaaacacatttcagtcaactcatgattttataatagcctttcaatattcagttaataccgctttgcgatattgtgtaagtccttgcgaggaagtcattttaaatgtatcattggaggcttgtgaaattatttgatttctaaagaatttatggtgatatttgttccatggaatctagaatcaccaatttgaagtcatgagttctcatgttttcagtgcccaaattagatcagttctaaataggattattttgaaaatgcccagacatctggctttgctttcgttctgttgtccttatatctttatattgtcttctttctacttcttcttgaatatacttttcaaacaaaatttacatgaatcatctagggaaggaaaaatgatgcttttaactctaggtgaattctgtttcccaaaaagcttttcaaaactctacaacaattcaacaaacatttttgagacaattattatttcaggctttcgtgagcattattgcattgagcattgtttcaccattacacttctcttgagaaggcataaatgttttcattttgcagatgaaacagggaaactcagaaaggatcagttgggctgtatttcatgtaaaattagtaggtggcaaagattatatcagggctcaagactacgagccttgacataagatgtgtacttaatgcttattttgtcattgtcagcgaaactgaatttcatgctaatcatttttctaagttcctatcaaagtatatttttactgtacttaggagaagtgtgttttccaatttcaactcataattgtgtttagcttgtcagtattatatatgcagatacttctgtgatccatatagggtctagaaattgactttaaatccttagttattgctatggtttggatgtggtttgtccccaccaaaactcatgttgaaatttggcccccaatatggcaatgttgagtggtggggcctaatgggccgtgtttgggtcctggggcagatccctcatgattacctttatgccctctctcaggggtgagttctcttgaaaatgggttaattcccatgagaacagatattttaactgttttcccatttgtcctgagaatcctcgcctgcacttgttgctgcagcatttacccgaagataactttgccatgaaatagcttttgcttttattattattttcagatcactctagtgtattgactttggaaacaaaagataatgttttacttacagaattctgtttttagtagtggtatttacatttacaaaatacagtaattcttgattgctgaaagtgtcaaatcctagaaaatgtagcattcctacacttgaagttaacatcattttcgagctgttgttggccaaagattcatctgatgaattcagcttttctgaagtagatgattctgatgattcagatgtttctgatgttagttttgtttagaaataactccaagaacagtttttatattttattttcacattgaaaatcagtcagatttgcttcagcctcaaataactgtttatgtaaaattaaatgagtgttggctgtgaggtacatgtttgtttttttttttttttcctagatgagaaaagcattaaaaagagtctggcttcttgatctctctctctcttgcttcctctcttgccacttgatctctttgcacatgccccctcccctcctgctttttcccatgagttggagtatccagaggtcctcaccggatgcagctgtcattcatttttggacttttcggtgaccagaattataagcccaataagtgtcttttctttataaattacctggcctcagacattctgttatagcaacagaaaatggactaagacagttatggaaggcaaatattagtattctaagctgcctttatacttgaattgttgaagatttagtctgcaagttaccacaactgtattcttaacacatggcagtcagacttagtaaaattaatatttaagttagtcattatataggatctaaagtatatgtaataaaaaattactgaatagttattttactgattttccctttaaaaaaaactgagccacaggctgggcacggtgggtcacacctgtaatcccagcaatttgggaagccgaggtggccgatcacatgaggtcaggagtttgagaccagtttggccaatatggtgaaaccccgtctctactaaaaatacaaaaaattagctgagtgtagtggcatgcatctgtaatttcagctattcagatggctgaggcccagtaatcccttgaacctaggaggcagaggttgcagtgagccaacattacaccactgcacaccagcctgggtgacggagtgagactctgtctcaaaaaaaccaaccagccaaccagacaaacaaacaaaagccaaatcaaaactaaaacccaactgagccatggaatttttctttaattggaaatatatgaaagtggaagataataatttcagcatgtaccttaggagactggaaatataccttgaagctgtctattacaatagaaggaaactcaatctatgacaccaaaaaagtagagtaaaaacatgtaacataggaataggaataaaaagcaaagaatgagagaaagaaaatgatgctgaagaaatctcttaaaaaatagtgctaaaatgacaactattgcgtggggggccttaagaggaagagattctgaagtcagaaatgtggtattaggagcttttagtctgtgtatgaggaaggtgatgactgattattataaaggtttgttttcgtctttaaaaattaaattttaaacttaactatctttggaattctcaggatcatttaggaaagctttgcaagactttagcctttgaagcttaatgtgttttggtgattcaatgagcaattcactgcttcatgaccaagtttattttattgtttaagctactgcccaagtataagttaggtaacttttgaaaaactgcaccacttacatctggtgatttgagcatgttaatgttcagtgtgcccaatttaataaagaagtcaaatttgcatccaagaatcttttaagcagtggaaagctcatcatctcagtgtccagaaaattggtttgtaagcctacaaatgtacaataaaatgctaaataccatttcagacgcaagtaataagtttaatttcttgagggaattatcttccaaaatgcatcatccagaatgaccagaatatcatatgatagtcttagaagaaaattcgtttcctgtgtgtgtgtgtgtgtgtgtgtgtgtgtatgtgtacaccatgcacttaaggaaattgtaaagtaatatttaatcgagatgtccagagctctcagtgcctttatgcagatgttggagagagacaggtttaggtatttaatattctaattccatgtccaaaataattctatgtttatttctttcacctagtttgccatttccaaaaaaagcaccaaaaaactaatcattgtatttcagccatagacattatggttcatctaagtacatctaagtgtatttgtaatgaaagcttgcatcattcctaattttttttatcagtaatttcagtatcttaattgagtgggaacttattaaagaatatagtccaaatacatgtatttagtctcttatggagagctcacaatatgtcagtcaggggtcaccaactggtagcacagaggatgattcctccccttagatgggttttcttctctttaaagaattttcaaaaataattctgggtttaataatgatttcggtggagcatgcaccctgctatgactgaatccccaccattcccaactgtcttaaacaaactgtcatctaaatatttctgttagctctttggctcctgaaggaatttgattttatgacaagatccactacttccagaactgtagcaattactggggcaagtaaacacttgtgtagcagttaaatagccattcagggcgggataaaattatgtctcaacaggtggtctaaagcagaagggagtgggtgtgggttggaggaatcaggacaccctcatggaagcctgggactgttggctttttgctgtgtgagtagtcagtggaagcgtggaaaggaagatagcatgatgtgttagggtgtgaagagctgggagaaatctcactgggtccatgtagggaaaatggaagcttcaaaacaaccacctccctggcaacactgaataggctcacaaagtgtgttaaaggacagtctttaactaaaacatggggttacagattgcgtggccacagtgttctttgtactagggtttcaatggagcccatatttttggtgatgtcagtgacaaataggccattctgcatccacgaactttctttagtgtactggggaggttttacactaaagcaccatcttctcaactcttctatagtgaagagagactatagaggaacttggggaccaacattttaggacaaataatctgatattggaaatatttgccctttacagtcacggacacagtttgaccttaacaatctagttaacatgtctgtttacttcctctttgactaggaaataacttctcatggataaactaacttcctgaggaagtccccaacttccctaggttgttagactaattaacaaatcagcagagagaagcactttagtagtaaacggtgtctttgcattctgtatatgtaaaaaagaaaaatgtagaaagtccacactgtggagggaataatatacaagtagtttaaaaattgtgtgtaaatcatttagagatggttgaagaattgtaacgggtgaagtctatgggaattaggtggcaacagagttaattattttatatatataacaaagaaactttctgttgtttatagcggctagtggttttcaagatggggtggggcatctggtacactgagggacatttattcttctaaatagtgagacatgtttggttatgtgaatattcagatgtgggctatagaaaaccagatttctctgcccagaagagagattctgagctgcaaaagaagaaggtgtaggaggatatccaggagggtgaagaaggagatggacccaaagaagatggatggtggagcgaagatgtttccagtatcttgagggtagtggcccataaggtgacatgttcctgtgtccctgaaatctttagtcaagtctatgaaactcacaacatgcttggtggggatagatttactgtggaaatcagtttagggctgaattttgagattgttcatttgccttttgtgttgtcacctgactttcacagacacaactaaagccaacttctgaataatccatccattaacacgtccataatattcaatgtgaatacatttaagcatgctgttgttacatgctttttcttccatcatatatagcagtattttctataacattaatttatgcactgtatattaactgctctcttttgagtataattttgaacttaacattattcccattattaaaaattactattctttttatgcttggctttttacaacttcttctgtggataacttttaagcttctcccctgtacctccaacattatatttcctgctataaaaccacccttccttttggccacaaaagaatgctctagacccaccttagatatattttttctgctgaagacagaatcagtcatgtcctcagagcatctgggttcttttagtagagaaatatggaccaagcatggtggctcatgcatgtaatctgtgcactttgggaggctgaggtgggagggttgcttgaggctaggagttcaagaccagcctgggcaacagggtgagacctcgtttctacaaaaaaaaaaaaattgagaaaattacttgggtgtggtggcacacacctgttgtcccagctgctcaggagactgagacatgagctcaggagtttgaggctttagtgagctatgattgcaccaccgcacttcagcctgggaaacagactcagatccatactcagaagaaacggaaatatacttgagacacaagtatgggagtcaagcaaagggttcctgctgccgtgggctcacttttatcaaagttagagctagagactatgtgctgatttaaggaagcagtacacattgattttatcaatttctagtattgggtaccataaattattatatgacatgttttattattttattatgaagcttcattggctgcaaggctttctactactcagaaaccaaacatataacttatatggggtcttcctcaccagacctgcaaatatgcccagacatgcacaatccacagcaatgccagtactaggccacagcccagtcaacatatccctgcatgagagttttgtgtatgcttcctgcgatgcctcaatggtatcattcctccacttggttgaagtcttttgaggtaggaattgtgtttttttcagctccgtatgcctggcggctactggagtatttgtcatttaatacacatttgataaacgtttattgaatggatgaatgtatttttattcaagattttaagatggaataaccctcttgattaacttttccaactataatcataaagattatgacttcaaaagctatggaatatcaagataataaatgagagatgtagttactttttttaaaaaaagcttaatgttactgcttatggaaacttgaggtacatcatgggaatatttggcagttatttactcttagttgtctcttgtgttaaggggacaaacaactttaagcagaatagatactttgaaaggaaggtggaacagaagataccatttctattttacattttcagcattttaaaaccaaaagacagtttattgtctatgaactgtatctagctctataaataaccagttcctctcagaaagtttttaacattctgagtcactaaatgagatatacttagaagtctaaaaattctaaggctattcagccctcccacatcaatttcaaggacaaaagaaaaatgttattccttcctcagcaatttaattttactaaatcctttctcagtatcttttaacttcaatacatttaattgttttaattcttcatctgctgatatctcaaagtaccaaattagagcttgtgattttttaactgatgaaattggagaagtaactttcattttattggcacaaaatatggctgaattggtttgtttaatatgtgtgctcagattttttttttttttggttcactgatttgttatggagaaaaagttaagacaaacattcttagagaagaaaataatactattctttccttgttttattttactttttagtattatcctagaaacaaccttggcttcagattatcttttgcaagtgatattctgtttcctggaaactaggacagtgtaaagctcatgttttgtttagctgtattggaactggacaggacagaaattgggaaatgaattcatcaaatctcagaaatttacaaaggtctaaaatctgattaatggattcaccaaaacatgaagtaggaggttgaattcatcatttaatctggatgagaaaacaaaagctgtgaaacaaaaattttgagatttttttttttgctttcatttatgtgtgatacaagtaatttttttctctttaaacaatgaataataaaattacctacctcctgtgttttttgtgaggagtaaattaaaaaattatttccagttcttctccatatgcatttagcttgtttacttttataatctaatcacagccacttcatgtaaatagtatatctttaacttgttgagaggtgagtagacttcattcccatggcaaagtcttccttaaatgaattcaacacaattcctattgaaatcccaacagggttttaatgttgaaacttaaccaaatttactttcttttcctggaataataaatccaacatctctaagtacttagcatatatggacactgaattcaattcagttatatatgtatgacattatatatgttgaattatatgtatatgttgaattcatttgtaaaatgatacatgtacatgtgaggacgtccaggatagttttgaaatgagaaatgagagcagcatttccttggtgtcgtgaaaatatattatacatttattaaatattgaagaagtgtgggctgggcgtggtggctcacgcctgtaatcccagcactttgggaagctgaggctggtggatcacctgaggtcaggagttcgagaccagactgaccaacatggtgaaaccccgtccctactaaaaatacaaaaaattagccaggcatgggacaggaggctgaggaaggagaatcacttgaacctgggagatggaggttgcagtgagccgagactgcgccattgcactacagcctgggcaacaagagcgagactccaaaaaaaaaaaaaaaaaaaaaaaaaaaaggaagtatggtgtggtacagcttagtgcagtgaaaaagagagttcagaggtagactgaattgtgtgtggtaatttagggtgggataaaaaatggcattttaaatggataggggagagaaaactttataacacatcctggtcagaaaccaacttctagttttaaagaaaaatgaacatggaggacctaacatgttcctgatgccaaaataaatgcttaatggatgaaatatttaaatattcaaattgaatatagatagtagttttaagaacttgaggtagaaaacctttcaaagcgtaacaacagagttaccctaaagctaaaggccgactacttgcatgcatgctctaggagatacagtaagatctttctgttgtcaaatatgtttctttttccattgcacaaagctaaatacaggtttcttttctattactagacttttcagagcttttcagatttgttactgtgtattgttaatcatcaaatggggatataatatgttttgtttctcaaacgtcctttattataccttacaactaggaaatgctaagaaatgtgaattcagaggacctaggaatttcactctagaaaattttattttttttatttatgaatatattcttcttatttttataacaaaaagacattgctaaaatattttattgaaacatctacatgtgaaagttatatttagccactaaaaacgtgttagatgcttatacactgttggtgggaatgtggactagttcatccactgtggaaagcagtttggagatttctcaaagaatttaaaacagaactgctattcgactcagcaatcccattactgagtatatatccaaaaggaaacaaattgttctaccgaaaagacactcatatgtacatcacagcactattcatagtagcaaagacatagactcaacctagttgcccatcaatggtggagtggataaagaaaatgtggtatgtatacaccataccatactatgcagccataaaaaataacaaaattatgtcctttgcagtaacatggatgcaactgaaggctattatcctaagctaattaacacaggatcaaaaaccaaatactgtgtgttatcattagtgggaactaaacattgagtactcacggacataaagatgggaacaatagacaatggggaatattagatggggaagggagcaagagttgagaaactttgaggtactatgctcaatatactaagatcagtcatatcccaaacctgaacatcacacaatatacccaagtaacaaacctacacatgtaccccctgaagctaaaacaaaagttgaaattgtaaaaagaaaaagttaaagaacaatgtttaatgatgtgggaaaatatttctaagaaatgcagattatgaagcggtatttcttacgtgatcccaattgtgcataggactatatttgaagaggaaaaagatgagaaggacatatttcatgaggttatcagtagttataatcctatgagtgttaggattataggttatttttattttgtgttttccaatattctctaatgtataaaattcaagttggttcatattcaagggctgaaaatacctctttggccatttgttcttagaattttgttgaatgtgacttgatcaaaattcaattatttgattttgtcaacataagtttagatttttgaataataatcaatgtttctatttcccatccctgatactcagatattcaataccgacctgtatagcagtcacttgctttcattctaaaaaaataaccaatctaaaaaaatttttttaatcttaaaattttttgccattagatgcacatacttccaacacatttttttttctgttttatatacatttccaaactgaagttccaacacaaggtttatactcggatgcatctgcatttatttaaccagtcatgttctcactcatcaaatgtttcctaaatgtcaggtattgtacttgggtaatagggattcactgatcaggcagatagactaggcctgaccttctggaacttttaatcatgtagggacacagatattattattattattattattattattattattattattttattattttattattttgagatggagttttgctcttgtctctcaggctggagtgcagtggcacgatctcggctcactacaacctccaactcccaggtccaagcagttctcctgcctcagcctcccgagtacctgggattacaggtgcctgccaccacacccagctaatttttgtatttttagtagagatggggttttaccatgttggccaggctggtctcaaactccttaactcaggtgatccacctgcctcagcctcccaaagtgctaggattacaggcgtgagccaccacacccagctggggcaaagatattatgtaatctcaaaaataaattacattctactaagaatacattctttaacgcatgctaacaagtaaaaatttaggttgaattctgaataatgaacaggaattagcaaggtaatatttgtgtgcacacacctgtgtggggaggtgggatgggaggaaaagttctgtcttcattttctattattgcataacaaatcaacctaaaactttatatgttcgtttcttttttttttttttttttttttttaaaagacagagtctcgttctgttgcccagtctggagtgcagcagtgcgatctcagctcactgcaacccccgcctccgaagttcaagcaattctcctgcctcagcctcccgagcagctgggattacaggtgcccaccaccatgcctggctaatttttgtatttttagttggggggggggtttaccctagggccaggctggtgtcgaactcctgacctcaagtgatctgcccacctcagcctcccaaggtgctgagattacaggcgtgagccactgcgcctggctttatgcatcagtttcctgatgctactataacaaatgatggctaacttagtgtcttaatacatcacaaatctgtctgacagttcgggaggtcagaagtctgaagcgagtcttagaggactaacattgatgtgtttgaaaatctgtttcttctggaggctgtagaagagaattcattccttgtctttcccatctagtttcatgaccctctcctgcatctttaaagccagtagcatagcctctgcaagtctctctgactctcctccttctcataaaaagccttgtgattactttgagccctcctagataacccaggataatctcaccatctcatgatcttgaatcacatctgcaagttcccttaccacataaagtaacatattcataggttcatgagattagaatgtggacaatttttttttttggagggggcattattctgcctaccacacagttacttaaaatagcagccattggattatataatagctcacaagttttttcagtgagaaatttgggctgggcttgactgtgatttttctgctgcttgtggcatgactgaggtcactgctggtttatagctggtggacaggctggtctagagggccactgatgcaccctgcctgggagggctggatagctgagctcagctggaactgttgctcagagagctcacagggacttcagagactccagcaggatggtctctaggtaaacagaccctatatatggttgctcagggctccagaaagagtcttctaagagaccgaaagtggaagctgctggtttcttcaagcctgggctctgaaatggacacagcatcatttctgccatgttctgttagtcatagcagtcccagagtgaccctgatttcagggagagggaattgatgaccctgctccatgggatgaaagctgatgtatttcagctatttttaatttatagagtggatgggtggggcaggagtccatgaagagggagcaatataggggtagccctagagctggagggagcttagggctttttcaagaaatgcctgtgtgtatttacagcatagtgatgaagatggagaagtaggcaggggacagttcatataggaccttctaggacataaaaaggatgtggatttattctaagagccaacacggtactttgagagaggacaaacctgctcagacgtctgcgtggccctgggaatgggcagtgagggcacctgccacctccgtaggagctgtcttgggaccatgtgagagagaatgtactttgggctactgtggttctgacccatttttagccttttttttttttttctagcagcttataacagagcagcaataatcaatgtgaggtcagtaatagtctctgaactatttgtctatagcaaggttagtagagaatttgagagtgattataatcctttataacaaattaacattactgcaccatccacacgagtgggcaatgggcttggctttgtatatctgtttttttttttttaattttctcttcattttgttccattttataaaatatttgtataaattggaaaattttaaagtacagatcctttgcagatcaagaaattctcttctagaacacaatctattatattaccacatactgtatctttcctctgtgtctcccttgtgtgccctcaactctcctcatctacagctgcatgtgctgagtttttcagactgaattgctggtcacatttattcttatttgctcatttaatatatggctgctaaagacctggatagaacaattttttttcagcagtctatgaacacctctaatatgattgctgttttgtaacatcttgccagtattttattcatcgtatctttcacatttgcattttagaattaagtgttctctgattgaattaacagtgcagggcctcctagtcacagtaacagccaatttggctgatgtttagaaaaagtagattaaagcagggaatcatttatagtttagtatgtatactgtgagcctgttcttttacctgaatcatatcattttatgtttattcctctatcatttgtagaagggctaaaacctttttttttttttttgcatatgtggtcgctgattatttatgttggctttttctttcataaatcatagagcagaatatcctttgtgatttttagtttggatgtctttaaactctgtaaggttaaaatatgcttttattttttcagaagtaacagatctaatggaaagaattgggaaaatacagtaaaatgatctgatacattcttaatcagaaattcacatagttgatattggaagtagtgcattttcatcaggatgaaaggagaaagaagcagaaatttttttgttgttttgttttgtgagtatcaagtctatgaatgacacagccttgtattttggcagagaggaaagatgagtgatgggcagcccagctcttccaatgactccattctcatatgctaataaagagcatctgtaaaattcagacattctttgctcatggttttatctgtcagaagttagaaaaaataatgatagcaaagactttaaaataaaaaatataaaaaatgaaattctagtcatataacggtggaactttccaatgggcagaaattggagccagtgtgaaagtttctcctttgagctcagatgtaaaagcccatatacaaggggaatggcaggcacagagtccagggaccagaataccacatctttggggatagtgtcagtaggaggaaatcacaaatgatctaagacaaacaagaatgaaaaagcagaaaaccataagcatattttttgaaattatgtaggcaggtaatgtgggaagcatgtcaaagaaagcagaaagcaaatgacaaaagtatcatataataggacagaggaatgacagagcagcacaaacaactgtcttcagttctttcaatggtaagagcacatggctttatgcgaaaggcatgaggatagcaacagctaaccattctatattggttactttgtgccaggcatggttttaactgcattacatatattcactcatttaaccccagaaccaatgaggcaagtactattattataaccagtttagaaaagaaggactggaacagagaatgcaaataatttgcacagaatcatacagttaaaagtgccttttactaaggcatcattctctggactccattcttcatagtagagatctatgatttaaaattgcagcccagcaaaagcgatgtcatatttttaaaagaatttctagaacaagtacaaatcaacaagtgtggaccaatcacaatgcaagggactgaaagaactggagattagccaattatctttgaaaactgggggaagtataagctcctgacaacacaacctgttaagtctgattcattattcagctaacctagtttaacacctcccctaggtcaggccccttgcaaagtgtcaaagataagaagatgcatttgatgccaatgtcaccaccccccaggtgatcagtctatgacaaaggcaaaggaaggagaacaataattcaatttaaggtgatacttagaaaccacagcagacccaaaggaaagagccatgcctgggaacgagggggatcttgtagaggcttcacagaggagctgatgtctgatccagactttcacgtgcagtggagtcacaagggggaattggaacatagggttgttcctgtgtgtgaggaaggctcagaagtgtgaaagggccagggagtttgtgaacattggtcatttatccccaggctattcagtgtgggatctgggatcagcagcatcccatccctagaagctgttagagacacaaaatcccggctccaccctaggcctgtctaatgagaatcggtatttaaatataacttctccaagtgacttggatgcaaattgaggtttgagatgtgctgttgttgagccattgcataattccagtgtcgagtgcatgcagtaagtgatggaacggaggacaagtttcttgcacatctcgggggagggagcgggtaggtagggtgggggtgatgctgacttcagactttatccccagagcaataatgacctgtcacaaaatcctagtgcaagcttagtaagcagtttgtacacctggtccttgcaaaccatcggtccgtatatcaacctgtttgtggtttccagaaatgagtatgctgattgctagaaatttccaggctaccaagagtaaatgctgccaatgttagtagcaagcaatatttcagactttgtgatactagaaactagatcgagagtaacaatgaccctctggaactctccttttttactgagctcaaccctgaagttcagtcggagctacctaaaccaaagttggaattctctacctagtctggtttttcctggtcgaattagaaaatgagccttcagtgcgatcttctcagtaaggagtgttattttgtattttggggatctctcatgtctgagaaacattttgatgaatagctgttgaggaaagcttgtactttttgttcatctctggcacagtgatttattcttaggttcccaaattgcatagtacacctggatctttgtatccagaaatatgttcaagactgagctggggctttagactcagacagccctgggcttaaaatcaggcttcttgatttattggacactgatatggtttggctctgtgtccccacccaaatctcatcttgtagctcccatgattcccaggtgttgtgggagggacttggcaggaaatcattgaatcatgggggtgggtctttcccatgctgttcttatgatagtgaatgagtctcacaagatctgatggttatatcagagggagtttccctgcacaggctctctctctttgtctgctgtcatccatgaaagatgtgacttgctcctccttgccttctgccatgatcatgaggcctccccagccacgtggaactgtgagtctgttaaccctattcttcttcccagtctcgggtgtgtctttattagcagtgtgaaaacagactaatacagacatatacaaaactcaagtttctcatttgagaaaatggagataaaatgcttctcttgcaagttattgcaaggatttgaatataatacatgtaagggctactagattactgccagacacatggaaaatgctcaatgaacattattcttaataagttacaaatttaagtttgttgaagtactttaggtcagcaggtagaaggatctggaagctggggccgagggaacacagacaatgctgggttgctgagttctattgttcttgcttccttggccagctctgtgctgcttgttcttttcacccagctgtagactgtagaaaggtcttttccgtaattgaggcaggggcagttatcctaggatatttagaaaaaggcttatttttccttggattgcatttcacaatgtcttaaggaacctctgtgcatgtgcttgtctggagtggtaaagattgttgtattagtctatattcatttcctagcactgccataacaaagtataataccacacgttgggtagcttaagacaatagcaacttattgttttgtggcaatagagtctagaaatcagaaatcaaggtggcagcagccgtcttccctttgaggatctgtagggaagggtcctttcttgcgtttctcagcctcttttggttcccgacagtccttggcattctttggcttgcagctgcgtcactccagtccctgtgtccttcatcacatggcattctccctgcatgtctgtgtttctgcaactcttcttctcttttaaggacagcagttatagaattgagggtccactctgctgcaggataatctcatcttaactaatgacatctgcaatgaccctgtctccaaataaggtcacattctgaggtactgggggttagggctttgtttttttttgtttttttttttgagggagtcttgctctgttgcccaggctggagtgcagtggtgcaatctgggctcactgcatcctccacctcctgtgttcaagtgattctcctgcctcagcctccagagtagctgggattacaggtgcgtgccaccacacccggctaatttttgtgtttttaatagagatgggatttcacccttttggccaggctgttctcaaacacctgatctcaagtgatccgcccaccttggcctcccaaagtgttgggattacaggtgatagccaccgtgcctggccggggtgagggctttaacatatctttataggggacacaattcaatccataaaagagccttgggagttggtctgctttcttcgcatcctttgccttcctcacctgcatcaccagggtaagaggagcccgtgtagcttaaggacatgctgcagcatctcacatactagagctgggtcagcccagccactattgtgaatagtcccacgctgggatttactgagtttcttgtggcctgagcttgctaatacacccccagagtgaagacaatcaaggcaagtctccaaagaattgctacactctccaggtattttatatccagaaatccattatctgtttctttaggttcctggtcagtgaaccaaatgttagacttttagggactcctggagttgacctagtcccacctaaacctttccatgagactgagacttgaaagggatgaatgcttaccctacagttgggtacatttgtgtagagaacccaaacaagatggagtcctgcacacccaattccttcttccagactctacaaccaattaattcacttcttctcttcccctggtatgaacacaggaggcagtagagacaggtaggaagttcttggtgcatggaaattcctccacagggaaaccaagaggaatggggaagatggaagtatccctcataacagttatgactgccatttttttttttttttggtggcagtgattaatattatgtgtcaacttgaccaggtcatagagtgctcagacattgggttaaatatgatgtcggggtgtgtctgagtgtatttctggatgacaggaacatttgaatcagtagactaagtaaggcagattgtctctcccagtgtgggcgagtctcatccaatctgtggaaagcctgaatggaataaaaggctgaatgaaaaagaattctttctgtctgcctgactgtctttgatctgggacatcagtcttctgtctttgaagttggccttgaactggaatttacgccatcagcttggatggatctcctctagttttctgactgcagaccttgggacttttcagccttcatgttataatacattttatattatagatacataacatagtatatggtaacttaacataaaaccttgtgtgtgtgtgtgtgtgtgtgtgtgtgtgtgtgtgtgtgtgtgtcctattggttctatttctctgcaaaaccccaatacattagtaaatgtgatgtgatctctggcatattttaggattcagtgagactttaaaagaacataatgcccaacacatgaatttgagaagtttagcagtgaaaacacttggtattttatggcttccaagaaatctcagggacattctaacccatccttgatctggtgatctctttccactcctccctctgctattatgtgcttaagtgtggaaaaattaacaaaaggataacttcttatgtatttttccaatgttttctgtttgttacaaaactgagaaaattaaacctcttgggaaatggccaggatatgtaactctccaagggtaccccacacacacagccaacttgagcaatttccaagggtcccagatttcagagctaatgcacctgttcaactcacagagtaagaacgttatgccttacactcaatttctaaaacatagaagcttgcagtggttggcatgaccaagaatttgtcgatatttgaaaagtaaaaatttatagtccatgaaacctgctcttccttacaccaaaacccaaaccccacatgatgtgagaactaactgagcctttcaggtgatactgagtaagatgagatttggattgctctagactcagtgggttgccatggagcaaactaggctaacctttgtactcttagataggagacagacctagataggagacagacctagataggccaacggggaagcagggtaggtgggaagaggggagaaggaatccatattagagccttcatctggtgcttgtctcacattcctagtctcctaaaattcttacatcccacaacaacaatttgcctacctgttcaattcatttcatgatcttaatttaaaatgaactgttggatctctctttcataaattaagtgcaaaactctactttctgcctttcttcttgtgaccagagtaccagttgactcatctcagttataatttgtttaacaggtttcatttgcttttcccccttaatacatgaatccttttatgtgtttaacagttatttgtttcagagggtctgcattgcataatgccatgagcagccaaggttttcacgtaatgattttttatgaaccatgcaaagacagctcaagttatgtaaatctcagtgaactctctagcgacaagagtcccaatccttaggcttcatcatggagctgcttctctctcaatgtatttgaattattggtctagccaacctcttcttttccccttgctgcagtattttaggaggaaggaacaggctaaatcctagctagacgtgcgcatgcattctggtatttaagagccaataaaatatagccaggaatcaccttgtctcctgtaccatacttggatttgtagttcagatcttcaatgtagtgcttaaaagaaacacacactggggttttcatggtgaagtccaaggcaagggcatagaaagaccacttgaccctggatggaacaacatgtggaaaccctccttgccctcctttttatcttctttactttttttactatggccagggttggaaatgtgggtggatgatgggttttacttctttgaaatgttaagtgtggaactttgaaccatgctcggtcttccctggatttagcaagaattgaaggctgtgctcagagaggttaaaggaagcatctgcttctctcaatacaaggttgatggagatgattagtgtggtcaaggaagaggagattgtttctgccgtgcagctaatggaaagtgctttgggaacattggaaaaaagcatctcttgctagaagaccttgatcatctgtctcttggctgtagaggtggctccttggggttcatgtgaggccatgtcaaacagaaacagggagaaattgtgtccaaattcgtgcttagatgtgtgtctgactcagtgttttcctcctttataaagccaagataaatgatttttgaattaaacattgttttggcacttcgtactttcattcattaagagggatgatgaacctgtcaggccataatagctagcctggaattttccttgccaagtctgtcctccttgaatagtttgctatttatgctgatgatttggagcaaggaggtagaaaatagtcatattatttgtccctacaagggaaaatacagcagcaatgttaaaatgataatgacgccaggcgcagtggcccacgcctgtaatcccagcactttgggaggccgaagtgggcggatcacctgaggtcaggcattcaagaccagcctggccaacatggagaaaccccgtctctactaaaaatccaaaaaaaaaaaaaaaaaaaaaaaggccaggcgtggtagtgcatgcctgtaatcccagctactcaggaggctgaggcaggagaatcacttgaacccgggaggcagaggttgcggtgagccgagattgcgtcactgcactccagcctgggcaacaagagcgaaactctgtctcaaaaaaaatggtaatgacttctctcctgccacatcaaaggtggaacgtgggtggtggggggacagagagagagagagagaaggggtacttattcatcacttttgcccatttgaagaatgctttatttctaggggaacactccttcagtctcaagatgccttcagtttgacttttgcttttagggaactggattttagtacattatgggtgtatgagatgattggagccttaatgaatcattacatgctatcattgaggcgctcctcactgtatggttttcagatacagagaacctagtgtatgcatgagaaagtaaatctcctcccttcctttgctggaaggaggagagcagttgccacccaccagtgccctggttggtcatagtgccttcccctttagatggactcaggacaatggcagagcaaaagacagtggaagcccacaagctccctgcagatctgcagcacccctgggactttatattcaccttgtccccttccttgcttgtatgttgactgaccctgatatttagcaattttcatgggctaaatgatatacaaggctaatatgggccaggcagttttaaccacaatctggacacatttccttatgtggaagtggattttggaaaatcattttctgtttttgttgttcccttctcattaagccaacatgtatattcataattacaccctttatgtcaattgacacactttcctaccttgatatggactgtgaaaggaaaataaatcttgggacccccaaatcgctaagctaaagggaaaggtcaagctgggaactgcttagggccaacctgcctcccattctactcaaagtcacccctctgctcactgagatagatgcatatctggttgcctcctttggaaaggctaatcagaaactcaaaagaatgtgcctgttcttctctcacttatctgtgacctggaagcctcttccctgcttggagttttcctgactttgcttcaagctgccctgcctttccaaacccaaccaacaaatgtacttcttacgtttcttgattgatatttcctgtcttcgtaaaatgtgtaaaactgagctgtgccccaactaccgtgggcacatgtcatcaggacttcctgaggctgagtcacgggcacatgtcctcaacctaggcaaaataaactttctgaattaactgagacctgtctcaaattttctgggtttacaggacctgcatgatatgaaagctatttcatgatttctcagattgtttctgaaaagtatcattgtaactcttcatcctctttgcaataggcttatttggttcagttctatatgaaggttttcaggttgaaagttctgccagtaacaaaatgacttggctgtgttgttcacttgaaaacgacaatgttgttgcctagccttcctgtcgaagattgaattttggcttgttgagagcttgctctctgttctaacaatcatgtgcggccagttgcttcatttgtgtttctaaagaaactcttggagtcattgaggtttaatgtgggtgggtagagttggaggaggggactatgtttgaaaccacaattaacccaccaacatggttaagccaccaacctctctgattctcagtctctttgcttgtaaagtggggataatagtatatgtttcacatcccatgcaaattgaatatattagtttggcacactataaagaacatataaagaataaaaattataataatagttaatacataataagtaactacttcctttctggaattattctagtttccagtatgatcctgacaatatcctaatgaggtagctttgttatttccccattttacagatgaggaaactgaggcaaagaggttaaggatcttgcttggggttctaaccttagggttatattgctagtaagtggtcaacttatgaattgaacccagacagtctggctccacagtgaagaacttgaaagaatgccaggaaataattttcaccaagttgagctggaaccaggcttgaaaactgtctcacatactgcctctatggctacagcggggtctgaatagatactcctacgttaatggaaattagacattctctttggctgatcttattccccaaattgtttacagctgttttggagctttggaattgctggaaatgtttaaacactacactgttgatttagcttattttgttgttttgcaatcccctaaattctcgatgttaatgttaacggtgtgttaccatgtgatattaatggaggactgtcactctcacaggttgagaccttatgttctggactatatgagtctcggagatttagaatgtgttatggtgacagtcgcgtggggagtatatgaccaagggatactccagaagaaacagaaacctggagtggcctggttgattctagaatgtattgaaggttcagatcactttttgaagaagtagactggccagagataatgtgtcctcactatgtgttggcccaaatcacaggaaaaccgctaatttagtctggtcttcaagtattaaatggcatcagctaaagttctctgattaccatttctggtaagcctagggactgtggaactcttatattagatttggttaactttaggaagaaagcaagactgcaatatgaagaaaataattccaatgtatctgtgtaaccttataatgacaagaatggtgtcagtcattaacatttatttagcacttgtaaagaaatatcattaataagtgcatttgatcctcacaaattcttatggtttaaatcggataagcctaatagttattcacatttctaatgtggtaagtaagacacagaaaaatcaaggcaatgagtgttctgctgtggacttaagcacaagctgcagacaccaagtccagtgctcttctcgccattccatgtagcatctcttatttcttattctcactcagtacttccgaggccactgtcagagttccatctgtctcaaatagtagaaatccaaatagaccacagcaatgtctacaatccaggagacaaagaggtttgatggctaggggagtggagtgctaatccaggactaataaggaatgaatggccggggattgcggtgaatgtagtgaattaatataatttaccctttcatacttacttcttttcaatattatgtactagtcaacaattggagtcccagaaagaagaacactttttaatctaatttcttttggaccagtaacagaggaagaggaaatagaggagcattaacatttattggagtatttttgcatgtcatggatgatatataaaggttgtatttctttgtctttactacaactcaagtaggcaatagtttctcattttacagataaataaatttaggatgagaggcagaagtactttgcccaagcccatgcagctgacagtgtctgcaccagaatttgaaactggaacatctgttacttctcttttctcacactgcctctgtgaagcctgggggtgagagtaggtgccagtaggcactggaatgctccaggagaatgcccgtgtctaatgacaccttataaacacttgccgccagcacacatatgtgataaaaacttcaataatggaaacgtgacatgaggtggatagaatgaatggacactttttgaatcaagcctcttcattttctcactactacctgctctgcatctaatttgtcttgagtacacattgaaaatgtgtttccactaatattgaactcattgaagaattgaagatgagatgctaaatttattagtttcgtggatcttatatggtgtcttcttaaaccttatgcctcatttttaatttacatgtgagttggaagtgactacacctgctttgtcattgaagtctgcatttttaagtaaaggtgaaagggtgtgtatgaaaacttctgagatacagaaaatgaaagagactgatagtcgcttattaagggacaccaaattctaccatgaaggttttattttttcccagtagcataacatggctatttctacattttaaaaaatctctgaaacattcctgtggtgatcatttcttttgcctgtctgaactaaagcccagttgaacagttcaatattcacagtgccaagcggatcagaccccatgatggcttcaacctggccaattgaaggggcagcattgctgcaagataaagtctctgttaccagcttcccatgtgtttgtgcaaagcttattttttcattcaagctcttttagccacagtaattttccatgcctcccatcctctagccttatgccgtgttgaagacctcagttgaacgatgaactccagctgaaatgatcttcctgagaaactatggagaagtgaccacttgaactcagactctaaaactgttttattgtctcagactgtgctcttcggtgtcctagtcaagtcaatttcaactttttttttttttttggagccagatttgttcttacacttttaggaaaatggccatattttcatttcctttcctgatctacttattttctgttttttgtttgtttgtttgtttgtgttttgagaccgagtctcactctgttgcccaggctggagtgcagtggcatgatcttggctcactgcaacctctgcctccctggttcaagctattcttgtgcctcagcctcccaagtagctggaactacaggcataagccaccacacccagctaacttttatatttttaggagaggcggggtttcaccacgttggccaggctggtctcgaactcctgacctcaggtgatccaaccacctcagcctcccaaagtgctgggattacaggtgtgagcccctgcacctggctgatatatacttattttaacacagtaaatctataatttgacattggaaatctaatatgccttccttattggttgctgaaatagtatattactggttcaagttattaatgtagacaagtcctgtagttacaaagcctatgcatacacctagaaaaaatagaaaagctaataagattcatgggcagtgaggacagtaatgctgtgaggtccgcagagaagggaacaaaagaggccaccgtcttgtggcaggataactctaagctaactaaactcatctcagtcatcccatttgtgtattaggcaagtatatttgtatggtatgccatcatagctgatgaaagcagcaagatataacttgcccttttcacatgactgatctgcaaatctttaaatctttcttttcttttttttttttgtacctcactatgtcacctcagtgcccatcttgtacctgtctttctgttttcacttgttcattgctcattcacttgtctctgtcccctcactcacttctgattatctctaatttctttgactttggtagaagtagcttgtgcattactttgacaccaaatggctgggtaaaaagtgataaatcatccacttcaggtggtaagcttttcctacattatctaaatgtagtaatgtttctgtgaagcagtgctcgtattgatagataagtgtttttgtttttgtggctctttgatcagatatttcccagtcctgtaatagagccgcactaaaagtcacttcagtgcactgccttcgggctcatcttttcttcacatttctatcatgctttctggagtataaaggattttaactgagccacagaccaacatctcaacctcctgcttcacgcacaattgtatgagcttacagggatatcttagagatactgcaggtttggttccagaccaccacaataaagcaagccacatgaaatttttggtttcccagtgcacgtaaaagttatgtttacactatactgtagtctattcagtagacagcagcattatgtctaaaaacaatgtatagaccttaattttaaaatactttattgctaaaaagtgctgacgatcatctgaggtgtcattgagtcacatctttttgctggtagagggtctgtttcacttcatcgttgatggctgctgactcatcagggtggtggttgctgaagcttggggtggctgtggcaatttcttagaataagacaacagtgaagtttaccacattggttgactcttcctttcaggaaagtttcccctgtagcatgagatgctgtttgatagcatattatccacagtagaacttctttcaaaattgtagtcaatcctcttgaaccctgccatgctttatcaactaagtttatggaatattttaaatgttttcttgtcatttcaacaacgtccacagacttttcaccaggagtaaattccatgtcaagaaaccactttctttgctcatccataagaagcaactcctcttcttttcaagtttgatcatgagattgcagcaattcagtcaaatcttcattctaattctaattctcttgctatttccaccacatctgcagcaactttctctaataaatgctagaacccctcaaagccatccatgaggtttggaatcaacttcttccaaactcctgttaatgttgatattttgacctgctccttgagtcatgttcttaatggcatccagaatgatgaattctttctagaaaattttcagttttacagattcatcagagaaatcactctatggcagctacagccttacaaaacatacttctttttttttttcttttttttttttttgtgatgatgtcttgctctgttgcccaggctggagtgcagtggtgcaatctcggctcactgcaacttccacctcatgggttcacgccattctcctgcctcagcctcctgagtagctgggactacaggcacccgccatcatgcctggctaattttttatatttttagtagagacggggtttcaccatgttagccaggatagtctccatctcctgacctcatgatctgcccacctcggcctccaaagtgctgggattacaagcgtgagccactgtgcccggccaacatacttcttaataagaattgaaagtcaaaattatttcttgattagtgggctattggatggatgttgtgttagcaggcatggaaacaacattaatctacttgtgcatctccatcagagctcttggatgaccagatgcattgtcagtgaacggtaatattttcaaaggaatatttttattgagtggtaggtctcaacaatggggttaaaatattcagtaaactatactaaacagatgtgccgttattcagctttgttgtttcatttctagagcacagacagagtaaatttagcataattcatcagagccctaagattttcagaatggcagatagcattggcttcaacttaaagccaccagctacattggcctctatcaagagagttagcctttaaaacttagaagttttgaagccaggcattgacttctctctagctgtgaaagttctggatggcaccttcttgtaataaaaggctacttcatatgcactgaaaatctgtagtttaatatagccatcttcatcattggtcttagctagatcagctggagaatttactgcagcttctacaacagcatttgctgcttcctcttgcacttttatcttatagaaacagcttctttccttaaactttatgatccaacctcccttagcttccaacttttcttctgcagcattctcacttctctcaatcttcatagaattaaagagagttagggccttgctctggattaggctttagcttaagggaatgttaaggctggtttgatcttctcttaagaccactaaaacttctttctctgtatcagcaattaggctatttcactatcttatcatttgtgtgttcactggagtagcatttttagtttccttcaagaactttgtgttttggagacagagtcttgctctgttgcccaggctggagtgcagtggcgtgatctcggctcactgcaatctctgcctcccgggttcacgccattctcctgcctcagcctcccgagtagctgggactacaggtgcccgccaccaagcccggctaattttttgtgttttttgtagagatgggctttcaccgtgttagcccggatggtctcgatatcctgaccttgtgatccacccacctcagcctcccaaagtgctgggattacaggcgtgagccataagcctggccaagaaatttttctttttcatttacaacttggctaacaggaggcctagcttttggcctgtctcagcttttgacatatcttcaagtgaaagatgtgtgactcttcccatcacttgaatacttagaagccatgatagggttattaattggctggaattcaatactggtgtgtcttaggcaatagagagaactaagatggctgctcagtggagcaatcagaacacacacatttattgattaagatctggtatttgatagcccaacagggtgactgtagtcaaaaataatttaactgtatatttaaaaataactaagtaagcatattgtttgcaacacaaaggataaatgcatgaggtgatagatactccatttatcctgatgtgattattacacattgtatgcctgtttcaaagtatctcatgtgccctataaatgtatacacttactatgtacccacaaaaattaaaaattaaaaacaaaaacaaaatcccaaacctttattgatgaagttcgccatcttatgtaagtacagtttgtggtgctgcaaaacaattacaatagtaacatcaaagctcattggtcattgatcaccataacagatagataaattaataatgaaaaactttgaaatattgtgagaattatgaaaatataagagaaaagcacaaagtgaattcctgctgttgaaaaaatggtgccagtagacttgctaatgtagggttgccacaaatcttcaatttgtaaagaatgcagtatttatgaggcacaataaagcaaagttacagtaaaatgaagtattctcttatttagtttttgcatgtggaagtttctactattacccacaggaaagaaaccccctaagacttcacagtatatctgaattactgatagtctttattcagaggctgctgtcaaagaacttgtctgtgggcctgattttcctgataggaattatgtttctgatagcaaggctatcaaaatttaccaattatttatcaaggtagctactagttaccagttatcaaatatttaccagttatttcatccatctgctgcaatgtgctccaaaaccacttaagcttttgaggagcatgataaaattaaagacaatatgtaaaagccattgaccagttaaaagagaatgataaaatgtgaaaccaagtccagctctgttaaaatgttggctttaatggaaaaagttaatgaaatgaaaagagcttgttttattcatttgtcctcactgcatttatctacagtaatctcatcatttcccttggggagctctgcacagaagctaccagtaaagacatgcaccttcagttttcctaactttgcatgaccaaactaattttgtttttcttcagtgtggtatttatttacagaaactttcccatttactgaaaacattaaagactttgactcaaacttggaaaactagtaaacatcatttagcagcaatgaacctgtcaacacatggaaataaggtttacagtcatgcaaatgtccatttaactttgtttgagccaaacaaatataacagtaaactaattagactggcttacatccccgtagacagtgaaaccaattatttcttaaagaagggtttgcttgtttttactctagggcaaaggtgcataacttcttgtaatactcctgaatagttcttcaaatcaggacagataaagttggcaactgatggaatagctaccttgatgtgcaaatggttgggtctttaattaggttcatttatataattgagaaagaagccagggaatgcatttgtgcaaggatgattttaaaagaagagggatggtctgccttttaattctgtatgggaggaaaattcataaaaaactgaaaaaaaaaaaaaaggcaaaactgttttttctaacaatctacttaccactagccatggattgcctttgttacagtttggatggctgatacatattcggaagccatctctctgttttaatatgtttgatgtctattactaatgggtcatttttgtctcgaatttagtacctgaaagattcaaggttttttaaagtattcaaaacctctaactattccctaaagctttaatctctgaaacagagaaacttcctgattagaaaaacaggcgcctagtttggcctcctgtagcactgaactatgagagatattgtccaacatttttggtggtttttctctgtgtatattggataaattttggatgagtggggctaaaattttattttagatttttaaaaaattcatgtaataggattctaccataagtcttactttatttttatatatacatgtgggttctgattataagtctctataaactacatgttgaaaattgtgaatattcatttctatgtttgcatagtatgtacacgctagaaaatttctcagagtgactgtggctcacatgaatcttatgctaaatggggatatggttaatttgccctggcatgtacagagtcctaacttcagaaacacttgtctttctggtatggccatattaagatagctaccaatctctgcacacatcttagtctagcacatttgaacatccttgtgtctaccagttgaaggtatgaaaataagcaaaggttacacttctttctgtggtatcagaaatgatgtagaaatataacttttggctgggtgcggtggctcacgcctgtaatcccactactttgagaggccgtggcgggtgaatcacttgaggtcaggagtttgagaccagcctggccagtatggtgaaaccctgtgtctactaaaaatacaaaaattaattgtgcatggtggcacacacttgtaggcagctacttggaaggccgaggcaggagaatcgcttgaacccaggaggttgaggttgcagtgagccgagatctcgtcactgcactccagcctgggtgacacggtaagactctgtctcaaaaaaaaaaaaagaaaagaaaagagaaagaaatataatttttgactaaattagtacttccatatgtttgttagcatggtaagcgaagatccagactacagtagaatgtcttcataaataaactatggttgattagtttgcctgaatgtttcacagcgcctgaaataattctgtttatgtggattcagatgtgttagccatttcttgcggtcttaggagagcagcagaaacacttagattcttagaacatgaaaactgagagagacttacgtgtccattagactaacacactcgtttcatattaactgcatatcaagaaggtaagtgactcacaaagcctcaactcaaaccctggccatttgactcaggttattgctgcaaacacagtactgttattgtatctggagtgctctagtccttacaaagtactttccctgccagaactctgcactgttggtgcctggacctttagtctttatcattttgtgcataggataagaattatttttgtgtgctgccgtgtgtgtaatccatgtttgtttaaaatactaagaacttttattttacataaaacatttcttggtttatgtgcttactgttgagctcatgatcaactgaaatttttagctcttggtttgcaatagaaactggaactatctgctccatacagagaaacagatattttcacaatgcttgctaaagccttacgtgtttaggcctagttcaaaataaactttgtgaagttgtgaatgcatggtgtcatgtgaatcatagtaatttatgaacatgtcagttgcaagatgtattagttcattttcatgctgctgataaagatatacctgagactgggcaatttacaaaagaaaggtttaattggacttacagttccacatggctggggaatcctcacaatcatcacagaaggcaaggaggagcacgtcccgtcttacatggatggcagcagtcagagagagaatgaggaagatgcaaaaacggaaatgataaaaacatcagatcttgtgagatttattcactaccatgagaacagtatggtggaaactgcccccatgattcagttatctcccacccggtccctcccacaacaattatgggagttacggcagctacaattcaagatatgatttgggtggggacgcagagccaaaccatatcacaagaaaacattgttttgtaaatagtaggttgttataataaagacaaaagggaactagaaaccctagatgatgaatatctaatagccatgtataatttgaaaaaaaaaatacagctaatgaatgagaattttaattaggaaatggtcatctgcctcatcaaactcattttatataaaatgattaatttattaatataaatcaatctggaaatgacttatgtaaattgtagcctgtatagtagaatcaaatgcagttaggaaagttggctaaattgatacaataaaaatggaaatgagaaagatctcattcataataatattggaaaaaaagtcatgaaatacctaggaatgaatttgctgagaaagactctctgaagagaactataaaattatattgaaggacataaaacaaaacccaaatagatggagagacagaccacgttcctggataggaaaacttaatgttataaaaatgtcacttattttgaaattaacatataaatttaatgcagttccaatcagaatttaagtctttttttcttttggaatacatgaagtgattataaagtatatatggaagaataaacacatgaaaattgcccagaaaatgttgccctactttagtaggcaactttagtaggctgtttgccctactttagtaggctgtttgccctacttgatgttaaaatcttatataaaactactttaaacaagaaaacatagtaccggcctgcagtaaacaaataattctatagaacaaatcgagataatttagcatataattaatgaggccattataagtcagtgaataaattattcattattcagttaatgaaattgagagaactggctgtacttttggaagagattaaaattttatttccagcctggcacagtggctcactcctgtaatcccagcactttgggaggccaagacaggtggatcacctgagctcatgagttcgagaccagcctggccaacatggtgaaaccaacactgtctctactaaaaatacaaaaattatctggctgtggtggttggtgcctataatcccaggtgttggggaggctgaggcaggagaattgcttgaacccagaaggcgaagtttgtagtgagccgagatcacggcattgcactccagcttgggcgacaagagtgaaactttgtctaaattaaaaaaaaaaaaatgtaatggacatttaaaatatttgctgactagggagcaacttttgaatcccttcatatgcttggagaattctccactttataaattctgcctaaggtggaagccggaaatccactttatgagcctctgtgactttggccccaagattaagatgtaccttgtaaactttgattcaggaaagagtgatgagaactaggaggtgctttatggaattaattttgttgagggtggcagaaaagcatacagctgtgggaatcagcaatggaatgacactgggggtttggaaggagtacagtgtcctgtggaacaagatgcatcagagtaggaatattttctccagctttagatccagagagcaactgagtgcttctccttgaaacttttgccatctaatactctttaatacatttattttttgcttaaactagtaggaattagttgtgtttgaaactaagaattttgactgaatgatatggtttggctgtgtccccaccaaatctcatcttgaattgtagttcccattatccccacttttcgtgggagggaccaggtggacataattgaatcgtgagggcagtttcccccatcgtgttctcatgatagtgagttcttgggagatctgatggttttataaggggcttcaccctttgtagcaggaggagctgcagacaagaacccctcagacactgagttgtagaaggaaaggctttattcagctgggagcatcgggagactcatgtctccagaaaccgagctccctgagtgagcaactcctgtcctttttaagggcttacaactctaagggggtccacttgagagggttgtgatcgattgagcaagcagggggtatgtgactgggggctgcatgcaccggtaatcagaacggaacagaacaggacagggattttcacgatgcttttccatacaatgtctgaaatctatagataacacaaggagttaggtcaggggttgatttttaactaccaggcccagggcacggtgctgggctgtctgcctgtggattccatttctgccttttggtctttacttctttttttggaggcagaaattgggcataagacaatatgaggggtggtttcctcccctaccttcactgggacttcttgccactgccatgtgaaggaaatgtttgcttccccgtccatcctgacttttaagtttcctgaggcttcccaagtcatgctgaagtgtgaatcagttaaacctctttcctttataaattacacagtctcggatatgtgtttattagcagtgggagaacggactgatacactgagttacccttataaaaagttaaatggcaaattattaactgggagaagataattataatccaaataacaaacagtgaaaacaactaaagaagaaaaaatatgcaaatgatctaaacaggcaatgcagtgaaggaaaaaaaaatgcaagtagaaagctacataacctcccagataattagaaaaacaataattaaaaaaaagttttaacaaagttgctgaaactaaaaatatcattagtttcagggcttgtgtgaaggtaggaaaataactggtcttacagtgtgttggtggacatgtacaggcttagggccctgtgacctgataatactctacaattaaaacgtgactattcattgatttattagtttcattcataaggacttatctaaaaaataaaaacaaaaacatggggatttaaagatacacaaatgcatccacacataaatacaaacaaggatatttatcacagccctctctggaatagaaaacatctggaaacaactcaagtgaccatcagaaggagaatgatggtgtaaggagtataatgcccacggttgaattctaaagcactgttaaaatagggctgtctgtatcagctttaaagtattttctagatatattattaaaggaaaacatccaatgacaatgtcgtcaccatataaaagattatatgtataatctaagcaaagttaatattatagaagatatacaccaaattgctaatagtgcttatattgtggaggagagattgaatgtgggagggagaaactataaactttatttcagatatttctttatcgtttacatttggcacttttacttttgtaaaccaaatgactatgaaaaatgcatgatagtgaattccataccaccatcacagtttcatctaacagcttgttatttgtaacatggagaggtctgcttattcactttatttttcctgctttaactccttgaggagtgagccacatttccatcagcaacggtgtcccctttaggcagggatactcactcctaggccagctctggtagaaacatcttgattcttcccactcccatgccctctgtaagtttcctgcttctttctcagttttgactttttctcaaagaaagtggatacttatcattaacaatcactgaagcagctcaaagttcagttgtaaaagagaaatctcttgggagaaaaaaaggcccccactctagcttcattgtaaattttcttttgagatggagcttcgctcttgttgcccaggctggagtgcaatggcgtggtctcggctcactgcaaccttcacctcctaggttcaagtgattctgctggctcagcctcccaagtagctgggattacaggcatccaccaccatgcctggctaattttgtatttttttggtagagacggggtttcaccgtgttggtcagacttgtctcaaactcctgacctcaagtgatctgcccgtcttggcctctcaaagtgctgggattacaggcgtgagacaccgtgcctggcccattgtagattttctaaagcatgtataacttccaatttatctctccagactcccacttaatcataagaaggcatataagttcattgttaatttaatgttattactacctacatattagcatgaggttatatttatgacatagccaaggtgggctgttaagatgatgtatgttcacttgatagtacaccgaggtccttccagtaatctaaccacgtggcccattttgtagaacttggagtgtaatctaactatttttttttatgattctggtccctcttcttttgtttttgcagcatttcctatgacacattgtggctttgtctaagattgagcatcttgcttttgtcacttcaaattcctttcaaggaattcaccattccaaggtgaaccacctgtattttcttgaagctgctagacagtccatgtaatttttccatatatctgactgttaggaagcagtcttttatattgagaaagtcattcatttatttctacttttttttgttggctttaggatgacacaaattcaaattcaaattataaatgtttatttctagtgtatagaaacacagttgaattttatgggttgacttggatcctgtgtccatggtaaagtaatttattagttctaataggtttttttgtcagttctttgagattttctatgtagatgatcatgtcatctgcaaataaaaacatttttagttcttccgttctaagttgtatcttgttttttttgcttttccttatggttagctaaaacttctgtgtaatattgactagaagtagtgacagcatacatcctttccttgttcccaatttcaggaagcaaagcattgtcttcaaataatatatagttagttataagttttttgatagatattcttttatttatttatttaatgatatttaagtttgaagttacatgtgaaggtttgttacataggcaagctcatggggtttgttgtacagattattttatcacacatgtgtgaaacccagtacccagtagttatattttctgctcctctccctcctcccaaccttcaccttcaaataggtccaagctttgtgttcataaatcctcattatttagctcccactagaagtcagagcatacagtatttggatttctgttccttcattagtttgctaaggatatattatgcctccacctccatccatgtttccacaaaagacatgatcctgttctttttatggctgcataatattccatggtgtatatgtaccacgttttcttttgccagtttgtcattgatgggcatttaggttgattccatttcattgctatcagaatagtgctgcaatgaacatttgcatgcatgtatctttatgctagaatgatttatattcctgtgggtacaaagccagtaaagggattgctgggttgaatggtagttctgcttttaggaatcgccatattgctttccttaatggttgaaataatttacactcccaccccaacagtgtataagtgttcccttttctctgcaacctcaccagcatctgttaattggtgtgagatggtatctcattttggtttttgatttgcatttctctaatgatcagtgatattgtgctttttgtctatgtgtttatcagctgcatgtatgtcttcttttgaaaagtgtccgttcatgttctttgcccaattttaaatttaaagggtttgtttgtttttctcctataagtgtgtttaagttccttatagatgctggatattatacctttgtcagatgcatagttttcaaatattttctcccattctgtaggttgtctgtttactctgttgatagtttctttttctgtgcagaagctctaaagtttaattagattccacttttcaatttttgctattgttgatattttagtgtctttgtcattaaatttttgcttgttcctatgtccagaatagtattgcctagattgtcttccagggtttttacagttttgggctttacattgaagtctttaattcatcttgaattcatttttgtatatggtgtccaggaggagaccagcttcaatcttctgcatgtggctagccagttatcccagcaccatttattgaatgtggagtcttttccctattgtttgtttttgtcagctttgtcaaagatcagatggtcatacgtgtgtgaccttatttctgggctctctatgctgttccattggtctgtgtgtctgtttttgcaccagtaccatgctgttttggttactgtaatcctgtagtatagtttgaagtcagtaacgttatgcctcttggtttgttccttttgcttaggattgccttggctatttgggctctttttttggtttcatgtgaattttaaaatcgttttttctagttgtgtgaagaatgtttttggtagtttgatatgaatagcattgaatctgtaaattggtttgggctgcatggccattttaatgatattgattcttcctattcatgagcatgggatgtttttccatttgtttgtgtcttctctaatttctttgagcagtgttttgtaattctcattgtagagatctttcgcctctctgattagctgtatgcctagctattttattctttttgtggcaatcatgaatgggattgcttttctgatttggctcttggcttggctgttgtgggtgtataggaatgctagtgatttttgtacatacattttgtatcctgaactttactgaagtttttatcagctgaagaagctttggggcaagttttcaaggggaatgcttcctacttttgcccattcagtataatgctgtctgcaggtttgtcatagatggctcttattattttgaggtatattccttcgatgcctcatttattgagaggttttaatatgaggtctattgaattttatcaaaagccattaccctgtctattgagataatgatgtgggttttgtctttagttctgtgtatgtgatgaatcacatttatttgtttgcatatgttgaaccaacctggcctcctgggatgaagcctactttatcgtggtggattagcttttttatgtgctgctggatttggtttgcaagtattttgttgagggtttttgcatcaatgtttatcagaatatttgcctgctcctttattattgtgtgtttgtgttaagaacacttaatgtaagatctaccctcttagcgaattttaagtataccatacaatattgctatttataggcaggtcttgctttctgaaagtcagttattatatctttgatgtcttttttttctaattggggtgtttgtaccatttacatctattgtaattgttgatatggttgtattcttatctaccaactggctacttgtttcctcataatcctgtctgttctgttttcctttcttcttttcttgccctcctttggattattttgctgttgtttttatgattacattttatctccactcttgctgtttagttatatctcttagaaatttttttatattggggtttctctaagatgtatagtatacataattagcttaccaccatctactttcagatagtattataagattttaccttatagcatgagaaactcacagcagtatacacgcatttttctctctctcagtctttgtgttatgtggtcgtgtattttatttcacatatattgtaaactctacaatctatgttactctgttacctagacatacaattgtctttagaaatgattaaaataagaaaagtatctttagtattcatcttcacttttatcttttctggagtttaccgttaccttgagaagattcaaattttctctttttttcttttccttttttttttttttttttttttgagacagtcttggtctgtcacccaggctggagtgcagtggcacgattttggcttactgcaacctccgcctcccgggttcaagtggttctcctgcctcagcctcccgagtagctgggattacaagcaggcgccaccatgcctggctaatttttgtatttttagtggagacagggtttcactatgttggccaggattgtctcgatctcttgacctcatgatccgcccacctcagcctcccaaagtgctgggactataggcctgagccaccatgcccggcttcaaattttcttcaagcgtcctaactcctttctgaagaaattcctttaacattttgttgtggttttgcttgtgttgctttggcctttggtagtaaattttttcagtttttttttttttggtctaataaaatctttatcttgacatcatttttgaaagatgttttcacaggtataggattctgggttggcagttttttgtttttctttaataccataaagatgttaattgtcttcaggcttacattgtatcttacaaagaagtttgctgtcattcctctcttttttcttcagtatgttgaggtacttttctccccttagtgccttaagccttatgcttttaataaaagagagattcagggaaatgggtgatgattcatgcttgctcccagcagtagctatcatttcttgaataccagcaccactgaaataggttctatcattctccttccataccccccaatttttaccatgagcccctgggggaggccagtgaaaaagcttactaatgagtgaaactcttcctgtctcctggacctttagctttgtaaactaaccctctagtccaaacttggtctttaaaaaaccatgacattttacgtgatttctctctacctatctatacggtggccacttcttcctcctgtgatctgccaaagttaaaaggattcttgtctcctgtctctccttggaattcagtttaggttgctttatgagttcagttcttagatggggtttacaatttcttggctttctctcatcaccaaagtgggaacacttgcaactttctacaccctaaattgttatgactttgaagttgtttaccatctagatgcagttttatgaacagactacgatttgtttatagcccatttaaattagcccaaaataaaaataatccttcagatgaacagagtagagtagttcatatccacagctatatacctgtcagtgtgaattcaacttttactgggtctcaggaattattagatcataatgtatttgcgctcaaagtatctgccaagtcatttttacatattccatcattgctaagccatttgttcccaaccttgcactttgggttgcttttttaatcccctgagcaaagttttatatcattttaaatgatagttttagaactatgtaatctttttatctcaggatctgtatctatataaagtgaactatagaatcaggatctatatctatacaaagagaataatataatcaggatctagaggatcctaatctgtcactcaacagagttgctgtcccttccattagtcattgataaaactattgaataggtcatgactgagtccagagaccattctgcccaaaatagctcctcctaaagttggtatcgattcataaattgatacatttaacttgataaaattcacttaattaatcttgtttttattattatttttggttgtaattctgagttgtgttttttggaggaccacatatatatttttaaatgtttattatatttttattatggcaaaatacacatagcatgaaatttactgtcttaattatgtttaagtgtgcaattcagtggtagtaaatacagtcataatgtgcaatcatcaccatctatctgcactatctactatatttacaaactatatttatttctgcaacaactttgtgcaagaagaaaatggtgtcagctgtacatagtaaagccatgctagctattaatgatcactacttcaacttatagacactttcacaccatcccttaagaatccatagtaatctctacagtttggggagtgtacttgctcgttttttgacaatcatatcataacattgtcttattcttctggcatcattcccattttccacaacttttcaaatgttattttcagtgattttaggtaaacgttctattggtactccagaacaattttagcctgaggcagaaaactggaacacacttggatcatatcacagctattctctgactttctttattcacttttggatttgcaatatttacctatttttgttcctccgttttcaaatggtggctcatctgcattgttagagaaaacaaaaaataaagtgagatggctctgtctttgtcatttcttattatctcttggctccaagaagagcttttagccctgccttggtcttagttgatcaattattagtgtgacgtcaagtttttattttaacagcagtaatcttttataagagttttaagtattataaccttgtttgtgggattactatgtggtgaaaattggagacttcctgtactttaactttttaagaaataaaagagaaactttatggggatatattgatggtaaattgtagtcactagtgcataatattggaagtttagaaaatgaatggtatgtgccaatagcaatcctaggctaacatttcacattcaaattaattgaagcaggcacactttgatttggagtatgttcttttctttttatggtgataatgcctgccagaactttggtctcaaacttaagttcatttctttcaggccagtttcatctgatggaatcagctttactgtctgaagtaggcagacagtagcaggaaagaaaacaccatcaaataatagtgtactacctgtgaggcacttctttctaaaactttaacttcttacttttggaaaagacttgaatgtcttattcctggaaaggaatactatgcttgataaacctaagaagagtttctgggaagttaggatgaggatcaccctaaatttgcactgtggagtgtaaatttcattcaaatacccgcctattttgattctgtgtaagaaagttggtgggccagttcattttcttttggcattatctgtttttggcaggcccagcagtatagctgctaattctactttgacataacacacatcctttattttcttctccaagcctacttctcttctgttcattcaccctatcttgtaggcttaaaatcttgctgggttttcattcttccctcctgtgtgccaacattcaggtgatatccagtcctgagatgtgctccatattattttctttctagtcactagaaactttcgtttgggccttcatttatttttgctggtattaaccttcaacttggattcatatctctgccctgtagttgtgtggccttgaatcacctctttgatccactgtttgtgcatcttagaaatgttgacagtaatattacctcttcataggttgctggaagcgttaagtgagcacagtatgcagactagtaaagattcattgtttgtatcattacctctgccaccataactactacaattgccaacaccttgccaccccatactgcagatccaacctgatgagccatctaatccagcaggggctctaatcagcctcgaaaactgattctaactccttagttaggcacaaatgcccttctcactctcagctccactgacagccacatccctgactacattgaactgttccctatgtctgtatctttgcattgttaactgaaaaatcctatactgaccagcttctacgtttttcctcaagatcatgtcaaaacctctattagcttcctagtatccattcctcctactcctttatatttgtgtttgtgtgtgtgtgtgtgtgtgtgtgtgtgtgtgtgtgtgtgttttcatggctcttgttttcctggaataaagaatacatttcctagaagctgggtatggccatttgactaaattgtgtccagtgttaataagtggatgctgtgcatgtgccttctggaaaatgtcattagatggagggagcatgcccatttttccttattctcctcattttgactgatggctggatcttgagcagccaccttggaccatgaagtggaaggccatattttgaacacagcagtacagcaagatagaaagaacttggatctccatttgccctggcctgctaacctccaggctttttatatgaggaaaagtaaaactcatcaagtttataatgttattttggatttctgctaggtgcagcagaactcagttctaacttatgtaaagacctaggtcaggaggtatccttcatctctgctcccaacataatttgtatactatgaaattatatttcttgtcaaattacatgtctgcattttagtttttccatttgtaaaatgaggatgaaaaatgaaagcctctatctgaggactgttaccatgagtaaatgagataatacatatacaatgcttagagtgagggatcaataaatatatggccttattgtttctgctgctgctgctgctgttagtactcctgtgtcacacattgtacagtgagtgcttcaaaatccaggtctctgtgttactcatctttgtgttccttcccagtgttcacgctcgaatttgacatattgagcagatggtaactaattgtagcctatcaataattttttttaaaaaaaggaatggaacttttcaaaagcatccaagtgtagaatgttttcttattgaggtatgattgacctactaaaaggtgtacatacttaatgtatacacctcggtgagtttgaagataagttcaggaattttaagcaccaagaaaatgcgcttctcagactcttactgagggggaataattgactgatggccccagttgctgtgctctgacccaacagtgcatttatcccagagttgtgctgagcgtggccaatgattgatcatggaggagacactagcgtgggatgcaggactgctcttacatacgtttttaggctctgtgactcttcattggctttgccaaaactctcttagaactacactcctcctaccttcctttctcccacctctccaccacagggatcagccctgcatcttgttctgacaactctctgtcctctgcagctccttccgtattcttcctaacaggtatcacccgtgctccctcccacccataagttacttgaacatctaatcctgtcacggtaagtttctcagaggacacaaactaacacatacaatgatcattattaatgttaatgtggattaatacaggaaccctctttacaggaacttgaatgttgcagtaaattatagtattgtttcaaaatacttgctgtcccttcttgagggaagagtatatatctccatttcactgatgtcagactccttcatgtcacttctcctgcaatgaaatgtgagtggaagtgatgtgtcacttccgggtggaagctttcagagacatcatttggtttgtctcattctctttttctctgccacaaagaccacagagtattgatatggagactgtgccatcaagatagtatgtagcagatgtgtaacatgagtgagggaaagcgggtgtgttgttttggggattatttgttactacagcattaccttggttgagtagactgataaatatgttgatatttaattgcatagagcaatcaactgcaacagaaaaagtctatcttaagagctaaaagctctttcttccatctgaatgaagcacagaaattaagtttcttataaaaataactaataaaacttctaatttcatcatcgaccatatgactgaatcattgttcctctctattgtttaaaattaaaagtctttctccatatggtttacatttgtgtttgtgcttggcattggatcacctacctgacccctctaacttttccttcattacagcagagccatcccactggtcaggggacataatacatagcccagatctttagtttattgtctacacttaccaaagtcaaagttagtggaataggccaggcgtggtggctcacacctgtaatcccagcactttgggaggataaggcaggtgaatcatctgaggtcaggagttcgagaccagcctggccaacatggtgaaacactttctctactaaaaatacaacacttagtccggtgcaatggcatgtgcctgtattcccagttactcgggaggctgagacaggagaatcgcttgaacctgagaggtggaggttgcagtgagccaagatcatgccactgcacttcagcctgggtgacagagtgagactcccactcaaaaaaaataaaaataaaaataaaaaaaaaataaataaaaagttagtggaataaacaactcagttcccctctttacacactcacagccctttcctcactatctagttctttatctgctgcatcagtctttccaaacatcctcagctcttataccctggtggagctaagtgaaacatgagttgctttgccttctcctttaattattctctgacttcatttgcacagatcttctttcattattatgtgagaaggagggcctgaagtcaaggcaaccgagagtggtgcatgctgcgttccacttgagctgtacctttactccatttgaacaatttcaggtgtgtgctcagctcctcccacttttgtagtgggaagaatgcaaagttgctatagttctgtactctatattttgtctgctttttttacaaggtcgtgtagaatgatatactggttcctaagctctttcactgtatccctttaatttcagctaactaactcttgccccttcttcagtataaatcgatttcacttgaatcaataatgccacactgagcactggatattttctctaacatttttgctcattcaataaggcctctgctatgataggtaaaaatttacctacttatgctaggtgagttaaacaattggtgtttttttttttgttttttaaaaaataagtatcagcttaggctaataaatattcttagtttttaggactcatgattaataatccctaactctgatattggttttacacttgatcttagccgaaaggctgagaagcaatgactttgtttttgagatgaaactaattcctctctgcctcaggatgattctattttggtttagttaccacaaggatattagtggttatgatcaatgactatggttataggtgtaacaaagtcaaacagtttcagaattttgtcaatggtggtataatttagaggctcagtgttgcattgaaaccaaacaattagatgatttcgttcatttaagaatgtcaagatccaactttgattttctttgtcatcttgaaggcttggtctgatcaatctcataaatgggatatgggcagagagaaatatacaacctttgaaaggcattttgggttccttgggtgagagtggcatcttattaacaaaagaatgttaaatgttaaacataaatgtttatagtaggtctgaaactatccctgttactgggagcttctaatgctaataatgttagttactgtaaaaattctctcaaaattagataaaagcaacctgaactcatcccatgactatactctgggttgtgtcaatgaaaggagcctctgctttattttgcctgccttttagggaaagaaaaagccatggcacttactctctgtgtctttgtaggtatcgtttgaccatataagaatacagcaaggagggatatttgcaagacatcttaatgtctgtaaatggatttcttccaggaacattagcaagtaatgtctttaatgtctttaaactacttgaaagaggtattatgttaaagatctttaactcctcaaaatatcctcaacgtttattttatgtggttaaaaacacctttggctagtattgcatctctttttcctcctatttaaagttagctatattaacagtgttttcatttagtttctaaaaacgattctgttttcatagattttatgctggaaataacattctaggaagtcttttgaaatctgaagttatacattcaaatatgattttgtaatctttttctttttttttttttttttgagatgaagtcttactgtcgctcaggttggtgtgcagtggcacgatcttggctcactacaacctccgcctcccaggttcaagcaattctcctgcctcagcctcccaagtagctgagactacaggcgcatgccatcacatctggctaattttttatttttagtagagatggggtttcaccatgctggccaggctggtctcttaactcctgtccttaagtgatcctcccgccttggcctcccaaagtgctgggattacaggcatgagccaccacacccggcctgtaatttatttttctaaatttaatgtctgtcaattgtccacctgtcttttttcttctcttttgcaaaatgtatttgggtgctatttttagccttatttgaccgttccaccagattttccagatgagtgaaagtacttgttctgaacggtattccgtggagtttccttggatccttaaaacccatatagtggccgggtgcagtggctcacgcctgtaatcccaggccgaggaaggctaatcacctgaggtcaggagtttgagaccagcctggccaacatggcaaaaccccgtctccactaaaagtacaaaaattaaccgggcctggtggcgggcacctgtaatcccagctactcgcgaggctgaggcaagagaattgcttgaacctgggagccagaggttgcagtgagccgagatcacactactacactccagcctgggtgacaagagcgagactccatctaaaaagaaaaaaaaaagaaaaaaaaccattgaagttagagaaaaatgctaaataatcagattgaaagtaatactctcaaccctatggatggcttctagtgctttataattaaggtcatctagtagtagttgctacaataaggttttggaattgagtcttggtgtataaactgattgtaaacattcaccatggaacacagagacacatttttaagcaggcgttattcttccaaatgaattttgtcctttggagtggtcacatggtaagaatgtgcacagagtccaacagtgttaccattgcttaaacatttttggatctccttgggattgtcttcagagtctctaagccacagaaaaaagttaatcttgtccttttagttatacctcatttttgacccctatgagtatccccaagcctgatcatctactttatttgtacatcttggctcttaattattattattatttttttttttagtattcagccaacacagctttaaagaacaggggtcttctgccatttatgttttaaacctcaaagttaactccaaaagggaaagatccaaaaacaatgtgactcaaagacaacttactggaaaaagcatgcaattccctgagcagattatcttgcaagtgagaacgtgcgtttggatgtaaatctgcaatgttgggaaaatcaatcacattgtgttctaccgttatagagggaaaactaagtataggctttagagcctttcaggttagttcaaaaagagctccactacttaccatgtggtatcaggtgtctttttgaaccagcatttccttagctttgaaacagaagtgtgatagcagtctcagagactagattaagaactagtgataattcattgcaatgcctgggatcacgccaggctcaataaatggcacatatatgatgttaatgttatcacaatatctgtacgtagttcacagaacagtttatttagctgttgataatagctgtgttattgaatatccttacattatagaagtatgtagatgtatgatgaagtttcatgaaaggttttacaaagggccagacctgactattactgattgctcaaaaggttttgaaggaaaggcactgatagcaatgaccatattgagaaaaggtctgcagagatagttaaattaacatagcagatccaaccaggttggctatagggtttctattcagaatgcaaactcgcgttatgaattatcctcttcctttggagaatagcagcactctacaaagttcattatcataactcatagggtttgtaattttactgtttgggttaggagtttttggttttaactaaaaaaacacggagacaattactaaatttagagctataacagaatccttcctccccctaaaattgggttagaatttagcccaatctctcctaatcacaaaaacgcaactgataattatctcaggcaattctgatattttgccatctgtggattttagtgtttccctgtgttatcagaaagagttaagaagttgtcttagtgaactggaaaattgttgtttgacctgataaactcacagcatttcttccagctagatcattaagattccaggactgacctcaagaagaccctctggaattcacagcactgcagacatgtcagtggtcagtctgtgttatgtgaatgaacctgatatcaacagagtttcccccaagacctccttgaactgccacaggcgaggtcaaatagattatctgcatttattttggaatccaaactaaatcagcaatcagatgaataatgtatcagttgtagtgcctggaatgggatgccaactccctaaaaaatgccactgagccaaaatacactttatcttcaaaatgttatgttttatcgtactcatatattaattgaaagtatttttgctgtagttgaacttttagaatcagatttctttttatgaaatatacttgtatcccctgactgttaagaaatcctgtaatgcaaggttttgtcctgaatctaggcattatctgaaataaataatggaaggtgtacaacttactgtctgataaactttaacaaataacacaatcttgtatcatctaatttcttctagatatactggaacaaagtgttggccttttgaaggcctgaaaaggctgttgaattgcttccattcaccatttcaatgagcttacataagtctcagctaattttatctacttactgaactgagatataatgtcttattttgcatggattgggaagaaatgcgcagcaggaaagctattgaccatgtggctttgccctctctcagggggcttccattcccaccactgatcacagatttgttggattaaatacctgctaatatgcggtttataaaattccccttctctaggttctgagcagtctatcatcttactaaggatgcaatttgaaagattctgaatgtagtttgaacgcttttaataggaccattcattttatcattccctggtttgagttagatttctttcgacaccgaagagaaggactgtataattgtgttattccttaattatttttcttctctttttgagtgatagaaattggccgctacaatgaagtctggaagtggcatcataagaacacaaagcaacattaatggagacagggtcattgtaggtagagttctcactgctttcaactaactgctgtatgtgctctccataaatcatgtcctccatatcattgataacctctaaattacatcagtcccgcttcctggatctcctctcccgatctggaattaaactgccctgcttaggcctcattttttctttattaggtgttaactgcctccagtgtcctctccttaaaaccattcaccaacttggctgggggtggctcacgcctgtaattatccggggggcccttttcagctctaaaattctatctaaaccatctttgtagatgttttttaagtaatgagttggtttaaaagtgaacaagggaagactgataaatttttctttttcacttttctgctgtcatatccgattggctaaaagtttttcttgacctgactttttgatctttaaaatgcagcagggtattgatgccaaggttttcactggactttgtaatttgagaagcagaaaatatggttatgcctttcaaaaacatctgcaaaggtttttgtttttgtattttttaaaatcttactcaagcttttcaaaacaataactttctggttcttagtggctatctcagacagttttacggaaaatatttcttacagagacagaaaggattcccacccagttaaatgtttcatcttctgtgatttgccctgcaaggagctcatctgtgtgttgagagggcatctagctttgggctccaattacaagagcagggccataggtggccatgctgcagggcactgctgttcagagggggctggccaaggaaaacactttcttgagcatttgaagcagaagatgaaacagatggtttttagctaggaaagcactcatgaacgtgtccccaagtaaatgttccatatgttaaatcctgactgcagtggaagcagcttgtcattaagtatgctacctgggaaatctccagtcaaacactccatacctgccattttatattctttgattggaaagccacacattaaatatggttctcaactttaaaagcagcactttctaatgcagacattaagtgcttgtggtaaaaatggaaatacaaacaaacctctttcatgttggctgaatcatcatcgttcttattatcatcaatagcaataggaaaaatttatatctcaccagtaaccctgctgttctttttggggtagagaagtagttatgaaatttaattcctgtcttcaagaaatttctaggctgggcgcagtggctcacgccggaaatcccaacactttgggaggccaaggcgggcagatctcttgaggacaggagttagagaccagtcgggttaacatggtgaaaccctgtctctactaaaacaaaaattagctgggcgtgatggagtgtgcctgtactcccagctactcaggaggctgaggcaggataattgctcgaacccaggaagtggaggttgcagtaagccaagatcgcaccattgcactccagcctgggcatcgcagcaacactccaaaaaagaaagaaagagagagagagagagaaagaaaggaaggaagaaaggaaagaaggagaaaaggagggagggagggaaggaaaggaaggaaggaaggaaggaaatttctagacaggagagaaactgaacatgtcaacagaagttgtaaaaggtgtgagcactaactgtaatttctcagtgaaatcttttttagtttggggagaattttattaaaatcattgatcagagtcagaaacaaagtttttcaataaaataacatgtctcaggatatatcttaggctaccgtgtgtatttagtttctgaaccaccaccctagtcagccatttaaaaaatactaacattagtggtggaggtaaaggatagtggtaaattgtgaatttctggtctttttaaggtctgattattaccctaacccctctttttctatagcttcatgtcctaaaaaaggtgacacctttcttaaaccacctttcaccttcctaagaaagggcacctttcagccggaacattacgtttgtcaacttctctgcaatgtcttgaccaagaatggaacactctgactttgtttcccatatgtccttctgtctcctgcatgggaaatgaagctgtctttgctgcctctgctgagggcccctctgagttggccaagggaggctggagggatatacatcacattacaaccttcatactgccaagttctagttagtttctgcaatgtatgtgaaacctccaaagcaaacagagagagaggaaatcaaaattaaattaatcctctccaaggataaataaagtatgcatgtgttcctcttgagctgacagggtggaaatcagaaagacccctttgcttgggattcggtgatactgatgttcagatttctgactcttcagcccagaaaacagaagtgctgtatagagctacaaaaatcttaaattgcttaccggtgtcatatatgtaagaaagcatgccttgatagttgagatttgtggacatcttcaagatggtgtatgtgggttagcaatagaaagctgtcctgtgaaaacagctgttgtcttgagagaaatcaaactctttctttgatcgcatgatcttatcacagtttggctgtgtccccacctaaatctcatcttgaattgtagctcctataattcccacatgttgtaggagggacttggtgggagataattgaatcatgggactggtttcccccatactgttctcatggtagtgaataagtctcatgagatctgatgtttttataagggatttcccttttctcttgacgctctcattctctcttgtctgccgccatgtaagacatgctttctgtctttcaccatgattatgaggcctccttggccatgtggaactgggagtccattaaatctctttctctatataaattatccagtctcagatgtgcccttatcagtactgtgaaaatggactaatacaaatgtcgaagaacaaaagtgcatttgaatatcataaaatttcaggcagctacaaagggctttgatttctagtcttcatttttatgaattaacaaaattggagcagaggaggaaacccagcttttctgcagactctctgccaccacacagctgaaaattgcattgtctctttcaattttgatgatcacctgaaatgattctgactagcatcctgactctagttttttgatcaacctctgccagggcattatagacaaaccccagctatctacgcctctgctgggagaagctgagttatttttgaccagcttacttgaaacttggttgttttttcaacaatcctccctgaaagacaagaccaaagaaaaacctcatttggttttactcagtgctgataaaatgctctctatgttgaaacctaatttaacagcgaatgggctttaatgaatcgtgcttttgccttccagctgcaatgcttcttgacatccttatttcagatgtgattacgatccttatttatgttttctcagtttgtttattgactaagttacataccacacaccatcctggtgactttgctgagagactgtctctacattaatttacatttggggactattagcagccataatatgcttcattgtttttttttttttttttttcagaatggtgtctctcacacactcaaatagacatgccaaaatgtatttgttgactaaagttgtggaaaattacatttttccttaaaaagaacagtaaatactggagtaccccccaaaaaatatctactgaaatattcccctcaagcattgaatgacatttttaggtggtaacagccgactggctccctgtttgtggtgaagtcatggagaactttgtactagtccatatagaataagagttagtcaatcacatctaacaattcagccatgggaaaaaatgagataatgataacactaagacatgagtaaaaaatagacatttgtaccatttatggaattgagaggcaaaggaggtaggtttatttccatttcataaacatttggccaaattttctctctaaatggttgctggagcaaaaggttagatcaccaaagttaagacgtgacacaagttttaattgagcttttgtcaatgaaacaagtatctacattcagaattcaatgcagtttttttccagtcctttacatactcacttctgcaaatcattaaaaccactgaaggcaaggatgttgctaccttacatggtgttttcatgtacattgaaaaaggcagctcttcccaaagacattttattttcaattttcagaaaattattctaagtatcatttgttagaaaaataaacctcactgggaatttttgggtaaaattcttttagtatataagaaggtgctaaagttataatcaaaaacagatgtcttacatgtgagttgagcccctgagatttgctgcacttttgcaatgtgcaacctgaataactatactgggcagctatttcaggggagaaattattctaggagttgtaaatttatctagtttcaccttcctgacttataaccaaatagagaggaaagaaccaggtttaaataaatgacttggccttttatcagttggttaagtgtttggatgtcagtaggctattaattaacatacccatagtaggggaaaacaactgtaaagatgagatgtcagccagaaataattaggcagataattggtgttccataaatggttgctgaagcccagttacgtcatgagtgtgagccagctttaatctatggcaataacatgactccaaatgtgtgaatttctgaaaaaagttttaggatgccaatgtattatgttgttcaattttatttgttgctcattagctactttgacattgtgctaagtgccttctctcttcataaatggccataataattccatgtgggttatggctttaattattctcactgcctaaatgaggaaagtgaagcttagagcaggatggagacactacttcaatgctgacctctaagttcatgccattgatgagcatgtaaattacaaaatgatgactatctttttagtataccagcaagaatcagtatggaaaatataattattaaaagacacaaacaaatgagtgtgcataacatttaagaacagatatgtcaagaaatatacagatcatgtgtagaacatgacagatctggtaggtatataaactgctttaacctttctggaggacaatttgacaactagtgtcaaaagcttcataaaaaggcataccttctaattttcaacctcaatgtgaggaattcatccaaagtgtgtaattagaaagttagcaaagatttccttacatgtttattaactttagaattatgctgataatgtcaacaacacaattggaaataacctgtatactcatcagtaggggactttgttaataaagaaaagtatatttataagcagctttaaaaatgttgtcatagaagaaacactctgttgaaaaatgttctcaacatattgaaaagtgtataaagggcataactgaaaatgtatgattacagatttgtcaaattagatgtttatttatattctcacatgcatagattagagaaaagactagaatggtttatataaacctgttagtagtatttaccagtgggagggacaatcatgggtgacctgttttttcttttctgcttttaggtatgtgttctatttttataacaaaactgcttttatttagaaaaactgtacttttagtcagataaaagaagtttcaaaaatgtggatttaatacagccatctatactttgattagatttgaaccaaatataaaggtgggttaatgctggttttgattttttgtttatctcatttgtacatttcctttttgcctttgttaggaaataggaatacgtcaaataagaacataaggaaatggaattttattttttgaagagtggaacataattggtgttacctaggcaggatgactttttacaaggaatacaacatctctagtttgtttcatttagtttagattcatgtaaacacagcgtgtcattcaccaggataattcaggtctgcgttagtcagaatacactaatggttataacacacaccagcaatatcagccacttaatatactaaatgttgattgatcaattgtatcatagaccaaggtggtcagaggcagggtgggggacagaagagaggaggggagctctgctccattgtgtcatttagacattgggaacccaggctttatccatcataggtgaacttgtggcctgcaaaattgccacagaataagaagagatactgtcgaggttccttcgagggaaataattgccaggtgtgaatggcctccctcacctctgttcacattccattggccagatctcaatcacgtgaccttactaacacatcactgcaagagaggctaggaaatgtggccttagggtgtatccaggaggaaaacaggttgggtgaacatacaacattcatcactaccacttccacctaacataacatcttacagagacaaaaatattttttgtctttataaagaatggtatttcaatatttgattttattttggtaaataaaaatattttaaattttctttattttaaattttctttatttcagcttttaagttttattctaaattacttgcttaatactttatttttatagcacattgttctaaaatctttatatccaggtaaaaaagtccagctgtattgatcaaggagtaattgatgcctaaatgataacacatttcctcaatagaattcccaaagggctcttggttaaggggaaagctgcttacaactacatgtgtgtgcaggctgcatcttaactgatggaatcagcctgttgccacatggcttctgaagtatttatgtctgattggaaactcttcagcttgtatcagatgctggaaaaatactttattgtctgagattttctgtttgtcgaagatgacagtaaaaaagtttgagcatgcaatcacctgttctcatttttcacatacagagctttaggtaatgtccagtcataataaataaactgtagccctaattatcccctgtaatgtttacaaaagctaagggaaggtggtacatagaataagagagggagatgagagctgaaggtgtattgcttattcatttgaaatggagggaggatgtttccatttcaaatgcagaattaattaatcaaccacagcttcggggcaactagaagtagtctctggagacctaaaacttgtcttgtgtgtttattcaagccctcaactcccaggaaattgtttattgttatttttaattaatcagctaaaaatgtgtgtttaaaatgttgtgagtatatttagattctcttgggtcatgtggctttattctaggaattttgtgggaaagtgaggctggactgtatgagggctgagcagggaccaggacccgtgtcagggagtcacctaaccctgctggggctgtgctctccgtcacccccaggcggagctctgccaagatttctgcctaagtcttcttgatacactgcatctggccctaggtcccatgagtaagttcccctttaaggagatataaaccatgtattctgggacatcataaagagggtggaaattttaatgtatctaggaagaaaggaaatttatttcacaatagacttcctcttcaaagcatatctgtaaaaaggcagccacagcaatgacacgtaatgctccccacccctctactcctgggggaggcccggaccttaagagagctaagtagtttagaccttggaaaatgacccttctctttagtaatccaagttagagcaaaaattgttcagcacataatattactgaaatccttccctttaatgatatttctgtggttcatagatgggaaatgggaagtagaagtttatcacttctttcacgttccccctatatgtttggattcctttcatgtccttaaatttccatttcctagtatgaaaaatgaagattatgtgtgttgcctctcaaggactatatatagagagtaaaatttaatcatacaaaggccttttaaaaattaaattattttaataattttcccacattgattgagatgattatttagataaatttcaatatggtttaaattctaattttaacatgctcccattagtgcatctacccacctgctcatccatttctcctttcatccacccattcacttctcaaacagtaattgctgatatatggtcctcattagtcatttgtgcaaatttatgaaggtacgtgaacgaacaagcctacgcacctgctctcaacgaacttaggaatgatctggtaaaggaggaaagtgaatattataatatgatacatgacatgagaaaggtgtgtgcacggtatctaggtaagaggtatgtggtccatctacctctgtagggtatgggggacacatagatttggatgatttgggtattaaagggtaaataggagtattgcaggcagacagcaagaccaattttaggaaaatgaatcagcagtgggaaaatgtgttaggcagaataatggcccccaagaatgtgcatgtcctgcttcctagaatatttgaatgtgttatcttaccaggcaaaagagactttgcagatgtgattacagatcttgagatacagagattggccttggattatccaggtaaatccagtgtaatcactggtgtccttataagagcaaaggagaagagtcagagtcagaatccaagaaagatatgtacaatgcaaagagttgtcaaagtcagagataggctcattggaaaatgctttgcttctagctttaaaaatggagaaggggctacaagtcaacaaatgcaagtggtctccagaagtgcaaaatgtcaaggaaatggattctctgctagagcctccagcaggaactcagtagaaagttagagaaaatgagaagacacttctgccctcagaaatggtaccatgtaatgtcaaataatcatgtgctagttaaagcagaaataaccactatatgttgctggggagaaaatttttgaaattcttcacatattccattcgtaggactaagcatttctctgaataaagaggattttttttttctgcttgtgacatttagtaagtcggatccctgcttatctaaaattttacctgatagtagtgtccatctacctgatagacagaagtatctctttcacaacagaattgcctttttcttgagcaggaacaaacagtgaaactcatgaatgtagttggggcaataatttttccaaattctttattatgttcatagtgtgaatatacgctgggatgcagtctttgaacatgatattaagcacctaaaatataccaatgcatcttgcagatgcttttcgaatacaggatttgtatagagggtgtataataaaggacttggaagcaactgcagttactccagtggaatggaagtgatctcaagattgtatgagggagcagaaaaccataggcaacacctcaaaacccacagaggaaagagttttacctgaaagacatggggagactatttcaggtgaaatgaatggaacctagtatagttcagatgtgaaaaagaaatatgtgtaggggatggtggaatattccatctatttctacaatactggcaaaatataaaggctgatgggaggctgcagagaaaagtgtaggttttttaagacaggcagaactgagttcaggtcccagctttgctccttaccatgtgtataactttatgccacttcactgaaccttactgtgctttagttgtcatctgtaaaatggggtagcaatgccttcctcacagtgttgtcagttaccaggattcagtgaaagaatagatgtatagagcttagcagtatgcctggcacacaggaaactcttaataaacttagttattattatgagaacctactgcattacaacttggagtgtcttactatgatctcttctcaaatctgcagtcaccaacctggtctttgaattaactagctgaaggcagagcagatacacaaacatagaacaacagtcccggggggagacaagctccagtaaggccctgttgccccttttgccatagagcagcaaccaggtgtggtttttcagaaatgcctttatgagaggtttggacttcagggtctatgcacttgatgtactgaaacctccactggatgctagttccaaatgcatccagttagctgtctggataactttgtttactattcatctggtcactctcaggcctttaaatcctgggcaatttcacccagacttgctgtcctgcacttgttttgtaaatgggatcgacttcattgaggtccttcaggatcataaaggaataaatttatctttttgtttcgttgttcattgtgtatttagatttagaaagccctgcatttggtagagcacattcctttacatgattaactgttgttaaattaatttgacagcacttaagtaatctagcctcacactaagtaggctccatatcaaaccaagcagtcttcctgatccctctatctgaatcaccccatcttgtttggaaaccctcttatctgagttagggacttattcccactctacttgtgttccttcttattcctgaacctttctctctgtatagccctgaacaaaatatagtggccctctagggatattattttaattgctgcattttatccaagacttaaaacatacataattagaaagaaacctcaatttatataattttcaatgtaatttagaaggtgaaatggactgtttttgttcctgtatctttagttactagatttttaatagcttggaagtgcagtgatgcttgaaaatataactttttggaaggaaaatgtaccagaaattgtgaccttcttaagtttcaatggattggaccactgagccaagaagtatgctgaccacccacaggggcttcaagcatggtgcagtgattgtcaaacgcctggccgaggctagttagaattaagtgaagacaatctctatctgggccagagaaattctagaacccgtcttgtgggtttaacatctatgtagtgtttcaagcaaacccatccccatatcctgaactcaagggctggcaggttgtggatcctacatatttaagaccactttgtcttctcccataataaagttttctcctgctcccattaaaaagcattacaagtgaaaacatttgaggaaatcacaactccaagccttgctggattagaataagtggttataataacaaaacccctttataggaaaccctatatttggggaatcgtcagaaatccacatggctgattgtaattcaaaagccctgagaataactactgccttttccttttcagacatctgagcttaactcttggcatcctggtagtagttttacagaatccaaattgtggcagcagtgaaagacatttgaggtgggagccttttgagctcactccccacttagaacctgcccctgttcctttcacacctttgttctccatcaaagaggcccacatgcactcactgttcccaatgagtgctaattcgaaatgcagttagtgctctgggagaagagaagtggataatgatcatttcatagagctgtaggaccttttgcattagttataataacaataactaccattgttctcaactggtgtagcactgccctcaaggctgtgagaattcagcgggaaatgggaagggatgctaatgacatgcaaggcatagaacagtcctgcacagtgaggacagtgaggaaatgcttctgttccacttgacattgcagctcactggacatccttgtagatttaaaaaataagatcagtagttatttgggtctcaagtctagcacccgtgtctatgtaaataggtattttttgcacagactgaatatgtattaaattttccaagaatgaaactagcatgtgcattgagggatgatagtactaagaattggagcttttcgaggaactgttcactatctcagtcacatcatggtggccatgttgcttgtgatgtaacaggcagcgactctgcatgtgtatacctgcatttgcagcttctaccttcagagcaaagcatgcaactagactagcgattgcatcttcctggatagaagagcctaaccaattacatatttaaatgtataacattttaatataatttacttttcttctatttctctttttttacacaaggcattatatgatttcttttgaaattatatatgtcggttattatctttgaatcacattttaggatactaaaggggacacgaccagacatttgttacaaaacaggagtgttgggttccattggggatgggaaccattgattaagtgcttatcatagctccagtacaaagataagggtattacgattaattcctagtcaccataggtggtacgtagtattatcccaatttataaatttagaagactgaggtttgcttagtgagtgtcaaaaacatttctggatttgggaactggcattcctacatgtgtaggtctagtaactcagaccattcacttagccatccggtaacacaaaccattctcttaaccatctggtaactccaaccattctcttaaccatctagtaactcaaaccatgctcttgaccactccatggtcgcctccagtcaggccatgttcttgtcccatttgaaaagtacctagtctatatccgagggctctccaggtagatcagccagcacttgcctataaatgccccacttgaggaaacatgaatgggaaacttgggcaatagtgttgtgtccccaaggctgaaggtttctgaccatcagcaagaccagaacatgcctggtttcctcttgtaataacattcaaagccagatgacagtggggctgactccgtaacccagtatgtttatgtaggcagtgcctgagagttttgtttaatgatgtactaatagggctgacaaggctcagaaagatcaccacacagaggggtgggagaggaggaaccctctagaatccatactgggtaattggttcagaaagaaaggtcctttccatcctcaactaccaaagacagagccagtgaatcaggcctcgtcctccatctccccagagttgtgagaccatgggcaggacatcaccaccatctgcttccccctgccctggcacctagcgggaactccaacggtgcacgtcatgggcaatgcgacagctcctattgctgcttgctgagctggcctgcatgtcacactgacattgaggagttttcttccttcttgttccaactcttttctctgttctaaatattattcacctcttgctgcttgtcatcagtttattttcagttttttttttttttttagaaaaatgcacaaggtaatgttttccagtgtgataaaaggagaaaatgatgtgtgatttctacctccttaggttatataataggtcttgatgcagggcttcttgggatgtccaggttcactgtctcttaagtatttcattaagcatctaaaaccagtatcagtgggatgacatgtaaaaatagctgctacctgcggtgtacacattttgtttcaggcactgtgttcctcctcttatctgctgttgaccttgggcaagatatttaccaactgtgtgcctcagtttcttatctataaaatagaaaaataataatagtgcctcaaaaggtaggttgcactggttaactaagataaacaaaaacacttagaataatacctaacacatagtaaatgctcaataaattgaacttgtagaagtagtagtggttgtacaagtaaattaatcagagttgctcacaacagtcttttaaaattttgcagatgaggaaactgtctaaaagaacttaaatggctgtcccattcaactaataatgaatataactgaatccaggtttgtccaaaccagggattctcaaccttggcttaacagaaattttgatcttcataattctttatggtggggagctgtgctgtgcattgtaagatgttttgcagcatctttggcttttaccctctacacgccaattgcacaccccaagtataacaaccaaaaatatctccagacatttccacatatccccagggatgagagttatgtgcaaaattgtttcttgttgagaaccactggtgtaaaccaatagttttctgccctttttgctatcctcattatgtaggaagatccttttctatatttttttaaacaaatgagctaagtaatgaggcatttcttcatgttagaaaacaagcttttgctttccaactttcaaaactcagcagttacttaaaataatcagttttatgggtataaccaaaacccaattcaattaaaataaataatccccagctaggaaactgtccctttggtcaatgattagaataaatatacattgttcttcaaaattctccagttaacactatagatttgtgaaagcagtcctgacgaaatattttttttaattttatttttagttgacacatagtaattttacatatttatgggctacagtatgatgtttcagtacatgtatactttgtataatgatcaaatcagggaattatattcatcgcctcaaatatttatcatttctttgtggtgagaacattcaaaatactccattgtagctattgtgaaatatacaatacattattgttaacaatagatccccagaacttatttcttctatcttactctaattctcaacgtggatgaacctagaggacattatgttaagtgaaataagccaaacagaaaaggataaatattgaatgatctcacccatatgtgaaatctgaaatagtggatctcttggaagcagagagtagaatgatggttaccagaggctgggaatgttgtgggggtggaggatggggacagattggtaggtcaacagatgctggattcttcagtgtgtgagccacagggagttcagtactgctgtaattgtaggaatggatttagaggttagaggaaaatgagttgttttctgtgcttggagtgttatcagtttttgaggatgttggcactctaagttaagggaaaggatgcccttttcatcttcacttaaaatactcagtttgtactttgaaaagtggaatgtttcctgtatgtgacatggctttcccatccctcttaatgagctttcctatctgttggtgtcacccttttcctgccacctggcccccaggatgataacctagggtgacaactgacttctgttcttgtcagtattgaggcactggagtgcacatcccgcttgatgggcaggtttccccaccacctttcatcaggacatcacatagcagacacaccaagggttggcctagcatcactgagtggtattccttgcctttaaagcgaaaatcatgaatcaacttgatgtttcatgtaattgcatccaacagtgagaacagaccaattttcatattcggacctttgcatctaaagctcgaatgatgcccattccggttgctcttccaagcctttgctctaaagtgctaacctgccgtcatttggctctttctcctgccctccctttcctgttgtaggcaaccagtgcagttgttttctctgatgggttttcctgttgctttggaggttactccacccaagaggatctaggtgctgctcagtgtacttctggggctgacgttttcctctgatgcctgttaccttttgcccacttttcttcttttgagtgtatttaaattccaagcaccgtcacagcaggggagaagatttctttgagtctagctgttatgatttaccccagagtgttaagatcactgacagatgttggcctggcctaattctctttagcctgactcagagaaatctaaagatttccttatcatttcatcatcttctgagatgaagtcgactgagaaaagggaagtctggaaagtcaatggtaccttcaaggatggaacctatgcacagggactcccgcatcgctggatttggatggtagaagcacagttcagatgagaggtggctggtttagggttctgataaacagcaatcatataagactggtgtgtggtgaggtaggactttggttctgggaatgtgccgtggctgagcgtctgctgtggatatggcagagactctgcaggccatgatggggtgagagccagggccagagaatggaagtgagagcctgagccctcagagtaggctgcctcgattggaatccggggtcacttctcttttctaattgaaagatcctaccagctgttgaatccctctatgcctcagtttcctgctctgtaaaatgggaataataagagtacctacttcatagagatgggaattaactgaggtaatgcatttaagttacttggaatagtgattggcacccaataatactaagtattagcccttgttattagcaaaactacaaaaaggctacaaaaagtggacctttctaatcacattgactgcccattctccccacttaaacactaacatctgcagcggactttggcccattctgtatctccctctgttgtcttttacaagctattcatttaatatctttgcttgcctctcagtttttctcttagatgaatgtcatggcactgttaagcctgttctcctgaattaactggaaaagccagtaaactttcctatcccctttattctgatgatagagtttttacccctggccatagaagtggggacttcatccaggcctgatccgaaatggccatcaggctgcaaataaaggtgttccaaagatcgtgcaaatgatcttggggtcacagctcttctaggggttgttattcgtacatagggctaaaaatgttctttctgctggagttgctaagcgggtggtgcctacatgaagtctgctctcagccatccaagcaagtgaggctgaaaacagatgtaagaagatgtgaagaatgaggaagggagagagtggtgactatggtgagtgctggctcctccttcatttctgtcactcaccacccatccttcctagactcattccctttctgcttagtcctattcggattgggccctgagcctctgaaccagttggagtaatgctgcttaaacaaaacaatgagttccatcaggaccagacagtgatgggattttactcatttctatgatgcctgtgccttgcctagtgccaagcttggtcagaggaacgatgtggtctacatttggagaagtagagctccaaatgtcagagctagaactgccttctcatggggtcttactttggcaagtgacttgggccaaaaagcatctccttatctcctgtgagctgtctgcctggaatttgcagagcctggaccactggaatgggcgatggtggatgccaccagatgcgagacttacagacagcccaaagccctctggacactgcccccttctcttattcccacaggcacaagctcccccgggtgcctgggaggactcttttcttttggaaatattggacaggatccatattcccttattcccttgcttccttttaactttcttttaaaaagtggcttccctgtgatacaggcggtgggccgggaagtgctgtgtagagaagtgcagggtctctggcaagggctccaccctcaggcctgtgcccatggacctaagtgagaataggcactcttgttttcatgcccaaatgttgcattttccaagaccactctggcccgccatgtcccccatcctgtgccagtaaaaaccccaagaccctagcggacacacgcataagcagctggacatcaagaggaacacactggcagaagaacacaccgacagatgctggaaggccatcagtggtggaacgacgcagatgctgagggaaatttggcagagggtggttggagaagagcctggccgctgagcagcccgactccagggtaagaccaccttcccactccatcccccttctggctccccatccatctgctgagtgctacttccaccattcaataaaaccttgcactcattctccaagcccacgtgtgatccaatttttccggtacactagggcaagaacccaggatactgaaagccctctgtcgttacaataaggcagagagcctaattgaactgattaacacaagctgcctggggacggtaagctgaaagaacacactgtaacacatgcccactgggctttgggagctgtaaacactcaaccctagacgctgctgtggggtcggagcccgtactccccatgacatgcctgtctgcatgcttcctctaggggtctgagtaatggtgcaccaaagacacaagcctcacccttgttgcatgtcctgcaaagggataagggaaaactcctcccatttcacctgtgcataagtgtaggtcttcttttgacttttcataaacttacattcctttattttgtcttagccttgttataactagcaaagcaggtggggcagttaacaccagtgttaatacagatgcttagcgaaaaaaggtcaaattcctgggcttcctttgtccctagcctgacacagggttgaaggtaatgacaatgctgagatgtgagtggcctaagaagacaagatgcatgtaagtgtcctctgtaccttataaatagattttactagaaagtgttttaatcctttaactagaccttggaagtcagcttccaggagcacaaaacagatcttttcccaaataggtacaggctgccctcgaggaatagctgtaggacacaggaatataagctattctgtcattttgacacctctgtcattttgacacctttattaatgtgccatggtaggaaatgaaataacctattcatacgtgcttcagctaagcctggaatatacatttttaaggcaggagctggggaggaggttgagtggaaaaaaacaaaaagctaaagggaacaaaaaaaagattctggatggactttgcaaccataaatggtaaaactaaccctgttccactgccagctagaagaacagccgagtaaggttttgatttacaggaacagctcagcaagggccttgtagagagcttcatgcctgctataaaaatgtgattagctataaaacagagagctttaacaagagcatttaagcataggcaacagacctgctcaaaaataaacaaaaacagatattgctgcctgagtgtctaacccaacttcataaagatcaggattaggagaatttttttaggcttgtgatataattaataactttttacttttagagtcaaaagaaaggaaaaggaaagatgaccttgaactttgcaaatgacttcagtctgcctctcctctaagcctctctcttcagcttgtgcagttctaaagcatgaataggaatcctcccccaaaacagctccctgtgtcagaccctccctggacaccaaggatggaaggaaatagaagccagcaggcgtccagggcctcaggaggggaaagtgtttaaagctccaagtctcccagccccctgccctgggcagtccctcactgcttgctctgtgacaagtctgcactaataaccctgcactgggaaggtctgtggccagagcctcacccagttcccatcgacagtccttttgaaaacaagtgccccttctaagttagtctgaagaggtccattggctggatatggaaaaaggaactaaaatgctgcacatctgttaatcactggggtaatttcttagtgattagtcacaacagccgtgatctatggatttctccctgtgtgtcagtcaccatgcagaggactttatacggattatctctgtatcttccaacaaactctctgaagtaggctttattatctccattttatagtggggagagagcatacccagaaagattatcatacaacacatgaaagttagagttgggattcaaccctggcctgtctgaatccagagatcaagcttttaacccctatgccaagaaagtggttgtactgaaaaaacactcaggttcgagagctgagttctcctgtttctagctgcagttgctttctctgttctgtgaaataccaggtgtacgttcctcctttgcttaggcctgatgcagttacagtgaagaattttcaaaaaattcgtatcttcgcaaaagaggcatgtccactgagtctgcaggccaaacatgaggttccctttgctactttttgttacttcttttcctttgtgtctttcttgcttatccttgtcctgctgaatacatctggccgaaagctcttcctttctgggagtgaaacagtgctttactggaatacgtatggcatggtgtggttaactgcagttttacagtctcctctcatttcagaaagcaatagtatatttagccacccagaaattaagtaaataccatttaggatttcttaaatgtaaaacaacattgtcgtgctttaaagttgtctttctaaatgtccatcttctcaccctcatattacaccttggcttcagggaaagggagaggattattttgaattggaagggtttctagacatatcctaggatttaaaataaataaaactggaacataacctgtttttttattttttaatgtcttcttgtgctgtaagctgaacctcgacctaaattcttgttaattaagactttatcctatgtgtgcctttgtgtaaaaacgaattctcccattataatcatcccacccaaccttgcccagcttccttgcaatattgcttacggtaagttttcctcactattggaggtttaaatggagccttgtattaaataaatgctcaatctattttagtaatactgctttataactagggcagacttttcttttcaaaatagtttcagtgctgattttcatcaggacaagatcttgattaattcccagatagacattgagaacctgtggaacaacgtcctctccctggaacctcatcattgtttcacagttacttatggggaaacaccaattcagtttaggggtatcttctgtgcaggcctttcctcacaccctgagtggtgtaaatgcccctcctcgccctttcccttagtgtctttgtgtctttatcctcacaagttcgtcttcatcatgtaaaggtttgcttaagtagttttatatccccattgtttagcacaaagtaggtgatcaataaatgttgctgtggagtgattgagtgcttttacaaaaaagcagagtatgtaggtaacctaacaccaaatagattatgggaagttctgatatttgcaggtaccatgttatcaaggtttttgtacatgtaagattgcatccttttggagaccagagtgatttctaggggagtttggtgtttttgttgggccttaaggaataggtcctctctggttaggtgaagattttccaagaaagtattccaggaataagggattataaaattacaaggtctagaaagtctaaaagcacaaaatttataatcaagagtacagtgtggtggaagacagagactcatataggaagagtgagagaatgacacattttgaggacacattttgaaggatctaaatgtctgatcaaaaattacgtttaattttgaaggcaactagagagcatatgtagagttttgagccaaagcatgataagattgaataagtgctatgagattaatatgaccatagtgtgtagggataatacgttgaatgggcagagagactatttctgcattctagattcaaggagacaaattgggagtggaaggagtgagaacagaatgatggaggtgccaaagacatttttctgaagagttgacagactttctgcacacacaaggcttcattgagctatcacaggaactcatttgcttctctcttttggatatttaaaaaatttgtctgaaaagcaaaattgtgagattttgtcttcttcttttgccctgactctggttaaacttgagcaaataaactgactttcaactttaatgccaatgctattttgaattttgccaaaaccaaccagtatcctagagctaagagctaaagaaatgttattttccaaaattggcaaatgcttccaacttgttattagagtaggatagaaatattcctagtgagacccacctactcactcatattgtagagagaaagttggtgatgattcacaatccttataataatgcagcaagttgcaatgtgcaattgaaagcgcgatattttttctgatttttaatgcatcttccagaggttggagcacagggagtatgagcataagccaggggaagagggatagaggagttcttttagaaaaatcaccaagaaaaaaccaaacagataatctgtaatctcttaaaaaataactgatggctatacaggatttttatgaaagcataataacttccagaacataggcaaattggtacacatcccatcccagtagccatcacctaacataagtcacgtatctttaaccctgagtttactaagttgcatacaaattaagcatatgcatgtgggcattggaggggcatgttgacaaaaatttcattactttaaggagtcctgataccgaaaaagaaaaatctcagagctagaataatgacgcccaagagctaatctaaagaccttttattttgaccactcaatagtgaaatgaacttaaataggggtggtgtggtatatctatttttgtaatgtagaacactgtattttattcctagtttttatttaaaacagtgatgatagatactagttgacagtcttaggttgtctccaatttaaaaagaattctgtctgtcttttctctgtttctttttctctttctgtaagagccacagagctcaagtgtattctacagtgatttacaattagtattattgagtccagttgcttaaaaaagaatttggactgtaagtatagaacaattttccataacaaaggttaaaatcaaaggatagcttaaatgacgcttagttaactccgaatcaaattaatcaggaaaccctattcttttagacaaggtttgcaaactaattataagtgctggtgtggcctagacatctcttagctatgcagatgctcattccctgcctgccatagaccctgagacactaggtcatagatggaactcaggaacttgtctttcttttttcttttcttttttcttcttttcttttctttctcaagcacccccaattctttgtgaggtagttgtcttcagagcacattttgatcatcacacaacaagaaggtaactgtggcacttcaggtgagaagagaatcagcattcaggtctggttctaccattcactccatgaatcttgtttcctgttgtgttataattggggggtatgttcattttctgggggctaccgaaacaaagtaccatacattgggtggcttaaaacaaaataaatgtattatctcacagttctggaggctagaagtccagtattaaaatgagcacagggccaaggtccctctgagactgtgggtagcgaccttccctgcctcttcctagcttctagtggtggttgtcaaccctttgcattcccagcttgcagctgcattgctccagcctcttccttcgccatcccgttgtgctccttctgtgtgctccactcctctttctatgagagaacccgtcgtattggattaaaggcccaccctatcccaacatgacctaacacttaaataattatatcagcagcaaccgtatttcaaatgggaggtcaccttctgaggttctttttgaaagacacaaacccataatgcagaaagaaggagtatgtgcctagaacaggttaggagttcccaaatcagagtcagaaactgatccatccagactttctacaggtctcttaggaaacacactacaattacaggtttcactaacctgactgccagatcctgactcagtaggtaggagattgtgccttagaatgtgtattatccttcggtaggaaatccccactctgagtagccctgccagatcacagccctaattgatgttctgctgaatgtattgggtaaaagataagttatagctacatagaactgatgcaataatctcatataactacatatattatactgtcttcacaatgcactttgaccatatgttcatctattttgacaggagtggggacgtgaggttctcaagttatgcttgcttaactcatagcccatgcttttaaggaaaactaaagctcattctaacaattgtctttataaaattaaaggtgttgtcgatgtttgatttttccaccattttaattatcagaaagatgatgaaaattgggttgttccctcccattatgactgatttcctctcattaatagagacaaaggctcttcttgaagtggaactaaaatgtaaacatgagttcaccctagtctctaaagacttcaagaggccatgcatttgatcaaaatggcatgttttaaatcctcctttcatgatagaatacagataaaatacagatagactgaagccaaaagcgttccttgctgcagacacactcaataatacgtacgttgttaatccctggctgtttcaaagtaattgtaggcttctgcatggaaccaattttctgatttttggagactaagataattccaattgcatgtccttaactatgataataagtggagtctgccagtggttgcttgtgtgagccggtcatgctggaggaaagaattgggccttcatgtgtcttacaaactatagctttctctttagccctttcctcagcaaatggagtcatgccaatctaagtatttagaagtgtctcacagaaacactgagttgcagatagagtggaattaataatttttattacataatttgctgtttcaaatgacaaattttgagtaaacaaacttggttgatactttttggataatttatggtcaattcttagttttctttgagtatttttagttacaattatgttccaatgggactttctttttttctacagtatcattgttactgatctgcatttagtttgccatatgctctgcagtatatttgtcttccctggtgaggttgtatataaagtgaggtacagatttttgatattcttaagtcgggtacataaaatattttgcctcaaattattatttcagaaaaagtttttttttaattaaaaaaatctgaattagccaaatcctttaatcagttcctatatgtatattgtgtcttgctgagaattgaggaagagtgtaattcaatgcagaggacatttgtgaattttttgagtcaggttggagacagaattagagaaaattttctatcgatatttttggtttttcactcaccactgagactgaactaatgatttccaggtttctaggagtcacgtagctcttgaaagaccgactactttctgtgtctctgggtcaaaagttacgaaaaagaagcaagagaatctaagccaaaataacacttcaaatagtccaatgactgtttatggcttttcacataaatatttagaccttcattagaaaacattagatttaagcagagagtagcatatgcaggtcagtctcagaatttaccagctattcatcagcagtaagtcattggggtttctcccttttgttgaagtggtttgtttttggtcacagagcgtcatcattgtcatgcttcagttctttcatttgtgtactatttaattaattaatacttaaatatttgttgaacatttactggatacatataatggggattaaataccttaagagaatctctcagttgaattgaggagatagacatataaaaaaaatttccaacatgggaacatgataaatcttggaatggaatgtaatagaaaaacaatattcatgcaataaaaaaatgcatgaagaagaacataacatgaaattcaggaaagtaagacacccttcatggaatgaggttttttatctataattgtaaagataaagtactcttgatcttcataaatcttcactaatttattttccaaatatttacaaagtattacaaagtgttggctactgtgctaaagatgactgtaaagtacatgattcttgccttaaagactcccagattaacttaaggaagacagctaagtgaatgaagaaacatggctccagccaggtgcggtggttcacgcctgtaatccagcactttgggagactgaggcgggcagatcacctgaggtcaggaattccagaccagactggccaacatggtgaaaccccctctctactaaaaatacaaaaattagccaggagtgctggccggttcctgtaatcccagctacttgggagactggggcaggaaaatcgcttgaacccaggaggcggaggttgccatgatccgagattgcgccactgcattccagcctggaaacaaagcgagactcctctcaaaaaaaaaaaaaaaaaattcacagctctgtgaaagtgctgactcagaactgaaggctgtcatggctcatacaggaagtattgcttgaaaagtaaagtgagactttttggtttgcaaagacccaatgcactcaaatgagctcaaataaaaatggcggcattgaaagacaacaaagttctcacacaaacataatggagccagtattgagtgtctgggagaactacaggagccacgcggtatctgcctctctctggatctgttaagtggtctcattctgcttctttctgcatgtgcttttttctgtactgagtcaccggtattttattgaacaatatattttttcaataggttcattgttatcatcatctccttttttaaaaaaataaaattacctgaagtcttcaagattgcactttatggctaacacattggaaattgttgacatttctagttgactcttctctgtagatcaaaatatttttaattgagaaaatactttctttcatgcgcgtccatgtgaagagaccaccaaacaggctttgtgtgagcaataaagcttttaatcacctgggtgcaggcgagctgagtccgaaaagagagtcagccaagggagataggggtgggtggggccgttttataagatttgggtaggtaaaggaaaattacagtcaaaggggggttgttctctggcgggcaggagtgggggtcacaaggtgctcagtaggggagcttctgagccaggatgagccaggagaaggaatttcacaagataacgtcatcagttaaggcagtaacaggccattttcgtttcttttgtggtggaatgtcatcagttaaggcaggaaccagccatctggatgtgtatgtgcaggtcacaggggatatgatggcttagcttgggctcagaggcctgacactttctacagttacttacacaaatgctaaatttggagtaaatactgctaaatggagcttactaattctacttttagtattgaaataaataactcagcctgaatatttttacattttatttacaatattatatttgtaaactgaggttacaatgggcattcaaaataatgttacatgtttcacctccaacagaatgaatttccaaaaatttactttgattctatgatgtgcatgaagaaaaccaaatttttctggaattaactttatttttcgtttgaagtgtctggtaatactgacataaaattaagatcatttaatcttgtgtgaaattcttctgctaatgaagcaaaaatattgacagttattgcttcactttttgtgcatgcataaaacaacttggatctgaaaataaaattaatttagcaaagcactgatctaggtgaaaagtcattaacttttgatagaatatattaatatttttaaacagattatgtgtcctaggaatttcatgaagtcagaaaagttttggtagagtgaaggctggaagctagatgataataagtaagtgctaattttgaagggtgtgacgtctctgattcaaaatggagtgttaaaattttactttttaaaataaaattataatgtccaattcagactcctaagtaataatgaccttactttagctgaaaaagcacatagcattaatgaactaaagacacaaaataataaatacaattgtattttcccagaatgtaaagatactgtcgacatatgtcatgcagagcatctaagcagggtcacactcagcagtggcaggtcctcatttctcagctgcgtccttagtagagggctggtaattgcacagagactgactcttccctgttctctgtcctccagtggcctgggtttctgctcattctgctccttccagtggttcagggtgagtagcaagatgtgaagggagagtgctgagaaggaggagggtggaggaagttgagaaagacagcagctttcgatgagtgcacaggccactcttcaagtcaccaaatttaaatgttgcttgtgctgctcattaacatgttgggaaatccttgactctttcaggattccagctccctcatctgttaataaaatgagaaattgccacaaagacctccctgccttggaaattcaaagactatataggctctataattcaatggtagaacttttttatggggggtgttagttactaaaactgtagactgtttattttgacctttgagtataggaaaacttgttgaggtaaaaatattctcttctatgattattcaggtagaactttaccattcaacttagggattctgaaagatgattacagaaaagcactatgatgcagagctccatgtggtgatgtcaaatccaataattcagttaaactcctgtaaaaatttcccatctcctactggcagggtccaagtcaggatatactgcatttcttctgtttcattcttttgttggagttaaatactattgcaaacaaggctggatgtttttatttctttttgaaatccagaatgctctttgtcatttgacaatgcagcatactaaactacttaaaatactttgtgagtgaaatcacatgcatgaaatgtggtataagttactagagcccttgaagggcagcacttgggtttagttggcctcttctgttttacctaatttctcaatcccacctattcttttttctcactttcttaaatcccagtaattatcttaggcataaagcagttttctatgcatagacagttcatttagattggtaacatgggctaggtaaaaaaaaaaaaattaaatatatatatacttaggcaatttttatctcgtttaaaatggcttgaaagaaccatggtactcagagcttcagagatgccctgtcttctgattttgcattctcacaattctctatgatttaaaggagcaatgcagtgaatttttataaacacaaaacttcttcccaattttatgttttggcatcataagtatgtattgacagcctcagtgttagaggctcagcactgtgatgtgcacatgtaagttcacataggaatgagagttttcaagggcagggatttatctttgtttactgttatatcccttttgtctacaacagtgcttggcacgtaagcatgctaaatagattaaagtaatgaatgtgagggtaatccatactctcctgagggcgagaatcctacctgtcctgtacagctctgtgtctgcaatccctagaacagtgtttgcctcccatttgttgagtgagtgaatgtacttcagaacttggtccttgccattaaagagcttgaatctggtttggaagacagattggcaaaatattgaagagcagtaacagtttgggattgtaatgaaaaattatcactagaaagtcataggttgattgtcaaggtaatgatataaacaattgttctagatgttcaaaataggaaaataatatacaacataaatcagccctcacattttgacattgttggatattgattgattgctcaattgatggattgaatggatctttgaatgcctctacattccaggcaatatattgggtggtgggaagtcaatagtaagataggtgtatttcctacccaaactgaactcataatctaatgggttcaattgataatcttgtttttttaaacaaataaataaataaataaatttttttaacaataaataaatgtttatttttgaagggaaaaaatggaacattgaaataaagaataatagtattatactagaaagggtgaattctaaggatataacaattaagctctgtgaagaatattctaggtagagaaggaggtatgcaaaggccctgaggcccaaaggcaataaggaatgcagtcgctgagacctcttctacctgagtgtgaataaggaggcaggttctgaaggattttaatcaacgggtatgatacagtttgtatatttgtctctgtctaaatcttacgttgaatagtattccccagtgctgcaggtggggcctggggggaggtgtttgcatcatgggagctgatccttcatggcttggtgttgtcttcataatagtgagttttcaaaagctatggttatttaaaagtgtgtggcaccccgccaccaccaactctctcttgctcccacttttgtcatgtgatgtgccttctccccctttgctttccaccgtgattgtagaagctccctgaggcctccccagaagctgagcaacgtcagtgctatgcttcctgcagagcctgcagaaccatgagccaattaaacctcttttccttatgaattacacagtctcagatattccattttaacaatgcaagctaatagaggggagatgggatacaatgtgtagagaaagcaagaatggaagtggttcagtttgttttaatagttcatcaaaggaatgacggagaacttaactaaggtagtagcagtgaagaaggccagttatggaaagatttgtaaaatgaaaggatttgctgttggaaaaaacaaaaaaacaaaagaacaacaactacctggaagtgggttaaaagtgggaacagaggattttccctaagtgtctgatttaaataatgggtggatagtactgctttttaccaaagtggaaaatggcgttgggaagagacaaatctggggtggagaagcatggatgctgtggtgggcaggttgtctttgagatgtcttcccgacatctcaaagttccccaggtaagactggggaactgaatgtgtaaaagtacatctcagagaaaagggcctaactaatgatatgaaagtctccagtatgttgatggacagcagtggagagtcagctgggcatattaaaatttaagccttcactttacagaatgccgacctggaactgtgagtgaattcttctttaaggtatatatttaacattgggacaaggatatcatctattagttaatattttgctacattaaaaatatgtcaaggtagtgtttctttttttcttttcgtttttttttttttttttttttttgcaaagtgaaagcaagtttattaagaaagtaaaggaataaaagaatggttactccatagtcagaacagccctgagggctgctggttgtccatttttaaggtagtgtttctagactacacatatatcctattctttctgtgcacacatcttgttataggtatctctcattttcagtaaagaaactatatagttagaaaaatctagagaagaaagaccccaaatttttaaactgaacataatcaggataaggacattacatatttgtgacacctagcctggccagggcttttgtgatttggctctatttctgtaccaaggcatctgagacagagagagatgacagacgtttgcatctgccaggttgaagccaggaactttgtgaggaataagaaactcaaaacctctttggaatcagaggaggagcagaagcttggaaggcagtgtacatacaaaacgtattaattaagcacctactctgaatgtcctgcagaggataggagggcagggtgcaaaccacagggaggtttttccatctgattttgggcataacctcctgatctggcctgtgtgtatgccccaaatcacttcaaagtttcttgcagcatctgggtgtgctccagtattcactggagatcctgcttgaccacgtgagaatgtacaagtagccaaagctaggatggagatttgttcctctctgtatctccagtcttcccaccaccctgtatcttttgtctggactcttctcccatttacctttattttctatcccatctttataaaaacagcttctctctttcctcctcaatgctttatcttgctctcttcttaaagtggctgacagctatttttatttgtatttctatgccaaacattgatgatgtattttccacttttcttcttaccatttctccttcagccctagatcattttatgccagggctaggttggtatccgatcatggatggtatctggctaccttgatttttatacaaaaaacataaatctggtttctgaagatgagtcacagggctgtccatcctttctcaacattgtctgctcactgcagtggcaactcaagtagccccatctttagatagggaaaggaattgggtctctcactgggttcccatttcgaatctcattgtaggacctggtctgctttctgcctatatgtcttagcagatgtaaaggggtacccttacctaattttccctgctaattcactcctgagttcctttacctgaaacatgtgtgatccaaacaaacttggagttatcatagctagaaatgataacctctggcatgcaagaagctgaacttgagtgccagcacttcattgctgatgccaaacaccacattgcctggcatcctaatgttgaagttttgcttcagggaatgaataatcaactctcagatctcttaaccatttgtaaatctctgagacattatcctcagaggaaaaaattccttttttttgatttttcatttaagggaacttgagccaataatccaaagtgcttttattctcagttctatttgcttgaatgatccaagttgtgtctttttctttggtgttttgtttatttgttttcaaaccagaagagcatgttaagtaaagtttgtggaatgaaaaaagtgctcagtgcttggtaatacagtattggaatatttgaatacagctaaatttgcagcagtgaggtgatgtgctttagggtttttggcaagggataaaggttaggagttgttgtcccagaaaatgttttttcatgtaattggtctttgacttaaatgaggagtgtcctggaatcatacttgcatgacattgttgggtctctgaacaccgtttagttcctttgcattgaatgatcaagagtgggttccactgagagcacattcttcactgaaaacaggagcatctgctttcagttaagatgctgggaccaaggtgggacaagtaccgtggacacataagacctgggctctgctcacaaagaacatacagtctagttgagaagttaagatattacactgtggccattaaaaatgcaaatcctgacagcgtgtggtagctcatgcctgtaatcccagcactttgggaggcagaggcagttgggtcacctgaggtcaggagtttgagaccagcctggccaacatggtacaaccctgtctctactaaaaatacaaaaattagccgggtgtggttgtgcacacctgtaatcccagctactagggaggctgaggcaggagaattgctcaaacccgggaggtagaggttgcagtgagctgagattgtgccactacactccaccctgggtgacagagcaagactctgtctcaaaaaaagaaaaaaaaaaaaaaagcaaatcctgtttgcccaccttcaaatacagacagaatcaggccactttttattgtctgtggctattactcttgtcttagacaccatgatcgttcatcttgattattgccataaccttctgtcttagtttgtttatgctgctgtaacaaaatacctgagactaggtaatttataaagaataaaaatgtatttcctcaccattctggaggctgggaagtccaagatcaaggtgctggcagatttggtatctgctgagagcctattcttacagcatcttctttctgtgtcttcagatagtggaaaagttgggaaggtaaaaggggcctaattccctggagcccttttgtaagaacactaattctattcatgaaagcagagcctgtatgacaatcacctcctaaagcctccacctattaaaactatcacactgggtcttaggttccaacatataaattttgatgggacaaatacattctactttaagatctcctaattggtgtgcctggtacttccactcttgtcccttttagccttttctcaacatagcaagcaggaagatctagttaaaagtaagtcaggtcatgttagtcctctgctgccaaaaacccctaggggttccctgatgcctcagagtagaggcaatgtccttgcaatacggataagattctacatatggctgagccacgcacaccctcgttgactctctgctgtcaatgtctgccacatgtcctcttgcacactctgctccttccactgtcctctccttgctcttcctggagtacaccagaaacatgaccacctcaaggcctctgcatttgctgctccatctgtgtggaatgctctttccctcagctggcttaatctcatacatttaggtctgtactcacagcgagaccttccaaggccacattgtcttaagttagactcatacatgcacatgcacaaaaaaacacactcttgcttactttaatttttttcatacagctatcaccgtatgatgccgtaatattttgattaatgtctctctcttccccagtaggaggtaagctccatgaatgcatgcattttgttttgtgtgccatatctttaacacctagaatggtacctggcccatagtgggtggctaataagtatttattgaatgattatttttgttattttaagcatgtgatggttttctagggctgccataacaaagtaccacaaactgggtggcttaaaacaaagaaatttatcagacagctctggaggcttgaagtccaaaatcaagatatctgttgagcttctctctctctaaaacctggaggggagtgatatggtttggctgtgtccccacccaaatctcatcttcaattgtaattcccacaattcccacgttgtcatgggaggaacctggtggaagataattgaattatgggggtgagtctttctcaagaaatgctgttctcttgataagtttcacgagatctgacggttctaaaaaaacaggagttttcctgcacaagctctcttcttttgtctgctgccatgtgagacgtgcctttcaccttctgccatgattgtgtggccttcccagccacatgaaactgtaagtccattaaacttattttgtgaattgcccagtctctggtatgtctttatcagcagcgtgagaatggacttataacacagggagaattgttacttgcctcatccagcttctagtagctctggagattcctggcttgcagctgcaactcttcaagctcggcctccatgattgcgtggcattctgtcatttgtatgtgacttcatattgtatgaagaaatgaagatacctccatgtgtccatgtcttgttatatggacataagtcatattggattaagagctcaccttcctccagtaaaacttcatcttaactaattcaatttgttacaaccctatttccaaataaggtcacattctgagatcctgcgagttaggacttcaacataactttatgggggatacaattcaatccataacaggtggtcagggcctgaattaagtagagattatggcattaaggatgttgaaagctaatagctggcatgagaatctgaatgaagaatgaatggcatccctacaatgggggtttgggacataatcccaaaagacaccatcctgaataccgtaaaccctattgtgaagatcctgaaagattgaaatcctgaaagtgtaaaatccccaaaattacaatctcaaagaatcaaaattccaaaaatataattatttttaaaaggagagttgagaaacatataaaaatgtgatagaatacaggcagtaatgacatacatatttttgcaagcataaaacagatatattaacagcagtaatacaggtataacattttttgagcagacgaaccatattaaaaaataaatagcttatataaatgcactcatctgaaatgccattatgaacaatccaagtcttttaatcaaaaaccttgatggatcaccactgcatcatcacagcatatgcagtcacccggagatcccagagcttatgttatctttcacagaagcagatatacagaggggttatcttttcatctgctgaaaaagtttcaatgtttttatgtgcatgtacaatgcttacatacaaagtcaacattgtgataatgcactttcctgtagtcaaatttgcaaaatatgtgtaaaatgaattagaactctttaaaagcctttatacaatttatatctccagtattggaaaagattaaatacataggatagcaaattgcagaaaatgatgctgacaatttaaaatagtgaaaaaaaaaaaaaaacctaaaacgacagcaacaatacccaaagaaactgaaaaacctgatacatgaaaaaatgtgttatagggatagattatgggcaattgcacagaagtagccctaaaaacctggctgactttcactgtcattaactatattttgaagtgttgcattaaaatattatcaatctgttactggaaggcaggaaaggcaatctgtgatacatgtttttcttagtaagagctccaatttatattttcttttctcaaaatttagaagaaaatttctatggagcctagagatcatgtactgctagctactggcaataaaatttaaaaaaaaaagaaaagaaaaggaagcaaagaaaggaaaaaaggaaggaaggaggacagagaggaagtctaatattgagggtggcattgctgtctggaaacatgggacacgtggaaggacaggtattccctttatgtgtcaacttgtctcctcttctcctctaaaacttgaccagactaatagcccaccaacagagctgtggtccagcatctactcagaccaaaaagctacagcatctataagttgtctaaattatctggtctagaatttcaggtctcccacatctgtcaccttcccttacataccttgtgacccagctaccttgtaggacttgctcctccctgtaggtacccttgtggattcccaacacatatgtcctttttattagtctgttctcatgctgcttataaagacacacctgagaccgggcaatttatgaagaaaaagaggtttaagggatgtacagttccacgtggctggggaggtctcacaatcatggcagaaggtgaaaggtccatcttacatggcagcaggcaagagagaatgagaatcaagtaaaagggaaactctttatgcgaccatcagatctggtgcaccttattcactaccacaagaacagtatggggaaaccactcccatgattcagctatctcccactgggtccctcccacaacatgtgggaattatgggagctacaattcaagatgagatttgggtggggacacagccaaaccatatcatcccttcttatgcttctcctttgaccccctctcaaatgtagctattacctttgttgctgtcttccttccaaatctaacttccctatcatcaaaacacatacaacaactttacccttacctttttgttggcattcatgataccctgtcttataggtttatattggtgaaggtcttgtctgctataaattagagagataaacatgtcagtagcatgattttttgttagtaaaacttttagatgattgtagatttaaatcttaataaaatctttggatttctgagtcaaagaatgtgtaatttcaaatacaagaaattaacatttcttaattgtcttctgagacagcagtgcacaataatgaaaacaggttaagattcagagggtagggttggagaaagaagaattaggaaatgtggagaaagtttggtggatgataaaaagtctctattatgttacacttagctgtacttgattttgttctttaaatacctacactgtccttgggaaacaaattatttaacatattgtgataggctgaataatgtgctgcccaaagtaactctgtcctaattcctagaatctgtgactatgttgttacatggcaaaaggggctttgcagatttgattatgttatggaccttgagatggggagaatattctggattgtttgggtggacccaatgtgatatggtttggaagtgtgtcctggcctaaatctcctgttgaattgtaatccccagtgttagaggaggggtttggtgggagttgagtggatcatgggggcaaattttcttcttgctgttctcctaatagtgagcgagctctcatgaaacctggttgtttaaaactgtgtggcaccttccccttctctctcttcctccttctctggccatgtaagatgtgcctgcttcccctttgccttcttccatgactgtgagattcctgaggcctccacaggcatgcttccagtacagcctgtagcactgtgatccaatgaaacctcttttctttataaattacccagtctcaggtagttctttatagcactatgagaacagactacacaaggtaatgtggagtgtacaatgtggaatacacaatgtacaatatggaatacacaaggtaatcacaagggtccttgtaagagagaggcagggctaggagcagtggctcacgcctataatcccagccctttaggaggccgaggcgggtggatcacgaggtcaggagaccatactagctaacatggtgaaaccccatctctactaaaaagtacaaaaaattagctgggaatggtggcgggcgcctgtagtcccagctactcgggaggctgaggcaggagaatggcatgaacctgggaggcagagcttgcagtgagccgagaccgtgccactgcactccagcctgggcaacagagcgagagtccgtctcaaaaaaaaaaaaaaaaaaaaagaggcaggagtgtcggaatcatagaagacatcctgatgacagaagtagagagattggaggtgctggctttgaagatggaacaggggccacaaaccaaagaatgcaagtggcctctagaagctggaaaatgcagcacacagattctcccctgagcctctagaaggaacgcagtcctgccaacaccttgattttaggatgtctgacctccagaactgtcagaaaataaatctgtgttgttttaagttatgtaatttgtggcaatgtattacagtgtcaataggaaactatatatattttacaggaagaggaattaaggctgtgacaattaaaagtagagaccaggacaggcatggtggctcatgcctgtaatcccagcactttgggaggccgaggcaggcggatcacaaggtcaggagatcaagaccattctggccaacatggtgaaaccccgtctctaccaaaaatacaaaaattagctgggcgtgatggcacgtgcctgtaattccagctactcgggaggctgaggcagaagaatcgcttgaacctgggagtcggagtttgcagtgggccgagattgcgccactgcactcgagcctggtgacagagcgagactccgtctcaaaaaaaaaaaaaaaaaaaaaaagtagagaccaagggttggcacccctttctgtctaggaccagatagtgaatatgttacactttgtgggccacgtggtctctgtcaccattactcaactctgctgtagacaatacctaaataaataggtttggctgtgtttcagtaaaatattatttgcaaaaataggcagtagactggattcatccttcaggctatagtttgctaacacatggtataaaccagtgcctcatcatcatttattgtcttaatttgtgcttcataatagcctggaatctgattcctatctaagcatgctacttgcccaccgaactagaaacagaacatcagcaatagcctatagttggttctctagccagaaaccttaaggtttttacctgtaaacatcaagcccattattaacactacagatatgtttaatgcctcagtatttgcacgtttgcaaaagctgtgtcctagaggtgtaaatggtagtgctaaattacattggcttgatttggtccagagaaaaccctactgtattttcataaagctgtgtcagtgtttttaatgctaagagtatgtacttctcataaaagtatatttcatcaaacaatgtctacagaggattaaactggactataaaacgatgtttttgtgtacagctttcaggattgctaacgctctattgtttatccttactccctggggcatctctcttgagatgaagatttgcttagcagatgacatgctgtacagacaatgtgatttttagccaaagaaatcgctgtatgtatgcagggattcttcctcgggtctctatcaatacttgcctttgctttgtgtatctgacccgtaacatttgtatgaatgtggcaagtttaacttgcctgcttatacctggcttgccaaacacaattctgccctcatcattttttataacaagattaagtaacattgctgccccctctgtgtctctgctgactttctccttggtcctcctggcctattaagttgcccttgagccttcaagaccagactcaattctgcctcctctgtggtcaagcctttctcaccattcttcctctgcaacttctcctaacatctttcgggtctgtatatgggctagttaattaaagtcacaccaagttctagcattgacatgatttttgcatgcatcatgttaaattacagatccttatattcagaagctgcattataatttggctgcaattcataatatttaagcacaatattcagtaaatatttgctggcttattgattgttgatttcattatttgcgtcctttttggattttaagtttgggtatgtgacattaagaaatatcttagtggaatatagaatggaatcattatttttattttacactctctaaggtaaagcaactgttcactccctcaatattttagagaaagcggtctagtcttatttccaaatttgcttagtggttataatttatgtttaaaaatcctacttgatgacatttaattaagatcttagaagcaaagaataattaggatgtattcctgcatatttttagctttggtatgactttacctaaaccattccatatgattaaagatcttattatcttcaaagacttacagataaagcaagtccagagtctcctgacagggtttgagtctatttaaaagtatttgccggggaaggtcatatgcatttgccaggcctcagtgagtcatagcacttgatccagagaggtgcgtttggaaatgtttttctgggtccctgagtcccctgctgctcctatggcgatgtctcctaggtgtgatacccacattgtcagtctggtttggcagtgcatacttccagcaaccatgcaggtataaaatggagaactgctctgagactccacccaaaacaattcgaaagatgttcagttaaaataaataagtgtcagccacttaaaccactcctgtttgaaattgtctgtctgcacccactccactggaagttatcagaatttttagtgaagcagatattctgatgcccataggtattgaagaccagggatcgggacatttgaataataagaaactgcacaaaaagttcttgattgcccccttgcatattataatgtttggatgagtgagaaaaactgagcaaaaagttgagagcaaatgattatataaaaatagacacaaaacattgctgtgttgtatatcggccaaagatacataatctgaatctaagtgtgagaatcaaacacacaacttcagatgggggaactttatacaaaataattgccctgagctcttaaaaaatgccaatgtcatgaaagatagaagagcccggggaaatggtctagaataaaggatctttgatcagattctggatataaatataaaataaaataaagcaaaaattcccagctttatagataatttttcagtcagtaggtaatatttaaacatggactctatctatgttaatgttgaattattatatgttagtgtttaattattaacttttctgcatgtaataattgatgggatgtgggataatatccttcatagaaggtacatgctgaagtattacagggacgcagagtcagtcacaagatctacaaatggctctcaagtaattcagaataggaaaatgtatatatgttccatgtacttacttgcgcacacacagccgtgtatatatgtaaatgaggagagggagagagagaatgtggtaaaatgttaaacaattggtaaatcttgatatatagatgtttattgtactcttgcgctttttttgtaggtttgacgtttttcaaaataaaaagttgaggagaaaacggcaaattccaaagggtatttcccttcatctttctttagatattagtcaaaattcagctaaacagaagtggagaatccccaagctactgaaataaataagctgctctaatcttttataagatttgggtatcttagtacttataggcaagggcagctgaagactcactaaataaatatgtcttcatcaatatttgaccctttaaggggtacctctgcctgttaaataagcaaggaaataaaatagcgtaactaggcatgcaggcatcgtgataatcacaagtttttcatttggaaatgtttcccaacttgggagttattgctttcagctgtaataataacaggcttttccgctaaggaaaaaatacgtggtgtttaaaataaatatcatcagtacaattctgcagtgttgaaaaaacataaatgaccttttttcttttctttaaacattaaaatctcctggagcttccaggggacagaatttgtgttcacggagaatgaatttcaactaagaggtgactggttacaaaagaccttcaccgtcattttaagtggtgccaaaaccccttttatttgtggcctttgcccaaagataagcccagacttttctccaagtatgttggctacactttctcattgcaatctgggatctgcctgttaaacacaattgagagtggaattataagctcaggggatgtcactatttgcatcctaggaactgactcaaaccagtgtactaccaaactcacagtacagctacagttatcggaaggccagttttaaaagaattcacacatttctccaggggatagcaaaaggtttgaaggcagctttctggtgggattttacaccctcgttttttttccttatgaaaaaaataatagcaagttcaggctttgttcctgagacctctgtcttaacatgacaaatcctttgcccagaagattaagtaattattctcttgtcgttctgtatcctaattccattttttcctttttctttcactgacaaaatatcaagaactgtagtgaatatcatttaatgagcatctctgatgtttctgatatcatgctaagtgacctatttataatattatttgatacaaacaagatatcctataagacagttattgtcttattttacaaagaagggaaattttacagctaaattagcaagtgatcgccagtctgggaataaagtcttgctcctgacactacaatatatgaaggacaattagttttctttattccatcatccatttaagaattgtgacagatagcatacagaaaacaatcaaatagattgaaacaaattcctgtgagggtggcaattttattacttttctcgaacagctggttagttcttttgtgagtgtgtttatctttctaaaatctttacaaggacggcacttatttgtcaattaaaatctgtatggctgactaaaggaaacatcagacattctgtaggaatcattaaggtcaaggtagcttgccatgatttaggcctcagatcaataaaacattcagctaagttctcaaagagcgaccttggaaaggagagagaacaaccatgaaagacatttggaagtaataaggccaatcagctgatagccattcactgacttgtagagacttgccaggagagaagtctgcgtattccctatcagtagctactgcatcctgtctgttcaacaagatcaccagttctgtgccagccattgggctgtgagccgaagtcattcaaaggaatggccacaattgcctgcatgtctaaatttgcaatcttggttgaattgctgtgcgtaaaataggatgttagcaataaaccataataccaacaaacagtaaaccagtcattcattagcaatcatgactattagcattatcttctgagtatagttgtaatgagcccacattatggatgcccctgggacattttccttgcagtcttcttttgggtttttctctgaaaacattattcaaggatcaggtggaagaggatagtggaaaggactgagggtaaattatacaaccaattagaaacttccacactgtcaactttcagctttcattatatttatcttggatgactgagtaaattacttggcttttctccattcttaaaatgtcatataaaaccatattgtgcctgattacctgattcactttattataagcccttggaagcatgcatactggttgtaaatatcattgaataacttactaaaactttatgtgtttaaattgtatctaattttgcatttatacctagctaattttatttctgtccccatttattaacttgagcaatactcaccatctgaaatatgttggccaataattatttcttctaatatggcccacatattagaagaaatatgtaacagctttgtaacaatgacatcatcagctaccatatgtattagactgtttcctttcaaactggtttactgaaaagagtataatatgatgataaatattatcattattagagtataatattattattatattgtataagaacatagcatattatataactgggtgttttggtagtgcaaattatttgttaaataaaggtaacaatgggttaagatagaaatatgtttgaaagtgataatttttaaatatagtaatttttcttctattagtttatattcatagtacaacttactctgcacaatagtgatgtttgactttaattctggaatattttactctttaaaaagatcacatcttaaatttcaattatgcaattttgctcttaggatatgtacaaaagttgtaaatgcttgatagagaatatacatataaggtataatgctcattcatatacatctttgaagctcaatattttatttcattatagggactaggcaaattttcattttatttctggcttatagaccatttcttggattttcgaagatttttttttagtgtaaaacctatgctatcaagcaaaataatccctttctaaattcctttaggcctttgatttacagagatctgtgagtattacatccatgaaggacttggtctcaaggttgcagagttatgagatctaaaggtaacatcacccataatatgtgggaagtgccctgccaaaaatcatagcaaacaaggtttcaaacactaaggaaaagtttagtctttgtggggcctatcttctcatttgtatttcaaatgaagttattcatattctttctttctccctccctcccttcccctttctcctctctctgcatcatcctcgagtctctattagtttatccccaagatgataaaaatagaaatattccttaacttacaagagaggtgatcttttttgacttttgaaattatgcccttcctactatgccatttctgagctctcctttatagtttaacttctcaaaacattttcttttcatattgcctctatttcctcatttttagtgtctggttttttagttgttagtcttgctatgatattttcccaggcatatttctcagcccagataagaatccttttatttatttatttatttatttatttttgagatggagtctcgctctgtcgcccaggctagagtgcagtggcacgatctcagctcactgcaacctctgcctcccaggttcaagcaattctcctgcctcagcctcctgagtagctgggactacaggcacccaccaccacagtcggctaatttttctatttgtagtagagacggggtttcatcatattggccaggctggtctcgaactcctgaccttatgatctgcccgccttggcctcctaaagtgctgagattacaggcgtgagccatcacgcccggccaagaatacttttaagtaggattgcattatgtactaatttttttaactagccagtcactcaaaaatatactgtaaacttattgataccagttttttactattataaaaatagcaagtattgtctaagaattcataaccacccggaatgccaggtttgaatttagaattctaggattcttggaatcactcattcctatccggccacctatattgtcctatactgacaggaaatttgcacgtatatacctggacataacagcctgcacgtccaggctccaccctccagctactacaagttgttaacctcggctattcaacaagctttgaggtacacacagtaattgcataatttggctgttttggcagggcattccagggttcctgagatctaagtgtgggttggaatgaagtgcagtggaacacatcctcttggccggctcatttcctgctcatatgcactaggagaaattcatagaaatgttcataccagcatttgtaagcagaagacaggctgagtgcctttgctcatgtctgtaatcccagcacttcgggaggccgaggtgggtggatcacctgaggtcaggagttcgagaccagcctggccaacgtggtgaaaccccgtctctactaaaaatacaaaaattagcccagcgtggtggtgcatgcctgtagtcccagctactcggaaggctgaggcaggagaatcacttgaacccgggaagcgaaggttgcagtgagccgagatcgcgccactacactccagcctgctgacagagcaagactccgtctcaaaaaaaacaaaaaaaaaaagagagaagagaaaacaacctggaaaaaaatcacagttagttcttgacaagggaatggataattcatgttacacaatcacatactataaagtaatgataagatgtatgcacacattataaatattttataaaatattatggtaaattgtatgtaactgattatcacagaatgcttttactgatttttgctgagtcttgtatgagtagccaagctgtggaattatgattcagtgtagggtgaatattagataatatttttgtttatgttaacaattaatacaaaagtgaaacaacagagacatattggaaattcactatttgtcagagacgttagtaattactgtactttgttcaatgagataataacttttgaatactagaagagtactttttcattcttttgaagctatagacatgatataatggctatagacgtgacacacttttaagtttaatctacattattaacatgttttccacgactatattaagtctaggtaatccacaaaacaatagatcaagtcctgacttccagcgttgcagatttccatggtataaatactcctacagttgctaatttcaaactactgacatggcactgctgacatagagttgagaaaagataggcagtaatacgcatgacatagtgtttccagcatacagtcgaaggacacagcctcaagaacatggattttagtaaaatgtagtaacataattggagaatgatgagttttgtgtctttcttttgttattaatataatttgcttaattataagtgtacataatttacttttttataatggttgtgtttaacaactgacttggaaaattttggagaatttaacagccccctattataagctggttcaaaacagctttagcacaatattgtccaatgactgaatagtctatgttgggtagtttctgttttttgtttctttctattttgtttttctatttgttgatttctgatgcaagataacactatattacttgatacagctttaaacttcagcttcatatttggaagggcaatcccctcagttttcttcttcaggaatgtgttgcctggtctcattgaggaatatcttggtacttccctcttctgtataaattttaaaattattttgtaaatttcacccaaatacctcttgaaagtttgaatgaaacttcattgacttttaggtcagtttggtgagaagagacacctttatgatattgattttgctatgtattaatattgtgtaactctccatttttagtttctttcatgctcacaaaggtgtaatcttatagtgcttaaaacttcctttttaaaaaaatgtttatttcaaaatactttatatttttggttgctggtacaaacagtctttaatatttctttttactaagttaactattattgaggtgtaatgtacagacaatggaatgcaccaattttgtatgtatagcatgataaattttgacatatgtttacaccctgtaaccaccgccaccacaataaggattcaaaatattcctatcactctagtaagttccttattgctctattttggtcaaaccctccctgccaagctccaggaaaccatgaattcactttttttcacaatagattagttttaactgtcccagaatttcataaatatggaatcatacatgtgtgctcttttggggtctgaaatttttgctgagcataatgctgttttcaactatcacatttatgaattttctggtgatttataacattttaaagtatgctaacatttaaacaaattaatgaatattggatgtttttagatgctatttaccgtaactttagcttatcagttgttccctttaatattctctttgcaaatatatttataaatgagcttggattcgtagagcagtggttagaaaactttgttagagtcaaatgataactattttcagcttttgggtcatacaggctctgtagcgattactgtgttgagtattgtgacagcagccatttagtatatataaacaaagaggcatggctgtgttccaataaaacattatttaaaaatacaggcaggcagccctcagactgtattttcttgatccctgtcagtaaaaccattcatatacttgtgacattaggactatttacactttctgtgtcctcttgggtaagatttattaattgacattttctagtattttttccattttatctctgttttaatctttattattttcttctttctgttagctttgcatttagtttatacttctttccctagctctttaagttgtaaagtcaggttgttgatttgagatctttcttattttttaatataagcatttatagctggagatttccactttaccactgctttcaccatatcccatacattttggtatgttgatttttttcatttttattcatctctaagcattttctaatttcctttgtgatttcttttgtgatccactgggttatttaagagtgttgcttaattttcacaactttgttcacttttcatttatagaatttttctgttattgatttctaagttcatcccattgtggtcagaagacatactttgtatgatatctgtcattttaaatctaatgagatttagtttgtggtctatcatatggtctgtcctgcaaaatgtcccatgtgtacctgagaagaatgtgtatgctgttaatgttgggaagattgttttgttgttgttgttgttgctgttgagagggagtctcagtcaccaaggctggagtgcagtggaacttacctaggctcactgcaacctccatctcccatgttcaagcaattctctgcctcagccttccaagtagctgggattacaggtgctcaccaccacagccggctaatttttttgtatttttagtagagacagggtttcaccatgttggccaggctgtagattgttatttctgtgtttattaaatctacttggtttattgtgttgtttaagttctctatttactgacttatcctgtctggttgttttatccattattgagagtagggtattcaagtctgcaactattattgtagaactgtgtatttctgtcttcaattctgacagtttttgcctcatatattttgatggtctgatattagatgtatgaaagtttataattattatgtcttcttgtcttgctaaatttttcatatgtaatgtcctttgtctctgataacctttgacttaaagtatattttgttttatattaatatagccactcccactcttttttggttactatttgcatagaatatcttttcatagctttctcactttcaatctgtttatatttttggatctaaaataagtttcttgctggccatggtggcacatggctattgtcccagctactcaagaggctgaggtaggaggattgcctggagcaaggagttccagattgtattgtgctatgatagtacctgtgagtagccactacacctcatcctgggcaacatagtgagacatcgccccttaaaaaaataaaataaacactttgggaggctgcggcaggcagatcacgagatcaggagttcgagaccagcctggccaatatggtgaaaccccgtctctactaaaaatacaaaaattagctgggcgtggtggtgtgcctgtagtcccagctatttgggaggctaaggtggaagaatcacttgaacccaggaggcaggggttgcagtgagccaagattgcaccactacactccagcctgggtgacagagcaagactccatctcaaaataaataaataaataaataaataaataaataaataaaatgagccttttgtggatagcatgtagttggatcttgtcttttagtccattcttataatctgttttttgattggagagtttaatctatttacatttaagtgattattgattgggaggaacttgtgttattttgctatttgttttctacatgccatatagctttttttttgtactccatttattgcattactgccttcttttgtgtttagttgattttttgtggtgtaatgtttactttctgtcatatccttttgttgtgtattcaataggtattttatttgttattaccataaggattacatttaacatcctgaagttatgccattctaatttgaatttataccagcttggcttcaataacatacgaaaactctgctcctttatagctccatcttcacccctcttggttgttgatgtcacaaaattacctctttatacatttgtttcctaaagaataaggtaatattttaaatgtgtgtcttaaattaagaaaaaaaaatggagttatatctcattgttactgtaatactagctttaaaaattgcctatatatttatattcattgagatctgtatgtcttcatgttgctttggattactgtttagtgttcttttatttcacccttcagggcctccttgagcatttcttgtggaactgttctgttggtaatacattttctcagctttgctttttgggggaatgtcttcatttcttcctcacttttgaagggcagttttgccagatattggattcttgggttggcaaggtttttttgttttgttttttagttttttagagctttgaatatattggccaatggctgtcctctaaagtttctgatgagaaatctgctgatcatctttagggaatcccatgtatgtgacagatttcttctctcttgctactttcaagatttttctctttgtctttgtctttctaaagtttgataataatgaatcttggtatgggtcactttgaggttacattatttggagttctttgaggttcttagatatttatattcatgtctttcatcaaatttgggaagtttccagccattacttctgtaaatattctcgctgattctttctctttgtcatcttctaggactgctacaatgcacgtattggtttgcttgatgttgactcatgagtcctttgggatctggttacttccatcgttttttgttgctgttatggttgttcctcaggttcagtaatttccattgctctctcttcaagtttgctcattctttcttctgcctgttcaaatctggccttgaattcatttagtgaatctttcatttcacttattgtacttttcagctcccatatttcttttcacattttctatatctttgttgacattttcattttgttcatatatcactctttggaatttctccctatatttctctattgctgtcagcactttaagataactgttttaaagtctttgcctagtatatctgccatgatgtctttttcagggacaacttctgttggtttgtttttttcctctgaatgggccatactttcctgtttatttgtgtgccttattattttttattaaaattgtacatctgaatctaataatacctttgcctctatttttgcagataaataaattaagacttggataaattgagaggcatagggataataggggactgggatttgaatgtccaatattttgattccagagtttcaccctaacttccgaattctttgcaactttttctctaagtctgttctcacaaagcaaacttttaatgtgcaatttagtaacttaataagatatggctattggaaagaaatagtctgtggagaaagcctgagtcaattatgttctacaattttaaaaaactgggattctggtttgtaattcatcctgtgaaattgattcttgcctaaactactaaaattatgtttctgaatgcaactaagtgaggatcaaaccatgaactctgcttctacttctgtatattttctaattttcaaaggcttgtacagacatctcatgtcatcctcataatatgtccttgaactactgataattactttttccttcttagaggtaagtcaattgaaatgaaatggtttgtgaaacgtggatgtaaattaaaggtcttttgacttttcttgcaggacttttccaatatagcatggatcaggcatttcatgaattccttcctgaactagccaaatgacttcacccttacgtaatctgatttagttccatgtcatataattaagaattggatgatgattgacttattggtgtcttagagcactgcaatgtttaatgcatttgtggatctaatttaattaaatgagaaaaggaacttctacaccgttaatatatgatgtaaatgcactgaaatgggaactagaacacatgcaattaagaaatttgtttccccactagacataacaagccaggaaggatgacaaacatttttgtgttttgtttctcgtggactatttccacatgatccgtgccttcatatatttgggtgtcagtttctgaaagtttattttgcagtttctgaattgattgttctggataatttagcattccctttttcttttgacagtagcagagaacttgtgcatgggtggctgacttctaatagtcttttgatatttctatttcccagaggcctatcaacccaatgactttttatttttatgacccatgttccaaataatgacatgtaaaatttctgttattagcctctttttttgactatgacttccttataaagaagaaagaaaaaattactgttatttcaaaccagcactaaataaatttaataaaacttcatgcacaaacttcaatttggaaaaactctgttgcatagtgtatcagtagtaatgtttatctttttaaaggcagtgttggcattataagtgtagagtgttgttatatatagacaaaaatttttaattaagcgttaataaacagttacatgtgatgtatggaaataaatgtgagccgtaaatagtaatgataattttcatcataactactttttagtgcttactgtgcgtcaggcagcatcatatgtgatttaatttgatcctcaccacaaatctaaaaggttggtactagtgttatccccattttacaaatgagaaaaatgctgttcaaagaagtgaagtaagtcaatcgggtaacgctcctagttaaatctgtcagttccagatttcacgttctttactgtatgcagtcctactgtatgacatatgatcgaagaataaaagccgagttcccatgagaaacaaatacatgctttaaaaaacaactgcaaaacatctagaccactagcttcttctgctatcgagttaacaagttcaatggccaggaagatatatgcccatattaatagaattctcttgaaccacaaaatgtagaaggataataaattttacagattttttttttcctgtttcacatagtctccagtttatgaggacagaaatttggaagaaatttatctcaaagtttcgtgtatttttctcttgcacaggtactgtaaatctcataactgatcatgtttgcctattttctttggctactaggaagattagaagaaaatgtgccgcccacgtataataattggatttcttaatcatatcttggcttcatataattttcttaccctatttttcagaggctctggtttcttgagtgattattcttcattctgttatattaaaaaaattccttcaaggtcccacaatatcttactgaggtatggactaaatataccaaaaataaaataagtatgataaaaattcaaaatatattgttttatttaaagacttagaatttctgtcaatgtggactactgacattttctgttaaattaagagaaagggttagatttggtttggttttaggaatatagatataatcatatcattgtatgaaaccatgcatcctactatgaatgtatgttttgttctattttggagaagctatttatttctagggcatattgccatgcacaattagatatatgatacaaagggacagttttctgcttcctgataacaaaaattaaaggtgaatttctccagatttattccagggcttataaaatattgttatcatggatgacctagtaacaaatgtaacaccccataacctttagtgacaatagaattcattactctaatgttctattgcctataaaacagagattgaaactccatgcctatcatgaagatgttaacaggtgttttaagctagattgctaagctctcttattactgatgtctgggagcatcctatttttactgcaactgggagggcatgatttttctaggcagtttggaccccagagacataaccgtctgagtacattcttgttagcaagagggaaaatggatgattggaaaaatagcattcaagtgttccagggaagagggaggaaggatcctcaagggctgtgttagtctgttttcacgctgctgataaagacatacccaagactgggcaatttacaaaggaaagaggtgtaatggagaactcacagttccacgtggctagggaagcctcacaatcatggtgaaggcaagggggcataagtcacatcttacatggatagcgacaggcaaagagaaagcttgtgcagagaaactcccatttttaaaaccatccgatctcctgagacccattcactatcacaggaacagcatgggaaagaccgccccccatgattcagtcatctcccactggggacctcccaaaactcatgggaattctgggagctacaagatgagatttgtgtggggacacagagccaaaccatatcaaggggaagaaaagaaaaagggaaatattgctttgggatgaaaaaaaaatgaatgtgcagagggcagaggacacggatgacttaggtaagtccatgcagagtgtaagcttcatgaaagcctttctttaataatctctgtgatgtgtgatgtgtcacataatacatggattaccttttcatgccgagagttctgttagtaaatcaagatgatgaattttcttgatgaatccccgagtgtgcttagaggagagaggtagaggaggctgtgttcggggctctggattccctcaaagcaactggcagttggcttttcctggctggttccttggactacatggatcctgagtggtgctgtgaggtgccagaaacaacaagcatgtcaagtctcacttcaggactgaacaaagttatctctgtccagtgcgtatccaaatgcagtgaaaaaaatgcatgaacagatggaggaattcacttgttccattttcctttggtgaatcttaggagctgttttgcccatgatatgtttgttttccatacttttatatgtttttccccagacacggtataaaatttagtatttaaaggttagttctggcaaagttaaccaaatagctcttatgcgaattccacagatgtgcttatttattcatgtgtagaatgctttctgtcctcaaattactgttctttataatgaggccatgccaataattaactattctttcacagcttaagggtcactctattgttaaaaaaataaaataaaacaggagaagcttgatccacacaaaaggagtatggtttataatttttactattggatgcactgaataacatgacagcaatgtttaacatttaacataacagctattttattaattaaaagatggctttcagtgttcttttttttccctctcttttatttatattgtcatttgctgcatggagttttatattttaggtagaattaagaaactccagcatgtgggatgcagaatgtctgcatttatttatttgcagatgcatgtgtgataccagtttaggaaactctattttaaaggtaggatggtttaaagtcagaatgatggtacatagttcatatatgttaagattacgatctatagaagccccacttgtctaaactgcaatatcctcctatttggaactacaactgatgttaaaaagaatttattttcatgggcaattttcttcttcaacttgctgaagtcagatatagaaaacaaaatgccatcaagggtaatgttattgcccttgcactttaatctggaaagggcagaagagctttgcaccttcaggacttcctctttcttgagataagtgatgttagcttcactattcatttagtattgtattatattatacgttacatatttatatattttataatatggtttatattcaaaagaagtcaaactatccagacattacagaaatggtcacactctaacaagcatgatcgtgagtactaaaatagtatccagtgccttggaccaagcataagtattaaaaatcatgttttttgtttctttctttctttttttcttgagacagagtctcactgtcgcccaggctgaagtgcagtggcgctatctcggctcactgcaacctccgcctctcgggttcaatcaattatctgcctcaccctcccgagtagctgggattacaggcacccgccaccacgcccggctaatttttgtatttttagtagagacggggtttcaccaccttggccaggctggtcttgaactcctgacctcatgatccacccgcctcagcctcccaaagtgctgggattacaggcgtgagccaccgccccggccagaaatcatatttaatgtgaacacaattacaagaagaaaatagtgtattataataattgtttttctaaaatgattgatggagtccaaataaaattcatgaatctgacaaatattcatttagtatgccatgaatggaacactgtactgggaagagttaatgcaacaaaaatgactgaaacataactgtcctaatacaacctgtaggcctataaaaggggcagaggccagaatttggagtctgacataaatataacgtgattaaaatgtttgttgtggagggtgaatgcagtggtagcggcaagcttctccaggaattgtcatttatttactaaactaaaagaaacaagctttgtgataaattgcaggttaatgttttgtaaatatttattttttaattttaacaatagttttattttcctataaaatagcttgttaatggccgggtgcagtggctcaggcctataatcccagcacgttgggaggccgaggcaggcggttcacaaggtcaggagttcaagaccagcctggccaacatggtgaaaccccgtctctactaaaaatacaaaaattacctgggcttggtggcatgtgcctgtaatcgcagctactcaggagactggggcaggagaatctcttgaacccgggacccgggagatggagggttgcagtgcaccaagattgtgccactgcaccccagcctgggctatagaggaagactgggtctcaaaaaaaaaaaaaaaaaaaagcttgttaatgcctttgctgccgcccagtccctgaccttgctgtccccagctgcgctgagcacacagctttccacagatcctgctgcacaggcctcttcctcattccctccaaagccatgctgcctcaccgtggcgctgtccaaatgcttctgatgctgtacgccgtctcttctctatgggacctcagtgaggcacatactgctcctctggggctggcgatcacaagtcatgggtttaatccctgctctaaatgttactagctgattagactttgggcaagacatttaatttctctgatctgtgccctcttctgaacaatgtggattattgtaagacatataggagtggttgttgtaagtatcaagtggggtaacaaatgggaaagattctcccaaggcctgtctcaggcaaaccatcagttatgtccattaacccttccctctctctttttctgcctccctcctcttccatccttccttcctttctctgtttcttgcttgcctttttctttaaaattctttaatctcctctttctcttttctgtgatataataatcacaaaagaaggacttatgatacatatgttcaggtagttcagaaaaggaaagagcgtttcacaattgaaagcatgagagaagtattcaaggagcactcatgtaggtcttgaagtgaaagtagaccttacatatatagaaaagagagaaagcatgtccagatgggtggatgtaaagttagcgccatcatggagggccttgcctcctttgtactctattagacaacatggaggctctgaagtttatttatttatttttttgagacagagttttgctcttgttgcccccgctggagtacaagggcatgatcttggctcactgcaacctccgtctcctgggttcaagcgattctcctgcctcagcctcacaattaggtgggattacaggcacgtgccaccatgcccggctaattttttgtatttttagtagaaacagagtttcaccatgttagccaggctggtcttgaactcctgacctcaggtgatccgcctgccttggcctcccaaagtgctgggagtataggcatgagccgctgtgaagtttattttttaaaatcatttctaggtattctataaaggattgcttctgaaaacagagttcatgattaatagactaggtagagaagagaagtggagagaccatttcagaggatgtgaatcaaagtaataacaaatgaaatggaaagggctgttgaggaatgaattgcagtgtcactgggacttccagccaattgcttctaggtgtgtaagcagtgatgatggggatgctaagcttagtcattggaaggacacaggtgccatgatcatggagaggaaacatcaactgaaatatttttgactagaaaggtaatgaacaattacatgtttgagatttcagctggaaatttgggaaaatgtgtttagaaagtgatgggaagtacaagccttgatttccacagctatttaaaacccacttccagggattttagaatagaggttaaatgtaagaagtagacacattcaaggataatgaatgtccggagagaagggcttagagcagatgacctgagggaagtgagatttattttgtgaatggtgaatgatgatccagagaaaacatcatcggaagctgaactgcttacaaggttgggatagtgttgagagaagagagcactggggtattttgaatagtgtggtgcactgagtttgaggaagatggaggattaaaggctgttgggtttatcaacttagaggtcactggagacttttggaaaacagttttacagggtgatatttgttaaagcgagagcaggacgaatagtgtttcatagtaagccatggaattggatttgatggttttaaatcaaggcttgttttccactagttgcttcagatgtaagatttagtgtctttctgggtgtttcatgtaaagaaaagataatttatgtgaacttttgtatttttaaatgaatattcaatgcatttaagttgcaaatttcagaaccctttttcttgagctctaaagcttaactccaatttattctatttataaatgtgatatagtgtagcaaccactttcaaaaggacctttacaacttagttaattaaattccattaaatatttaaacagcaatcataaatttaacatattcatttctgttttgaagcttttcaatactccagcaacttagatggccccaagttctagagaaatctacataaatataataagttgaatatgcaagtatggtggcccttaagttctcataaatattacaatattgtttatacaacagtagatttttcttataagtttcaaattaaaataacaaatccacataaatcacccaatcttaaatgtgataaatacgtaaaatagcaactatacacaaattatttctaagtgcaaaagtattaaagcactgggcttgttgttgctacttcatctttgtccctttttctccatttggctgattttaagaaaatttatactctaggaaaacaattctaccagtcagggtctggtttcctcagctaccattccttttgtcttcctccaatttaaaagctgaaaagtaagacattcaaattctcagcctgtcttgcagcaggaggaggccacttgatacgctgctgtctgatgggatatagacaggagttcctgtgtattttaagttgcagataatagggaaccagatatccactcatgactactgagagttggacctagaattatcataatatctgacgcttctataaccctcactgtattccagaaaccatcttctgtgccttctatgggctaactataacacctataacaactcatgaggtagatgcagttatccttccatttcatcactgaggaaatggtagcacagagaggtcagttacttgcccagagtcacacagccagtaaatgacagcatttaagatttgagccccagccccctcattccagaatcctcttaatctcttccctatagtcacctctccctgatctccatttttccactgggcgtccgaagctctttgtcttatctattctgcactgtttatgacatactgttacagctaatggtttccatgtgtgcctcccctgttccactaagtggtccttgaaagcgtgcagcatggctctttatatctccagtcacagccacagtctccctacagatgttcaacaagtattttcatgaacaagtgacttcagatctataaaattacaaatgccatagatagacttacttcaaaaactcaaccgaccaaaccaaataattatttgaaattaaaaagaagtaaaccggtagaatagtgactattttactccataaagagtgtcactttgcatgatctgaggacttgggaatgttggaagggcattgcttcaggagatgtttcaggctaagagaaagatctttttaaaatgtattttgttaattgcacaataaggtggaaggaaaccaggatgcttgagaaataccctgcgcttcatggtaatcgtggagatgtggccacactgttcagtaatacatttttatcactttgtctgtatacattagagcagagttcgagaggacaagtgccctagttctcaattccttttatacttaggactttgaccataaagaaacctaacattgcaaagattgacagaaatattctctacttcctgtaattaccaaagcatcctggtacccatcagttctggacttctgtgttaccatctttgctcattctgacatcatgggaccccagagagctgctctgattgctttttgtatgtaaaagcaagtttccctttttgtaaaatcaggaggctgaaaatgagcatcaacatatgtgcctgaatgacttgcctgttggaaatctgctcccaggactggtgccaatgaaatattccaaacacttgtttgggaggcaccgtagaacacattctacgagggaggaggcatagtatgataattaacaccgactctacagagtcacatggcctggatgaagtctggctccgtttaagttgtatgactttatttaaatcatggctttctgagttttgctttccttacatgtgaaattagggtaatatgagaagtgcttatgatgagaagtaaaataatataataaagaaagtgctttatgagcaacacagtgctatccaaatatttgtaactattttccaaaaaatatataattaggaacctatcatacctaattgtaagccctgatgtttcagtgggtggtttcccagaggttgtgatgtggtatgttagctttactggaagaccttagcatacaggcagtttcccttcttgttatctactggagggtgggaacaacatgttggctctccccttcacatgcctcaggatgtttatttaaaggaaaacagctctcttggtcaagaaaatccccccttttcactctcttccttgaattttgtaataagacctgcttactttctctaaaagagcaaagcgaacacccatggcatcatatctgtgtggtaccatcttagggaggaagctgaggagtcccctacagatctgctagaaaaggagaccttatgttgcacctttgcatctttctccataaatggcagtgtcgttattcaagactttggcaaatgtctgaatcaaacattctgtagggaaagaagacaactaacaatgctctgttcagatctatgattttccttgaggaaaaccaaagtgtgagtggtgcctgggcacccatgcggagctgatgcctgtccacagacatctgaaagcaacaccacattgtcaccagcactgaggagatgatccacagaaaaggagtgtcccttaacacattgaaagtacacgttcatttcatgatatgaggtgtccatttggtttgagcgaagtgatcattatgtaacattggtttctctcatctgggcagatgcatccctataccagctgcctgcaagtccttccacagccatccagcatcttggcatccacttcagcttcctctgagggttcttccccgcatctccagctgggcctgagggacaggatttcagactccttgctgctgacttttagccacctgcagcccttgattctgcctcttgcccttcagatgcctcttgcccttcacgttccacccacctcctttccagctgtaactcaacatttgtcacctcaaccagatattaagctatttaaaaggtattttcctacaacagccttatggagctgaaattcacataccgtagatttcacccatttaagtgtacagttcagtgggttttagtgtattcacagaattgtacaaccgtcaccacaatctaattttagaacttttttttatcacaacaagaaatctcacacccattagtatttattccttatttgtccctatccccctagccttaggcaacctataatctctttttttgtctctgtagatttgcctattctggacatttgctgtaaaaggaatcatggaatatatgatttgttgtgaatgggtttctttacaaggttcatttatgttgcagcatgtatcaatacttaatatctttattgttatagaatattccatttataaatttacaatgtattatttacccattaatcagttggtagacatttggattgctttcattttttggctttaatgagtattactgctacgaacatttgtgtacaagtttttgtgtgcacctatgttttcatttctcttaggtatatacctaggagtggaatatacctaggagtgctgggttgtgtgataactcttatatttgtctttttgaggaactgcccgactattcaccacaaaggctgctcaattttatattcctttctgcattgtgtaagagttccaatttctctacatcgtcaccaacactttttattatctttttgatgatagccatcttagtgggtgtaaagtggtatctcactgtggtttctaagccccctttttaagtccaaagtatgggaagaataccccataactgctttcttaggtcatggagatgaggcactgacagcaaagctctctccaaagaaaatgtatgtgaagatcattctcttaacttctagcctatggaaccttccatttctgagatggcaaggaatttaggactcattacccttggtttcccccacttcctttcctgcaagttatggatggtggggtctgccctttcactttgacatacctggcctagagtcttcacgcttcagctgaaatgtccatttaacatcatgttacaaatgaactatctttaaaaaaacagatcttccatttataatatatccactgctcccccattcaggcacagagctctttagatttcatttgaagtgttttcctctttaaaattaactacatttgatgcaactggctcctttgaaggaaaaaaaacacagactgttgcacatagtcatgaatcacaaatgagggtgtttatatattcaatgagaaattatttttgctggcaaatggttgtgtttttttccagtccccttaaatccttaccttttttaaaaaatggatttgagctggctaaccaaaatacatatgatacaacagaataaaaccaatagagaagaaatcaggcaaagggaaagaaaggatagaaaaatgaaaacacaactaaggaataagtaacatttgcaaatgctagacataggcacagttgtcagaggtggtcacagatgtatccaaattccctaattgtttaaacaaagagaagaacacaatcaatttcacaattttacatatttatatgacataaagaatgtagttgcttaggacaaccatacattttcctaagagaaataaagtctcctgtgttcttatagtaagcatattgtggactgaaacacaatatgctcagataaataactcttagcctgatcctctctctttgaatatttctcaatgcaaacaggtggcacaaggctaaaggtgattttattaaaattcattatagaaaatctttatatagaaatatgttaatgataatcttgctttggactgtctaatcttgtgtattttatgacattgtacttacgacattgcatattttcacaatagtcttcacagtcacatagacacactttaagtttgttgataaatatttctaattttagtaacagttttaccttatatgaaacatgagatctacttccgttggtgatttacccattggatacatgtgagcgtttgtgtatattcttgcaacttcccttctaagatagttcacatatgaattgtcaacttaaaaaatgaattttttttaccaaaagttgtggattgatggtcaggataaaattatatacatgggaggccattctttgaccttctctacatcttataggagattgaaagattcttccttgcttattgtttttcttcttttccccaaaaatgctgctcttgggtataaaaaaagagttaaaaattacaaatctttaaaccacatctggtttgtgtgttctcagaggccacttgctggaaaagcaaggcgtgaggcaaaaaaggaaggaaaatatcgtatagtccagttaacccgttttataaggaaaatgaaactattcttaggagttatagcaccatttaaaaatgtagaaagaagtacaggaaaagaacaacttttttttttcctccgaagaaaccagcagcccatagaattagctcacaaatagaaatcagatcacatgaatgcacaggaatgccatggtcaggccaggagacagttataccatgtccctggcctcgggtggttactgttagattggagtaaaaatcagaggtaatggttttactgaggcagaatgagctatgtgttggtgccaattcactgtcggggaagtagacgaataaattattaaatgcgcatatgtgttactgaggtgtatttctgcttaatggacacttttggctgtttttagagatgtttttatccaaaactacttaataaggggagatttatatataaatactccctggtgagaaatacaaatagtttggtctttaataaatcaaaatctgaaaagcacttcctaagtcctccctctgtgtggtgggggagaataatatatcctaattttgaagcagttcagacattttaaaatatagagtctggggaaggagcaaacacatctctaacaaggaggatgcaaaagctccttaagccaattaattagggaatttgactgatgaaatagtttcactgctttcagaaacaggtgtttggaaaggcagctgaagaacgaatcttatgtccacttcgctgatggctatatcatttcctccctacccccagaacagtgtaggcatgtggtaggcattcagtaaacctgtaaaagcaatgagcgagcaaggctaaagatgctgtctagaattgctgtaggtgacctatgctgatgaacaggtaggactacattgtaatttgcattgaacatatttgttggttaatggcttcttccctggtatttgagagttggctttcctaaacattttaaagcaattcctttcaatcttatatatgctattatattgaattttccataaagttttgtattagtccattcccacactgctaataaagacatactcgagactgagtaatttataaaggaaagaggtctaattgactcacagtttagcatggctggagtggcctcaggatacttacaatcatggcaaaagggaaagtaaacacatccttcttcacatggcggcagcaaggagaagtacagagtgaagcgagggaaaaaccccttacaaaaccatcagatctcatgagaacacactcacatggaacaccatggaagtaatcgccaccatgattcagttacctcccactgggttcctcccatgacatgcagggattatgggagctacgattcaagatgagatttgggtgaagacacagccaaaccatatcatctcactcctggcccctcccaaaactcatgtcatcacacacttaaagacacaattatgccttcccaacagtcccccaaagtcttaactcattccagtattaactcaaaagtccaagtccaaagtcccatctgagacaaggcaagtaccttctgcccatgagcctgtaaaatcaaaagcaagttagttacttcctagatacaataggggtgcaggcattgggtaaacacacctgttccaaatgagagaaaatggctaaaacaaaggggctacaggcctcatgcaagtctgaaatccaagttggtcagtaaaaatgttaaagctccaaaataatctcctttgactccatgtctcatatccagggtgtgctgatgcaagaggtggctcccaccatcttgcacagctctgcccctgtggctttgcagggtacagcaccccctcccagctgctttcacagctggcattgagtgtctgcagcttttgcaggagcacagtgcaagctgttcgtggatataccattctggggtctggaggatggtgacccttttctcacagttccattaagcagtgcctcagtggggacattttgttggtggtccaatcccacatttcccttctgcactgccctagcagtggttttccgtgagggacccacctctgcagcagacttctacctggacatcgggtgttttcatacatcctttgaaatctaggcagaagttcccagacttcagttcttgacttctgtggacccacaggcccagcaccacgtgtaatccaccaaggcttggggctttcagcctctgaagcaatggcctgagctctacattggcttcttttagccacggctgaagttgaagcagctgggacataaggcaccaagtcccaaggctgcacacatcaggggtctctgaacccaacccaagaaaccatttctgcctcctaggcctccaggcctgtgaagggaggggctgctgtgaagacctctgacatgtcctggagacatttgcccattgtcttggtgattaacatttggctccttgttactcatgcaaatttctgaagccagcttaaatttctccctggaaaataggtttttattttctatcacatcatcaggctgcaaattttccaaacttttgtgctctgcttcttcttgaacacgttgccacttagaaatttcttctgccaggtaccctaaatcatctgtctcaagttcaaagttccacagatctctggagcagggacaaaatgccaccagtctctttgcatagcaagagtgaactttactccagttcccaacaagtttcccatctccatctgagatcacctcaggctggacttcattgtccatattactatcagcattttgttcaagaccattcaacaagtctctaggaagtttcaaactttcccacatcttcctgtcttcagagccctccaagtctctaggaagttccaaactttctcacactttcctgtcttcttctgagccctccaaatggttctaagctctgcctgttacccagttccaaagtcgcttccacatttttgggtatctttatagcagcaccccactctctgttgtagcaatttagtgtattaatccattctcacactactaataaagacatacccaagactgagtgctttacaaagaaaataattgactcatagttttgcatggctggggaggcctcaggaaacttacaatcatgtcagaaagggatgcaaacatgcccttcttcacgtgtcagcagaaaggagaagtgctgagcaaaaaggggaaagccccttataaaaccatgaggtctcctgagaactcactcactatcacgagaacaacatgagggtaactgcccccatgattcaattacctcccaccaggtctctcaggaaacactgggattatggaaactacaatttaagatgagattttggtggggacatagccaaactatatcaagtttgctgaaaaaaacctcaaatgattatcacaaaataagaatagagatgagttttgaattaatgcatttctccatagttaacttttttcaatttaaacatttagttataaataaatatttaattatttggaaactgtgactatgaaagtgtattatttctcaaaaaaaaggaataaaatgaatgaatgagtgataatcctaggtagcaaaaccctagtgtaagctaatgcactatttttactctttgtattcatgaacatgcttgaaataaagcaatttatttaagcacttgttttggatctcttctctgttaggcattctctagatgtgagaaaatcagataacaggttaaaattcatgctctcatggactttatattttagggagaggagaggcaataaacaaattttaaaataatgaaattatattatggtgttaattagttacagtggactgaagtgaaaaaaagtagaatgattaaggaggtgactcagggtagcagtgctgcatgaaaaagtttctcagggaaacaagggagtaaagtctgcatatgtctaggaaaaaaacatttcaggcagaaggaagcaaaattcaaaagcgcctaatacaggagtgtgcttagggtgtttacaaaacaagaggaggaccctacatttggagcagcatgagccagtaagggtgagcacagtggggtcaggatgatgggggaagttatgtagggtctcacagtagcactccatctctgcactgtgttctgtatgatggaatccattggagagtttaaagcagagagaacttgatcaggtttctacttttaaaaaacccaaatgtggctgctgtggaagagagactctcatggtcaagcttagcagcagggagaaatagcagaaggccctttcctctttccaaatgagagaggatggatagtcatttgaactggaatcttggtggtgagagggtgagaagtggttcggtctgtgatctctgttagagccagagccttcagaaattactgctgcactgggtgtagagtgtggtagaatgatactagtcaagagtgaatcctaagtgcttagcctgaaaagttgggtgaatactatttaatgactcaaggaaaattagagaggaggaagattcaggagcataaaagcaagactacttctagacatgttacctgttacccttgagatgcttttaagacatccaaggggagcggtagagtcggcagttggatatttgagcctggaacacaaaggggatgttgaagctggtgatacaaagttggatgctggctatatatagatgatgtttgatgacagaataccatagactgggtgggttatacactatggaaatgtatttctcacagttctggaggctgagaagtccaagatcaaggccctggcagatttagtgtctggtgagggcccatttcctcatagacagttctgttctcattgtgtcctcacatggcaggagtgagggatttctctgtggtcgctaatctcattcatgaaggctccacacttatgacctaatcacctcccaagggtcccactgcctaaagccattgcattggagatcaggtctcaacgtacaaatttgcagggaacataaacattcggtttctggcagtatttaaagttatggactagataagaccatctaagacagtgcttttcaaaatatgtctagtgaatggcctttgttttttctaatttgctgtagactgatgcttttaaatacaataaaaataaatctaagggaaaacaaaatttaaggaaaactgaaataaatacatactaaatacgagtgccacttttttttttgctaatagagttaatagacataaaattattctgtcaaattgctgtaaaagtttcttaacactcactctggcttcctgtacttatcttgctatggactgagaacaaacaattcacagagagtgcttgttcatggatcatgctgttagtcacaccaacctgggaatgagtgtggagggaaaagggaccctgagccacaactttgccctcagaaagatgagaagggaggtgggaattcagcagactgtggttcctagaatccagatgaagatgtttcaagaaaaacgaggcaattacatagtatatgcaaaatagatccccaggcattaactgtaataatgaaataccagagtgaatggaaagatgttattttgcttttacacgttccttccccaagctttcatggtggtacggctctaccaatcttaagctttgtttatgcatggcctattctaagatcatctggggacaaacctgaatgaggaggtctcccaaaagagcaacaggattgccaaagtaaaagttgcatcagggtccaacctaaaagtactagccaagtgtctcaactcttagattggatgctgtagggggtcaacctggccattaaagtcattaccacaccaaccatttctgtgtattagggttatccttctttattttcagcagtagctattatttcagccaacacctatccaaaccatgccaacaatataggaatatacttgattctcagcaaaggtgatttcttcggacaaaggaaaaaatatctatgcacaatggttagttggttcaaatgcacacatacggacccaacataagatgactgcctgatgtagagccataagggaatcgtgggatccaggttttccatctgtaactcatcctcccacttataaatattaccccatctttcttacttaggctgctgcttgtctctgctcatccctccacctctgttccccacctgggggcagctgaacttggactattgcccagctagatgttaggatgaaggcccattctaatactttgctggtaattctttttaattatccacaaatgtctaaacattttctggcccttacccagtcccaatctggcagctttacctattccagtggttctcaatcaggagtgattttgctccccagggaacacctggaaaagtctagaggaattctgatataactggagtgattttgctccccagggaacacctggaaaagtctagaggaattctgatataactgggagggggtgaggtactactggcatcttgtgggtagagagtagggatgctgtttaacatcctgcaatgcacaggacaggccctgacaacaaacagttatctggccccagatgccaaaagtgccagagttaaagaactttgccttgtacttcattattgtgtcctccatgctaatgtttctcaccacttaaatattgtagatgttttcaggttgattgtgtccccacccacatctcaccttgaattataataatcaccacgtgtcaagggtggggccaggtggagataattgaatcataggggtttcccccatactgttctcctggtagtgaataagtcttacaagatctgatggttttgtaaatgggagttcccctacataagccctctcttgcctgacaccatgtgtttgcttctcttttgccttctgtcatgattgtgaggcctccccagccatgtggaactatgagtcccttaaacctctttcctttataaattacccagtctcgaatatgtctttattagcagcatgagaacagactaatacaagggctaattttttttgtttgtttgtttcttttgatagggtctcgctctgtcatccaggctagagtgcagtgatgcaatcatagctcactgcaggctcaaacttggggactcaagtgatattcccactttagcctcccaagtagctgggactataagcatgtaccactatacttggctaatttttttctcaaactcctggcctcaagtgattgtccttccttggcctcctaaagtgttgccatggctaacatgtctttaagatttcaacagttagcctcgcacggtggcttatgcctgtaatcccagcactttaggaggctgagtggggcagattacctgaggtcaggagttagagaccagcctggccaacatgctgaaaccctgtctctactaaaaatataaaaattagccgggcatggtggcacatgcctgtagtcccagctacttgggaggctgaggcaggagaattgcttgagcccaggagacagaggttgcagtgagcagagatcatgccactgcactccagcctggccaacagagtgagactctgtctcaaaaaaaaaaaaaaaaaaaaaaaattcaagagtccaaattcaacttgtgagttacacttagaaggatttattgacaaacttgttataagtgtgtatcctcggctgggtgcggtggctcacgcctgtaatcccagcactttgtgaagccaaggcgggcgaatcacgaggtcaggagatcgagacaattctggctaacacggtgaaaccccatctctgttaaaaaatacaaaaaattagccaggcgtggttgcgggcgcccgtagtcccagctactcgggaggctgaggcaggagaatggcgtgaacccaggaggcggagcttgcagtgagccgagattgcgccactgcactccagcctgggggacagagcgagactccgtctcaaaaaaaaaagaaagtgtgtatcctcagtcactgcacagcagtgttgatgcaggaagacatcagtaatgaaaatagctgatgggatgtctgaattgtagaatcgtttccatgtaatgcattggattatatctgagtgccctgtggcttgacttacccagctcaccaaaataccctcctggggaaacttgccttgacagagcccagagccctgggccttgaagagcccaggagactctgcctacaaaaaaaatcttcctcattaggcagatgacacctttttctgagctgtatacttgcaggtaagggacaagttttggtggggacactggctggattccagccttacactgccctctgggccaggcatttttgtttgaggcacaacctgcacagacttatgcttcagcctggcttgagtaatatctttgagatgaggattctgtttcgtttttatttactgaagaaacataagagccttctttgtgtctattttaggtgcttgagtataccaaggaataaaataagtaaagatcccttccctcaaagaatttatatagtgatgcttataatctagtggagcttgcatttttaaagttgatgatgtaaagctaataataactatacactgtaagtgaaaactaataaattactcaacatttcttccttaggtgcagatagtagtgacctggtttaaatagtaccagtgccttggactaggctttcttcctcttgcagaatgctccagctgacctcacaatggggaggaggacatgtgccttcttgtactacttgctatcacactatcctctgaccttgagtctttgctagtagcttggtttagtgtaaagggaagcatgttaccccctataggactagcacttcctgcagccccacctgcagtttctatcaagtctctgattgaacatttaatctaaaagctccattctgaatttatgagctgtttcctgcttctttttgttttattttgcttttcttgcctttgggcacctgaagcctatgtcttgggccatgtcagtcaaaaggttgcttgtgcatttttttttcctgttttgggggttttggatcactattgccctaacgtcatgagcggctgccttactccagtttctatataccaccatcactatccctaaccacagttctggagcaaagcatacaagagcacagaaaaccaaaaataaagtttctaaaacagatagcagtgagaagctcatgtaggtggactgcagatctgaagttcactggcagaagtgggactgacacttggtctacctttgacatctggaaagacacaatgcacaaacctacatgacataaattattgaatccagtcattcctattctaggactgtgacagctttatacctgttccattgaaaaagaatgatgattttttttttcaaaaagacataatgcatcaaacacatttctgtttccgtgttgtggttccaaggtgctatgatttctgaccattgtgtgctttcagagatatttccatgatgttcagtgaagctagacttctgtataattgggctatcataattgttacactattgaacacttgccttttgttcccataaggctctagcccagtggtaaaaatttttcttttcactttttctttgatcagtggtcagatggtaactggaatttgggttgcatgaaatggaccattaggggactgaaggatatgacgtggtggataatgtttgaaaggaaggattctgtaaacatggaggtttagatgagaacttagctgctttgaagaccaggccagatttcaggctgctcaagggagtcatttatagacttacatctacaaatggttttgattcagaaaacccttggctatgtttgtttgaaatctaaggattttgatatcttctcgctgagttttgactcatttataagaatagtgaatattagagaccatacaacttacacacaaatagaagggaatcacattcttttcctgtcattttggagagggaaccttaccatagtcaaagcaggtgaaacttatgattcattgtcgatttttaataatatatgtcaaagggaggggtgcaaggggcaagatctgaaacaacggctcaccttaaaaatgcatttgcgtttggtgtttggaggatttgctctcattacttttgtagcagattaacatttgaagtcatgtttgtttttctcagactagtattaaactgggtgcataataattacccagcagcaggaatctggtaacagattaagaatggagaatccatagagtcagtatgaataagggagacccaatgtctctctggaaataccacagaatgaagtaatagaaaaatcattttacctcactaaggaattataagtttcatggctccttttgcaaaagtttgaagaccttgagtttatttcatgtcgatcttcagaattttaatttctagtgcactgaatttacacattgcttcacatggaagtgtatgtactggtgaaaacacaaaatagaatgtttaataaaattgcagggggctaggagggataacattaggagaaataactaatgtaggtgacatatacctacgtaacaaaactgcacgttctgcacatgtaacccggaacttaaagtataataataaaaataaaataaaattgcagggaaggggttagaggcttttgaattcaaatcttgggggaaaaatggaaggagacatatgcttaagatgatctctattttcagtggacagagctaagttggtgagaaaggctgggggcctgtgctttgtcaggtagttttcatggggagaaaatgttgggtaaaagaaacccagattgagaaatagtcaacagacctcagtttctcagtgcattttattttattttatttttatcccaagccattggatttctctgacccaccaggaccaagacaagtaacaggaggtgagaatataggatttcaaaagcattaagagttgtaattttttttgaagtccagaaacaatatgcatcttgatatgcaataaaggactttgcagacttctcattgaatcagcagtgctttgtttactgtacttttttattacttcattttagtaaatgtatgaatatttatatagacttgtataaattcacccctaacctcagttcctcaaggcttcttttacagtcacatcttaaattcgtcaaccacaagttatccttctagaaggttcttggcgaactgtaaactacttcagggaccactgtactttcactatcattgttcgtttttatttcagtggtgtgtccagggatttgtccttagtttaatcaatctttgttttcagcaaaatgttgacgttagggcaaagttgtttttgtggctgttgtgataagaccttgaacattttcgccgctgcaattcaagaagcacttggctactctgtggcaggcagactctgaggattataactcctcttgcagggagggctggaacctccctagggagcaggcgggggctggacagtctgccagacacacgctctctaggacacactctctctttttttccccgtatagtgcttgtgactgatgaattcaatgagcgcttcaattctcctactttgttctttcagcagaccatttgtgtctttgagagcttattttggcaaatgaataatcagctatccaaattggctcaaggacgatcaaggggaatatttgacctctactttagatgatctacatttttaatgttagtatttgtgacttagcagagcggttgatcataactggccttctttcttcctcatctgtgagcatacatcaaaggctccaaaatatgcacacaagacaagtttaaaagccctcatcattgtgaaaatttcttgtgatttttattttaattgggagagaaggaggtgtggacaggagatgctcatggctattttttctacagatcaaatccatagatctacattgtattgtttttctcctttcagaactttagtataaattcattacttgtcttattattgaaaaatattattcagacatagtgaggtactttgatgtagttctagtggctatatttgttgtttcttagaagacttagctgtctgcaggggaagtaaaaataatggaattaagcagtgggatcatcccccttcaaaagtcttacatttattagcatatatttatttttttaagacagaagtccacaaactatggcataataaacaataatgctattctggaacatggaaagtcctggactggtcatcagatataggctctagccttgacttcaccagcaactgggcgtggggccatagataactcatttaactttcatgactctcagcattctcatctacaaaaagtgttggattaattcaatcagtggttctcaaatttgaatgtgcaacagaatcactggacctcattaccatattcagtaaagcttgggtggaaatctgcaaatttgcctgtctaacatggtcccaggtgataatgatgctggtgtggggagcacactttgagaatcactggattggatgatttctctgactacttctggtattaacattgggtgacttttatgctctgtggctagaatgatctgcttagagcttcagaatgcattggctgtgatgggtccaatgggcaagtgctacgagtagaactgaataagagcagaaatttgaatcaatagagtcatatggttttaggatggcccaaatattagcagtatctctgagtggtcaaaccccccaaccaagagttggtgtattggagtccagcagcaggggcatcacatggtggtggctagagcaagctgagcatttggttggactgatgagatcagtgtaaatgatgtgacacatttcaacaggcttatgtacatattggatacgggaaaaagaagattttgattgatttcacaagttagacaccgggcaaccaataaatgccacttgcattgctaccattaatgtagctttttataccaatgagaaaactgtactattctaaaagtaaaatgaaattaaataggctctagttgtatctgtatctctactgtccttcgggaatagtgaagtaactatacaagcacaagcacgtacattattaactaagaacagtggtggcatttttctttgttgtctagactctactaggctcttctagtgattctggaaatcattaaatccttgtttttttcaaacctcacccacaaggttttcaagtacatttcagttcctgctcaacacaggacaacacttgctcactacaatgaccaaagtacctgacttctagatgcaggcttggaagtgagagagactgattggaactatttttagttgtgatgtttttcttgaatgctctctgatgggaaaataaaggggaatggcttgagtttatttcttcatatttaggaaatcccttctgcctctgttgttcaacttccaaattattgaaacactttccaaaacctcatgcccctcaaatttgtatactagaccattgcctgaaaacaagtttgtaaatatataccctgtaagccttgaaaaaggctcagctcaggagaaattaaattgtattttgtattttagtggataatatggtactgtgggcattaacaaaaatatgtaattagggagaatcaatatattccatccaagaacttctcttatcaaaagagagggtagaagaattgaaaacatgaatgaataggcatgaaagatggatttccaaagaccagctagctttgctctgtgtgtgtgcgtgtgtgtatatgtgtgtgattttctctctctctctttctctctgtgtctcccatatacagatataaattgtgttgtcccatctatctaatgagtaggttagattagatcagtagttctttaaaaaggcagtttctgcacaccaacaattatatcgcagtctgcaaatagctatattttgcttgggcaacaaagccgaggaagcctcagtttgtaatttaaccgaaaacagttttcaaaaagcacatccagtagaaatatccttggcttcttaccttctttctccatcaaggtgaacacttttcattacacctagaaatagccaaacagccagtaaaaaatcactggccagtacaaattcttaggcaataggaactaaccagatgttttatcagccaatcagaatgctgtaaaataacctgagaaaggctggcactgaagacgtttgtggcaatccagtgcctagcacagaagatacttgtgtgtattgcatcaactgctcccagttctccatagcagtggaggagaagtcagagagagaagagagagaccagcttctagacttccctactgccctactggctggttgcattaaaagcatctgtttaatgagagtttgccaagtttacttattactaaataacatgtaaattggtatttgcagctgtactaagaattttcacagttctaggattagcctgaaagcagttcaatctagttactgatttatgtgtttctgaaatctaaaaaattttcccaagaccctgctcagacttttttttcactaagtctagatggtgttttcaaatattttacataaatatatttcactgtaaaaatgtaaactttatacatgatatttaacaattccttatattaagaggaagcaaaaaagcagctaagaaaaatgtttttactctccatatttctttctaccttcatgtaaatgggaatactttagttttatgataacagaccggttttaaaaatcttacttacctcatccttataagcatttcagtgttagctgaaagtaaattactctctttcctttctccattttcataatctattgccgccatttggaaatatctgttctcattagtaactatggcacttgcagcctaaatggtcatgaagtcactatccggaccatttttaggatgtccctgttggatgcaagtagtttaaagccatatgattcgtttttattagctgtgctgttcttaaccagggataataaaggctttgcaagtcaagtctgcatggcaaaaaaggtgtccacaagtgtgaatggctcatttttaatgactagccaacagccacttgtaaaagatgtaattgaaattgttcagagattaggttccgtctgctttgtcctccttctcaaaagttttcatggatccaagctattcttaagcattgtttaatactagaaatagcctttatggactaataataagaaagaaaaaggcaaattttaaaagatattccaaattcaaagaaaataagtttggcagcctgacttttgattatctgtaaaaatcagggccaatagtttgaacggaagagtaaatatgaaggttttctaaacagttttttctggaagagagggttggaggtgagaagttctcctttattcagcagcagtgcctacaaaaaacataaatggtgtttctgtgaacctcaaaaagtaaatcagtgagtggatgtaggaattggggtaaatgagcaatagctgccttgtcatttcaagttctgtgtcttactcctatttcacaatcctttcataggagagagagagagagttttctttaaaggcaaggtttgtgggtaagaaaaattattgaaataatgtaggaataactcaaaaccagagaagcctttgactcagttcaaagaggctattaggaggaaattgactaaagctgtacagactctaagacctgggcacttacattcctttgcatttcttgaagaatgctttgaattcttgttctactcctaggaggctctcgaacttcagatactaatctcaaagagagttatggagtccagaagacatcaattccctgtgacaaacagaaaactaatttacattcctgctgaaactctgtagattttattttctcaggaaaaaaaaaaaaaaagatttgtttccaggtgctttcaagttgttgtgatagagctagaggtgatgcacagaagaatctcagattttctctgccttccagctctgtcatccagtagctgcaggatggctgtgaaatactgaactgctgttctgtcatttgtaaactgaaaatgactagaatttccatgaccgttcttttgaggatagaagttggttacatatgtggaaacgttttgtgcacttaaggtactccagaaatctcaaagggctgaaggatgcagctaagtgggaaggaggcataattcatgccaacgtcaagcaggctcagtcagcctctctgtatggcatatccctttcctccccacagctagatgattcctattttcgtttacagatgagcccaaatggttcccttctcttcctctgttctcctgttacattctctttgtcttggcacgcgttcacggtgaaattacgataaagatgagggagataacaggtagcaccatggaatcaaacagccaagtagagttggcaggcagaaaacatgatgaccaccaagtccagggtgtcccatttttccaaagactggggcctctttctttaccatcagaatatttttaaaatcgcctcatatcttactaaaaaagaaataagtatcaaatgcttaaaatactcaaatttctaaaaatcagagagaaaaagtactttaaggagatatgatttaatctttatatagtcttaaggcgagaaaggactttataaacaagggcatttttttttttttaattttagaatcagcaggtacatgtgcaggtttggtatatgggtatattgcctgatgctgaaatttgggcttctaatgaccctgtgactcaagtagtgaccataataccaggtaggaacatttttatccagcccaaagtgtcaatagtattgagatcaaaataccctgttgtaaatgaatgttttctaaagtgccaaatatacaaaaacaaagggccggatagatatattatggttcttatacctaatggaccattttgcaacaattaacatgttaaagaaatgcatctatttatatagaaagcttttcacagcatatttgttttaaaaagccacttacaaagcttgtgatttcatttttgtttaacacggacttaataaaatgtacccacagcaaggtgtttaagggattgtctctgtcttgttgtgtgtgattgtaggtattatttttatttactttcattgtgcaattaactcgaattgcttctctattaagaaaaataataataaaactaattatggtaagtttttgaaaagtcatgctatggatttacactttagagtagttataattttagtgtccattgatttagaaaacacatgacaagcagctattattattttattaaatctttaaaatacatgtctttagaatagcaactacacacatttgaaatatgctagcatatgtatctgccaagaggttattatactttcttggatttgttaaaataatcgtggccacacataagcctgaggcacatactataagccattgattaaccagtaaggtgtctgcaaacatgaggctatattttatttagtagcagttcattccttcggcttttcctactcttgaaattgcaataagattgtgtcagaatgctgtgttaatataattctatcaatggcaagccacatttttaaagactctttaaatgaaaaagtgtaaatagtatggaatccacaattaacatggaatccagtcctattaaataatttcatttaaactttcctcacttttttttaatcacaactgaactgtaaacttgaaagaggattatgataatgaaatcatttttcctcttttttagatgtaattttcccagaattcccattgactgcctttgaaataacttagtccatgatgttgacaaagcttttaaatttgaagaaacatccttacttgtacatagtaacaaaacaatcactcactgaaattatgctttgtaaaatatatatttttaaatttccggactcggtcgtgtatattcaggaaatgtaaattatctattaagacccacaatcatttgtgagatgtttatattgttctctgataggtatagatgacattaatttcaatagatgttcattcatgcattcattcatttattttttgttcagaaaatgtttatcactgtgtactggacactgagaaaatgacagtgaacaaaatagacaaagtctctgcccccatggagattaaattccattgcatgctggtgtctggtcataggatctgaatgtctagttagaaaggaggcagatatgaccagaattatttcagaacgatatagtacctcctacacctttcacctggaaaattaaatataagtaaaacaaagtatttaacattttactaggtggaatcaatgaatgaaccaatgactgccatagaaccattccatttcaaagccagaaggcacctttgagaattatttcattttttttttcaattatttgctttaatccttgtttttttgttagaatgaaaaaatgaatgtccagaaagtcacaaagcaggtttgaggcattgctgggagaagcctccagccccctattggggtaagagtcagctgttctctctaaattgtctggagagttttatacccattgtgcacacctacaaagcatgcacaaaccatagctgatcattctgcagttattcatgtcataggaaaatgattagctgtggtatacccttatatgaggtagtgaaaatatattttaccttataatatattgattatatattcacttcaggcactcatctaccatatataacacaaagttcacttgaattatttgcattttggaaaagcaaaaaaaaaaaaaagaaaaaagttgagagagtcctagatgaaagtattcaggtccgtcatgcttcagctgtatacctgctgaggtttttcacaggctcatcattgcctaacacattgagctttacctaggaaataaactctttttgacttcttgtttggatttcaaataataaaggtgagatgtgaaaactaagggatgaagccttctggacccaggaacatctttgcagtacaaagatgccatcccctggagtcatgggttaagtctggaaggtagagagcaaagcattatccaggagttcactgcaaaaattgtctctgttgagataaactggtggagggaataggatggcagaagtagtagtaatgaggacaaacttaactcttaagtcattgattatttggatcaataagtatattgaacaaaataattaactcccacttagcaaaatgtcaaatgggaaatattgcagaaacctgtaataggctaacaacaattaaagaatgagacagaaaaaaaaaaagcagtcccatatttcagagtgatcattggaagttagacaattacacgaatattgcatgaatgggaaaatgaaagagtaagaaatggggcagccatgacagtcatttatttttcttctggacaaccacctttttatcctgttgtcttgggcaggtacaacatatgtgcctgtggacagaggagtgtttaaaaggtagcattgagttgacatgagaggcagtctgttctttccatttcctttccactgcttcagcattgcttactaagtaatctaccgcattaattttttgagtaggtaatttcctttttcctctctttaaaaataattgtttatggctgtcttggtgccaaaaatatcataatcccgtgttcaggaaggagattgccatgaacagggactctggactcccaaagatgttctcctgccctgtgtctgggcttcccaattctttacaaccttgaacttggagaaggtaggaaacaaaagatttattagtttcagcccattgaatctcttcacttccagaactacacctttatttatttgccttttttcctaaaaatatttaaaagtcaatcctagttgtaaattattatttatttatttttttgaaacagggtctcactccggttgtccaggttagagtgctatagcacgatctctgctcactgcagcctccatctcctgggctcaggtgattctcccacctcagcctcccaagtagctgggactgtaggtgtactccaccacacccagctaagtttttgtatttttagtagagatgggattttgctattttgcccaggctgggtctcaaactcctggactcgagtgatctgcccactttggcctctcaaagtggcaggtgtgagccaccatgtcaggctgaaaattgttttaaaagatgtttgaattgcttttttgaataaaagtgcttcatcttcttttgaaattgtgggttctcaatactaaagtgtcactatatcaagttatcaattgctgtgtaacaaataaccccaaaaaacttagcagcatcatgcaacacacgttcattatctcacagtttctgtgggtcaggaatccaggtaagactgagttgggtcctcagcttcagggtcttaaggtgtagactgggctgtggacacccagcgtttgactgggaggggatctgcttctaaactcacatagctgatagcaggattcagtttttcacaggttgtgaggatgaaagctgaagttcttctctgttggccagagaccatcctcagttccttgtcatgggacctctccaacatggcagcttgcttcgtcaaagacagaaagacagagtgtctgctagcaagacggaagttatagccttttataacctaaccacagaagtaacacctcttcacctttgccagattctgttggttagaagcacccttgtagggtgggggaatgcctgggagcaggatgaagggatcactaagatccatgttggaaatccacatagcacagccattttcttaatgagcagttccagtctaggtttttaatttactcagagtagatttaaagttctgtattcatatcccagctgggctacttaatattattagctctgtgacctcgggtgtattatttaacctcccctaagcctcactttcttcatttgtaaacataaatctgtaaaaagaggataaaagcaatgctctctcttagagttgttttgaaagttaattaaattcttgcaaaacagcgtactgctgagagaatgaaatattttcaattgtctaagtttttcagaatgctgaaaggcttataaacttgtttataagtaatttttaatttaacattttggttgaaacatatctgaaatgcattacgtagtgtcttcctaaacagtttatgctaattgaattgagccttgataatttatgaccctcgtgtaaaatctaattattgctttatgctgatatacagtgatgtacagtggcttttgagatgtttgaagttttttcccttcttaaatggccccaaattgctctgacttttgagtccttgtttttaatttgttttttctctcttgctctaacactgctatcaagtacatttcatttttatcactgggctacatctagcgacccttccatctcccaaaattttggtttctaatttcttgtggacttaaaatggagaggcaatatgtatagtgcttaagagcataagataatcctaggtgtaaatcccagcccttcgcacttgccacctgtggatactactcaactaagtgcttaactaaaagcatgtaatccccctgtgccttagtgtatatcatctatgaaataggatgctgtttttatttacagtaagttagatcctgcttatatgatgtgtaatatatggtagacgtgataaagtcagctattgttacttaacaatttacataaataagtgtgttagaatttttgaaacgtaagaagatacaggctgcaaatttggctctctttttggaccaaagtacgttggcatctgtaaaatttttggcgagttccaggttattggtcttttgttgagagactacatcgaatataatttgtggtaagtcccataggaattcctttgatgaaaggaaatccataatagcaatctcataatattacataggttacatagaatgattttctttctctacatcagagcattattttttatcttggttttataggtttctattctgaggaaggtatttgaactcacttttgagttgaaaacaaaatgcgtgatgttcaatttgatcctcattaataacaattataaactgttttgggcagagttatccagagagaaagaaccaataaaaaacatacagatagagctatatgagaagggatttattatgggaataggctcctgcaattatggtggctagtcccacaatatgctatctgcaagctgcagagccaggagcactggtgatgtaatttagtctgagtcaaaggcctgagaaccaggggagcagatggcataacttttagcctaaggctgaatggaggcctgagaacttagaggactgctggtgtaagccccagagcctgaaggctctacagtttggagttctaagtctcacagacagtttgagtctcacagacagactcaaaaaagctttactatttatctgggtatctcctagtccagttaagttgacatctaaaattccctatcacataaaccaaagattgagtatcaatatgttgttggaaagtgtttcataaaatggagactgacctcatatttctggttccatagatcagaagcaggacaacgtgatgtgaatggagaacatttcctgtattttgaccacaagatactattactatttgaatacatatcaattagattaaatgaaaatgcaagtatagagagatgtgttttctcatcattttctcaaactgagatgagtgtcaccttttggctaagagataagcattgtagaagtgaacattataagcagacaggtgtaaagaagtaagaagggaaaaggaaatgaggaaaagtacagaggcctctaggatccataaaggttagcgtgtgtgcccgtgatgaggagggataggagttagtacctcagaaactccgaggggggcttaagaacaggagcatcagccatgaggccagaccagttagtttcaaatcccagctttttcacttattaaatgcatgggcttggacaagtaattggccatccctgcattttagtttcctcatctgtgatgaaggccactatagtgttcaccccacagggtattgggagcactgaaatacaaactgggaaaattactcttagttagcagaatgctgggcatattgtaaattatctgtgtattttgctgccttaccataatctagagcagaagtttacaagcttttcctctaaagggccagattgtaaatattttagtctttggaagccaagaggcaaattgcaaatattatgtatctccttacataataagagataagacaaatttctacaaattttttattggtgaaattcaacatataataatgtaattaaataaaattattgtattatagatccagtaatgagaagaatggaattcttttgaggagtagatgacatttcccttaaatgggattcaaagttactgttctctaacaccaatttttcaaaaaatgttcatctgtaaaaacccttcttggtgcacaggtgagctatatacgaacaggcagtggcagccggatttgacctgagagctatgatttgctgtctccagaacagtggttctcaatttttcctttatgatcttggtactgagacgtacatgagtgaacatggatgacattcacaaatgttatgcactcccgaggccataccaagatttacccaatccccagcacagtagctgcaaccacacacttttgtctgacagaaaagcacatcaagcagagactttagtgttataatcaatatagtaacaaatgcccaagatgtgcatcacaactgagcatacctagccagtgtgttatgacaccaggttctctgaatatttctactattcagaacaagtcctcccattcacaacctaaagtgacaattcatagctgcaagaaactttctaaagaaggaggttgtattgtagtgcaagcaaagggagattcttttttctctttcatgtgcggggaatgataaaatagagagctgagctctagggtaagtggcaccatgcttcctcccaccaacaataatgcccagttgtgtaccaattgatggctctttcctgagttccaggagtgtgaatccatccatctgctgggaatctctgcctggatcaccttcgggtatctcaaactcacactgtagtactgaactcatcatcaagccccacccccaatagatcttatatctgtaccctgctctccaaccctactctcatttcctcatccagcctctctcacgtgaccatgcttacagtgtacagcggcttcctggtttcagataaatcaaggttcgttcccatagtctgtgggacctgaaccaacactccagcttcatctatatctgtctgtctgtctgtctgtctgtctatctacctacctacctacctacctacctacctaacagcatcatagaattaattgcctggtattctctgcaaacaccatattgtttcttagcttcttctttggtcctgctgtcccctttacagataatcctcccattccccaaatacggaatgccttacatcggcctcctagccttccatgaaacttcttttccctcatcccaaaggcagagtttgggtctactctgtatttccagtatgtcttaagcatgagttatacccactatattgaatgtagtagtgctttggtatctctgtcttcccacctgcgcactgagagacttgagaactaggagtatgtcttaatttttgtatccgtagacagggattcttatataaagaaagcacctagtcaaggtttactgatttaattagctctacagaactggcttacagccactgtgtttatctgagcttcatcaccacaaggcagagggagtgaatataagttagtagccaggagccagatctaatatttaaaaggctgctttggagatttcatttccattggcgtgtacaagttcatgattgtttcgaaataaaacttgttaggattttaaacttgactttcattatctctggtatattcttctttaaaacatatttgctcttcccaaatagaaagagtaattcatgactttcctatctacttattttgtctcagatttgattttgatttttctctgtcttcacgaaaccaacgaaataatagggagaataattgaagctttctaatcattagactctaataaagaaactcgatacactgtaaacccaccactacattctaccgtgacgagcagaacaacctgagaagaatacagttttttactctaagcagccttggttttccttgtcacaccactagtaaacaactctgttttaaaaatctgtaattttctttttttttctgtttctttttcttgaacttttattttaagttccggggtacccgtgcaggatgtgtaggtttgttttataggcaaacatgtgccatggtgatttgctgcacatatcaacccttcagctagttattcagcccagcagccattagctattcttcctgatgctctcccttctcctacactgcccccgacagcccccagtgtgcgttgtcacgcccccatgtgtccatgcattctcattgttcagctctcacttgtaagtgagaatatgtgataaaaaaaaaaagtctataattttcattcaaaagactgccttaagcaactgtgaaacaatttaacacaattttaccttaaggttcatatccacagcacatcacagaatcaaaattaagactgggctcatatttgctaatctggagattgtgcctgtctgcaggaggcatagtctttgcggtgtgaggaaggctacagctcggtggaactgcctccccaagacccagaaccaccatgggtacttagtgtgtacatcttgattgtaaatgcccagggctactctagaggtaaggaaaagtggagacaataaaaccagcaaacatacatggaaagacaagatgaaacatttagaggttcattatagcaaaagaaaaatataaacaatttcctggagaacttctgtttttattccttatttcacgcctttgctaactaatttgctattatttttgacaatcttttattagtaatatttataataattagactccaatatcatgaagctgggaagataaatatttgatgacaaaaacaaatgcccttggcaaagcatacacacagattatatttaaataaacttcatgattgttcataaaatgtctttagaacctaaaacaggaggaatgggtgtgcattatggtaagaaatttcttaataatcacacatttttaatactttttgttatgtttgcttcaagaaaaatttactacttttgtcatgtagtaaatttgtcatgattttatctcttcaacttcataataatagtatttgaaatatatacaatagatctcactgctttggttaacaagtccacagtttagtgtcagcagcaggaatggttgttgtttgtttttacactgatgtagagggaaatgaatacgttcaagtgatgttgttttttcccatgtgtttggataccctactactttacaggtagagtgaattctaaaggcaggtagatacctatcatttgcctaaacagtaacattgctggctgggcacggtgactcacacctgtaatcccagcactttgggaggccgaggcaggtggatcatgaggtcaggagatcgagaccatcctggctaacacggtgaaacccagtccctactgaaaatacaaaaaattagcctggcgtggtggcaggcacttcttgtcccagctactcgggaggctgagacaggagaatcgcttgaatctgaaaggtggaggtcgcagtgagccgagatcatgccactgcactctagcctgggcgacggagcgagactctgtctcaaaaaaaaaaaagaaaaaaaagagtaacactgccactgatatacaaacagcctttcaatagaaatttagtacagaaccaccagtggaaagaaaaggttattgaaaagtttgagtgggggtgaactgccttcttctgggatggggctggtcatgatagtacacacagagcgtggtccactcatggtgtggtgtgtttctccactagtgctggtccagccagggctccactcagccctgcctccctgtgcacagtggccacagtgctgtgcaggcaacagctgggggatttgctatggactacacagtagagatggagatatacatcaaagtctagaaatgtgggcattttgattcatttgacttccctttcagggcactcagggctcaatttatcaaaacaacaaacagtaattgagtcaataagacatatgctgtagggaaatgttcccaggtattgatccaaaatattggcatgatatttacatctgtttgccaaagtcatacattgtcctaattccatgaacagacaggcagcagggcatagaggcacggaggctgcatggagatccctcactgcattgtccgctgtcttcccacatggcctttggcacatggctccccctgccaccagctgcctccttctgggggagtgcgagaagactgaagttccaggaactgcccagtattctattctgcattggaatcctctaataaataatgccatatcaatgtagctaattatcattatttgagcatacaacttgagtgcatccatctggaacattcaaaattgaccctctatggtatgatgagtgtgtgtgttgtgggcaggaaaatcctccataggagaaatctagcattacccaggatgagatggagaaatccttcactaatccatgcgctactcatctgaagctttattttctagactttctcttctgaagtgtacatttagtccccatgcaaatgactgttaaagcaaatcagcaagagcaaatcaacaatataatcctcctggcaccacatggtaatgtaatttttcaattcaaaatgcacacgcaaaatactaaagtaaatggctctgtggtaactatatcaaaataagaaaaatgtttcgctttaaaaatatgctatatctagactggaagaggtgaagcagatatgacaaataaattcagtaggatcctggatgggtttctggacacgaaaaaaaaaaacactggtgagcagttggctaaatttgaatgaagatttgtagatttattaataataccatatcagtgttattttcccagttttgggaatcttactatcatcatataatattttaacatttaggtaagcaggccgaagggtatgtgagacccgattgtgctacctttgaaactttttttgtaaatctggagttatctcaaagtagagataagaatatttcatgaatcacaattttaatgccttatttatcttctggtaggtcagtttagagaatttttacaatagtattgacttttgattataatttaatgatccatatggaatcacagactattaaagccagatggatttgctctgttgattgacggagggaggaagaagaaagcagtatttagcgattaagtcaccaggtgccaggctgcagctaactctgttagttgtgtcctggtgtccacttgcctgtggtttcttgccatgcaaaccctgattttccgtagggccccagtgtgcccagcctgggtgatggatcatcctggtctctgattttccactcgcccttgcagctggggagggccatgtcagccagttcttgccaagaagataaagtgagaggatacaaaaagtatttctagaaaaactttgctttcctgataaaaggaacaaatgcatctggtgcctccctatccatccatttttacccaccttgaatacagctatggtgagtggaattctggcagccaacttacgaccgtgaggcagagcccaagaaagctgcagagatgccagtggcgaggcaataaacgaacgagtagctactacctccagactttttcatatgagatgaatttaaactcttactagtttaagtctatgttacatcttttgttacttgaagccaaaaacatttcctgttgtttatccaagaattttacatgaaccatttcatattattcttgtaggtataattatcattgtcctattatagagattgggaggttgaggcttaaggagattaattcacttccccaccatcatacaggaatgagtgggtctggtgttggaatctaagcatgcctggctctaatccccttcctttctcgctacaccacacagcctctgtttgattatttgtacccatgatgaggcaggcacgatgttagattaggaaacttgtgcagagttaccaaacttggggttatatcaagacaagattccagtcttatttttatatagctcagcaagttaaaccttttaacggaatttccacatctccaatgcgctttgctcatcccatcctcctgttagagttagaactagctttcttccctgttttgcagttaagccttctctgcgacaaaagttatgtgaccagcctaaggtcacagagtcggtcattggtggacctgagaagggaagtcagcttttcagtacctttcaagtcccttctaatgcacagcatttgcttctaccttttcatccctcttagcttttccctcaccatacatcttattgacactttcactcttcacttctctgataaatgtagccttgcctgccttgaaatggaaatcaaatggctcaaaacagtggaagaacgcagttctgaatatttttagtgggactctagttttcattgcctttttagttagaaaaatattatccagcacaacttcatttgtgatatcactttattcagtacaaacttattaagtccgtggtgccataagtatatgtataggaaatctgagatataatcatcagtaccttggagtttatattgaagcttgggaaagggagagatatcagaatgttgtaaatgggataacctctggctgggaatcaggaaatctgaattcccggccagctctgcttgtaaaaaagctgggtgctactcaatgtaggtattactgaggtacagtctgacatagtactattcaaaaatgtttgctacctctttgaaccagaccttccctggttccaaaaccacagctatctggactaatagaaggtcaaaggattaacagattttttttttttttttttttttgagacagagtttcgctcttattgctcaggctggagtgcgatcttggctcactgaaacttccgcctgctgggttcaagcaattctcctgcttcagcctctcaagtagctggtattacaggcgtgtgccaccacacctggctaatttttatattttttttagtagagacgaagattcaccatgttaatcaggctggtctggaactcctgacctcaagtgatccacccgcctgggcctcccaaagtgctggaattacaggcatgagccaccgtgcccagaaggattaactgacttttaataaagtaactataagtgatctaaaagcctcaaataatggatcaactgtgctccaaaacaacaggaatattataagtacacatgctctaaacagctaaacacctatcttaccagcaacatccacttcctcctctgctccacttaatggtgcagggtagttcaacctaagggagatgtcaggcacagtttacaggtgctcgcatccctcatgttcctggaaactgaactgtggaatacttgatgtgtcagcaagaaaggtgaaggcagcttataagatttctgaatcattgtccaaattcaataaaaatcctcctttcttggctagagaagagacaaaaccctctctttccatggcatagaagacaaatagttaaagtaaaaggccttatgtactctcatcactgaaaggcaccattgaaatagcaaggctttggagtcagaggttttacagtcagaccccctggtgcagccacagaagctatgtcaacttgggctagttacttagatctctaagtctattaaaatggaaataataataccctcttcatggtgtgattgcaagaatttttaaaaaatggcatatattatatagcacagtgactggccaggctcaataaatgattggaattagtggagggaagagctaattttcactaatcttctgctcactctcctcaaatatcctctattatatccctttttatttccatattgtttgtttctacctatagcttgacatacagtcttttagctcttcttacattctgtgaagaccttaatagtgactcagagctatgaaaattgtgagactttgtttttttttttgagacagagtcttgctgtgtcacccagactggagtgcagtactgagattgtggctcacttcagcttcaacctcctgggctcaagcgatcctccctcctgagcctcccgagcagctagaaccacaggtgcacatcacacctggctaattttttttaaaagcttttgtagaggcaaggtcttgctatgttgccaaggctggttgttttaaactctgaggctcaactgatcctcctgccttggcgtccccaaatcctgggatcactgacctgagcaaacaagcctggctgtgacccttcttttcaaggtctactgtgcctgacatataaatagaaaggaaaggcccagttaatgttttttaagttaatttacttgcattacacttattcaattccaagcaatcttactgagttgggcctcactttaaaaatttattttaaaaacattttcctggccaggtgttgtggctcatgcctttaatcccagcactttgggaggccgagacaggagggttgctttagcctaggagttcaagaccagcctgggcaacatagcaaaaccccatctctactaaatttttttttttaagtatctagtcatggtgttgtgtgcatatggtcccagctactcaagggaggctgagatgggaggatcgcttgagcccagaagtttgaggctacagtgattcgtgactgtgccactgcactccagcctgggtgacagatcttgtctcaaaaaaattttttttccaaaacttagagaattttttaataatggaagaaattatcagtggcctagatgcaatctacagaattccatactggattgctgctgtttataatatcgtagggagggggcatataaatgaagtgtgtggttgatatggttctatgtaaactactctacttggaacagggggatgagtgaaaggagaatatattcactggatgccccggtcaacttaagcaaatgaatagaagaaaggaaagatctggagagcataaatgttcactgtggttccatgttcttagattccctttccttcttttgcacatggatcctatttacatatattttattacattttttattactgctgtagcaaattaccacaaatttaatgacaaaaaaaaaccccacaagcctctttttttacagatctggaggtcagaagtctaaatcaaggtgtcagcaggactgttctcctcctgaggctttgagagcagaatctgtttctttgatttttttttcagcttccagaggctacctgtattcctttcctatgatccttttctcaccttgtcattcaaacttctactactgactgaccctcttcctcccctctaacaaatacttttgtgattacattgggtctaccgggataatccaaaataactttctcctctcaatactcttaacttgatctacacgttccattttaccaggggaagaagcatattcccaagtttcaggaattcagacatagacatctttggtggagggtgggggggctaccatatatattgatgtagatatggttttatgttttagattgtactgcctccctatgagtttctgttttcctggctatggccttggtcctcagaatctgttcccatctttgagaatcccacctttgagagtggcatattcccaccataatatggactccagatttctgtcctgtcctgataaattggtcagtccattgttttgctaagggtgtgccactttaatgaaaccatattaacctgattgaagaagaatcttgatataagcttaaaattaaaacaataatagtttaataatggcacaaactaatttcaaagtagttagagcgacagtttttccttgccttttctgattctcactcttgaatttggaggtgaaagtgggtgcatctttggttgttgtccgtggtcctgaactatcccagatactaaggttgtttctcttgacccctgagacaccaggaactgctgttcagtttctctgtcttgtttagaaattccaaagtaggtgagaaaagtagataagtctgtgaacagagcttagtgcctgagcattaaatggatacagactgttggaaaggcatagcccttgacagatcaccaggtagaaaacagaaaacatttctgacatgatttttaaataattgaaactgtaaaaacatttcacagtttaccatgttgtaaacatcaaacagctaagcagcataggaaatgtgtgcattgaacagtgcaaaggatgtgcaaccaaaacacaagcattgagcaagaaagatagggaagatgtagtaataaaaggatcattattagttgaatagcagaaaaacatttagagttgggttttttgttatttgctggaaaatactacctaatgtaatttattactgtatttttatgtcatacatttttgacagttctgtcatgtttttggaagttagtgtcactgtctactcctaccccaccatatacacacacacacacacacaaataccatcaccacacatcatgggaagctggtggggaatatgccatttcattaatttctccccaagcttcatcccaccccatgaaacacagaccatacttttgatacctgcccatatctttagtatttattatgcattagctcttcattttctaagggatggaatggaatgggaattaggaatggatttggggtatcagatgtcagtgatttacataatcatgtaggaaaaactacagatttcaccaaaaccagtgattacacattattgtttcagctaattcagaatttcaatgaggcatgagaatggaatatgggccaggaatgtctgctgcacatatttttgataattaaaaacgaggatagcagtctttttacatgttgataaggttaatcaaggcaacgtcattgcagttgtcaaaaaatcctgattattctcctgcactccattcattgtgaatctttgctttgaacacaggggagcttctggacctacaggtacaactataatctgattatgtgtttttctacttgaagagactacgtttttaactagtaaggcttaagacagatttcagtttttattaattctcaagattaagaacagatagcggcaacatgtcatgagtttcattaatgcaaaatgggaaccaaagttttgttcttatttttaaaaataatagtgataataataatataactaggcagtaaataaataaaaaatctgaatccagagccctttgttaagtaaaacataacagaaagaaatcagggtagatgccggccaacattcggattaataaagtgtgaacgtaccactcttgcatgcagattagcaagaattagcaatcatatagatgagtatagtaagttttaacctatttgctgttaccctcccaaatcctattttgctcagggcacacctccattttacaactagttaataaagaatactataatttaaagttcatgtttctatggtaacaaccaattataaatgcaatctgaagagatggaaggaagctgccaaaactcttaaggaaaaaaaacatgatctgggttggcaacccacaagaaatgttgcttgataagggcttttgccagcttcccctagcattggcctgcaagtttatatctgaacaaacatcttgcacccattttctaagcactgcatctgtaatacattctaaaaggataattgtgtctggggctcaacatatgtgatggtgaggcaggaaaaaattcgcactttttttggtataatttctcgcatatgtttcttataacttcatggcactaacatcaacactagagagagaaaagaaccttaagtgggctagcttttttcagaagcatattcctaagttttaccttaaatattcttatgttcattgtttatacataacaatggataatggtaacatttatggagataataattatagaacttaaataaaatgttagccatcaattgggagttttaatgtttaacatatgtatacctgattacatatatatcttaatataacactgtgattacatatgtatcttaatatcttcttcttaatcactctgtatatgattgtgctttgttttcaggaagctcaatatgcacacataaggcatttccaaaatagatgaattaaattgaagataattcatgttaaaatatatttcacattcattattccatgcatcttattaacaacctagggagagaggatgttttcatttccattttacatataaagaaactgagaaatggaaaagttaaggacttactgaaagtcacacattgttagtagtggaactaggggcaaacccccaccttggacctctagatccagcattgttttcactctacaatatgactcctccactagctcaaaattaaatacacctggatatcaagctttattatatcaaataatgtagcatttgaatcttaactccaaaaagtgtttatgcttgaaactaaccaattggtaatatatggataacgtattccctatcatctacctgtgtctttctcttagttgtagttaagtgactggaaggcaaaagagtgaaattgacaatgatggaaatcacatttaattagcatgaaatggtaagcagctgctatgttcaaatcttcctgttatgagattgtcagacttataaaatattatccacatggcgcagttttgaacagtgaaagagaagttgaatcaaaatttaaaagctcagtgcatagaaattttgggtcctaggagacacacaagaatttcccttttaaggaaattggctacgtattgtttgcaaacccctattctggtaaaaaaaaaaaaaaaaaaaaaaaaaagtaaattccagttccaaggttgaataacttttttcttagattagaatggtactcatttgagcaaaaagcactactattacatgtgatctaggacaatactaatttatcttctctctggccatattgaggaaagtggaaaacaaatcacacagtcccactctccacatgaacgccagcaatcagctaaacataataaacctgcaagagaatatttttatattatcaaatttgtttatttcccaaaatatgtattttggaaaaaggtatgtattttggttacctatattcaaaattagtcagaattcataagagctatcaacaaataacttaagcacatttcctctattttatacctcattaatgggaagacatcatggtataaagtaaattcgtgggtatctaagatgctcagaaaatgtatactttctctataataaggtatcatcaaaggctgtttctacttaaagtcctgttgcattttgaactccccctttcaaatatttttcactttctttaaatccccaactttgttcctatctaaagatatgactccatctcttattttactgagagaatggactccatcctttctatctcaaatttcctgctcctcaacatctctggcttggggccttcgttctcttcatttgtggtaccatagttctcaacgctgggtgcacaattaaataaaaacctggagagctttgaaaacaaatactgttgcctaggcaccctctagactaattagttaagaatatggtttgaggaccactgacctgatcttttcccctaaaagaaatccagttattcacctgtggtcaaggtcctaagtgagaaggcattgattcaccactctttctcatctccatcgtttttcttttccactttttctcatgctaccaagcagctcatttcatcacatcctcaaaaatcagtccaagaaggatctttaaagggagagagaatcccccttcatagaacacaggtagttgccgatgctcccgctagctttcttatccagttgcaatggcttaacaaagccatacttccagaagccaaataaaaccaaagatacattagctggaaataaaaaatgatcatgaaattgatcatgaaaggataatcttgctagggataatgtgtttaatagcagagcaccttctctcaagataaaaaacgtggtttcttactacatttatgtgataggagattcactgtaagaaattatctttagtcaactttgttgcttttctcttagctagtgaataaaaaccttatttactgataattgtcattacagtagatgacatatacgcttaggatgggtatttcatcttgagcagagtagacaagccatgccattaaacatgtaaaagagtggctttaaaaaaagtggatctcatggagttggagagtttcagaatggtggttaccagaggctgggaagggaggtgaggaaggagggatgaaggtaagttagttaaggagcacaaaaatagttagatagaaggaaaaagttctagtacttaataggacagtagaaaatttatagttaaatataatttattatatatttcaaggtagctagaataagaattgtaatgttccaaagataaagaaaatgtttgaagtaatgactattccagttaccctaatttgatcattacatattgtatacatgtattgaaatatcacatgtaccccaaaatatgtacaactagagtacataaatgaaattttttaaaaagctatcaaaaaaagaaatggaaaagagtgacttagcagcagttattatcttgtctccaagaggtgacttttcagagttgtggttcggttcacagtcattggtttccatgcctttccgagttctaaggaaaatcagccgtggcccattaaaaaacccttcatatcactttgataaaattttacatggattaaaataattttgagcatatttttaggcagtttaaagtcttttagatacagtcagcaaattaatggcaatatagtaagtttttgatttatagctttggcctaaaagtcgtcatggaaaatctattctgtggcagaactcaatgagcactttatttcaaaaagcaatttcattttgaagatagaaccacttactcttggaatacttgtttttcagcaaagatttctgaaatttccgtttatcactctgctctctccaaacctaatcacctttacctcattccagatgtccgacttgtgtttgtcaaaaatggatttgaaaactaattgccacatcatgtgggtattgaatatgttaagtgatttctctttggccagtcctcctttgaaacatggaggggcaaaggaagtctgagtctacaaagggagctgaaggggaagggcagtaactggatcacagtttgcacggctgtgtctatatatttttttcactaagaaaagagcaagattagtggtaaatatccagtatataatcattcatttgaagtaaagggctaaaagttgcctatggcagcttgtttacatttagtgaactgaaggaaaccatatttgtgttactggaaggaaccccaggtagcacccagaaaaaagaaaagcaaaccaaaaaaccccactatacatatatatttttttactttgcaagctgatcaaactccaccaagtcagaatatgtcataatttgaattggaattgcccaaagattactgactgtattttgggaggtgggaaaaaacagaaaacaatttgttaggtaaatttgacccataaaccaatttcaaggctattaagaattaggaatggattttagtggcttgacacagccatattgtttagtcaacaggcacttctaagatatgagctcagggagtcctgtgtgcttgtcaaagcaagtggagtaaaggttctgggaacctctgggaatggttggaattctctacagaaaattaagatgatgtttaaattcagccttttcaaaaactttaccctttactcaacctaaattaatgcagttttactattctgaagaattaagtacagaaatgtgtgacctgagagttagcatgcaaataaacaaaccagagcaggcattgagtcagatatttggccaccaccaaaagctgggtttgcctttgctgtgccacaccacacagccaggaaaattctgttctttctggtgcagaaggctctaaagaggaggagaactctgattccatttatcttgatattctaattgtaaagtttgtgatctcattatcactgccttaaacttcttggccagtcgctatttctaagatatgctgtggatgcagttgtgacagtgattcccaaggccctctgctatcatctctcttcccggtaccacaatggtcccgtttgaggaagaagacagaggacatgaggatggatttgtccaatagaaattggaacttagagtttacttgtcatgcttgaatatgttaagggaggttttactgctctaaaggataaatagaaaaataattggaaaattgaagcaagtgataacgagagagaaatttttaaaacgttcaaaaagtaagaagcagtcatggtacaccacagttttatttatgagtaagacttgcatgccattggatgttagtttaaccatccccacccccaagaaaaaaaggtctaagtacattgggaggatggggaaaggagaaattgtgtgagtgtgtgtgtgtgtgtgcgcgcgcgtgtgtgtgtgtgttgagtgtgtagtataagagtaaaatagtatattcagtagtaagaagccagtgtcagtgcctgatattgagaaatagagaagtactttctgagcatgttctttagaggtgaatctggagatttctttagaagagtttcaagtggctgcctctggggagaaaagggagcattcaagcttttaaagtatttgcaccatagtttgatttttttaataaaaagtactttaaatgtaaatgagaaaccaggaagtggaagcaatatgcatagctagacctctcttgataagtattgctataaaggagagtgtaaaactggggcagatgttgaagagagctgaggagttgagagaagaccttttcaacttttttaaaaaatatatactttaagttctgggatacatgtgcagaacgtgcaggttttttacatagatatacatgtgccatggtggtttgctgcacctatcaacccgtcatctacattaggtatttctcgtaatgctattcctccccttgccacccacccactgacaggcccctggtgtatgatgttccccttcctgtgcccgtatgttctctttgttaaactcccacttattagtgaaaacatgcagtgtttggttttctgctcctttgttagtttgctgagaatgagggtttccagcttcatccatgtccctgcaaaggacatgaacctattttttatggctgcatagtattccatggtgtgtatgtgccacattttctttatcaagtctaacattgataggcatttggttttttccaagtctttgctattgtgaatagtgctgcaataaacatgtgtgtgcatgtgtctttagagtagaatgatttataatcctttgggtatatacccagtaatgagattgctgggccaaatggtatttctagttccagatccttgaggaattgccacagtgtcttccacaatggttgaattaatttacactcccaccaacagtgtaaaattgttcctatttctccacatcctctccagcatctcgtttcctgactttttaacaatcgccattctaactggtgtgagatggtatctcattgtggttttgatttgcacttctctaatgaccagtgatgatgagccttttttcatatgtttgttgttttcttaagtgaggagcttaaagatggtgtttcttggtgacaggaaggaagagtgtaagtggagctattgataacgcaggagtgacagagaaagatctaaggagcaacctttttgagacagtaaggagggatgaaatccacagcccaagtgaaggcattttcttgtgaaaagttgaggaatattttctccattttaatagccgaggttgggattgtgggggtggccaaagggtgggagatgtttgaggagaaagggcacaaatagtggaaaagtaaatctaggaaatgaattttcctaaatttatttagtagaatggccaggccatttgagactttatttgacagttgcaataataaatataaagtgacaccaaacagctgtgtgattttctccagcaacaccaactggccaatgtgcaagcagagagcgggtaggaagttggagctatgaaatttgggggtttgacaggtgaacccacagcagaagagagaagcaacgaagttgaagatttttgcatgagaacgactgtgatggtgggcgtggaaggtaggttggaaaaagaggaactgaacacgggtggtggagaaatagtgagaaagtggcagggtgaagacctgagaatgtcagcagcaatgaagaatgggaaccatggcactgtcataatttccggcaagtgcactgggcagctaggaggggaggcagggacctgcatggtgcagttcctggaaatgagaaggtcctgggtgtgacactgagacgagatgcctaaggcagagtggaaaaaagggctgtcgaaggtgacatcaaggtcaggacactggatattgacatgttagagaatgatcattgtaagccacccatgaatgagataaccaacatgacagcaatgaggaggagagagggtgatataaatggtgcatcagagcctcaaaggagtaagacactgcaaaaacaaggagaataggaggtcagaaggagtagcaagaaaaccaaggagggtacctatcaaaccccaagccctgaggttcaggggatacccaagaaaatacattgctcctggagagggctgtagaggaatgagtgtgctcagaggacaggtctcagttaaggtgtagaggtgaagggagcattcagagaaatagttagggaagtaaggatgggtgctggattattgatattattgattgagagcaccagaaagcataatgggaaggcttagagaggaaaagaatggagttttggatcaggatgtagatgtatgggaatgggaatgagggctctcacagatctcacaggaaacttgcacttttggcaatgggccaggtaaacatggatgtggggcatgatgaatgacttctgagagtttcctatcagcaggtgagcactcaggtctagcatggtggccccaatgagtgagcttggtgatgtggcagtgactgtttccctggcagcctatgttgcagtagttctgggtggccacattctctgtctctcacagtagttattaccattgctttggtcaagattatcttaaagagtatagtagtgtagtgcttcatgaacatgagaggaagggctatcacaactcttgttggtcacctggggcaagtcaggcaactctgtgagtatcagattccccattagacaaaaaaaaattagccctgtaggtcctcttcaggtttgaatttttgttattatgacgttaaatatatgctgttaggtttgtagcatttttaagtgaaggatttgggcccatattacatggagatgtttactgaaattggatttataaagaagcacatttgctgaacttccatttttgacagatgtattatgttgaaattaataatttagagaatatgtaagaatattgatatggtttggatatttgtcctgcccaaatctcacgttgaaatgtaatccccagtgttagagatgaggcctggtgggaggtgggtcggggggcggggatccctcatggcttgatgctgtcacttcatgagacaggggttgagttctcaagagatcccattgcttaaaagtgtgtggcatctccccacccccctgctcctgctctcaccatgtaacatgccagatcctgcttcaccttctgctgtgtgtaaaagctccctgaggcctcctagaagccgagcagatgctggcaccatgcttgtacagcctgcagaaccatgagccaattaaacctcttctttataaatgacccagtctcagatatttctttatagcagtgcaataacaacctagcacacacacgcacaaacacaaaattagcttctatttcactagcacaagattctacgtgtgtgtatgtgttcatatgtcactgccatcatttttaaaggtattccttttcttttgtgtctccattcatctgagggttgggtgtagctatcatgaatcaggtctatactgcagcctagggcatgatgagccaaacttctgtctaactagcacgagactctgtgcagttatcagaatttcagaaaaacagcttatgattacaaggttaaaaagaatcactgcttggccttcataacttcccattgccacatgtatacatacattgcgtgctctgcatcgctctgaccaaacggctgtcgaggcaacacaggaagcgagtgaagctgggagtgatctcctgcagcaggtcttcagaagacctattttctcttgtagaggtttcaggggcacttggttaatgtgaccatgatacacattcacgtgtgcacacctacacacagtcacacacaccccactgtggacatctcacaatataggacaggctttcagcaacaactgggtcacctttgcacccagttggtggttataaactcagacaagatactttgaagtgttttatacacggaagaagagggcaatagtaggagaatagtgccttcgccctttctgtgctttcaagcatgtaagccaatcacctccctcctccatccccaattaaaggaaaaaaattagccccatacatggatgcttgaattctcttaatattaaaagtcacatgtgtgatgtaaataagatgaaaagcagtgtggattaccccattagaaacggagatgaactagcagctggttgcatgaacgtatcaaagagcctactgtcccagtgataattcttggacaaagcagttaggacattttccatcaaatccttttaagccccctcgcagttcagttgcatctggcacgcattgtgcctgttgtctgctataactttgcaacacagtgaaatccccggctttgactgcagcagcatgtggctctgagtggcatctgtaaagcaatggcacttcttaattttcataataaacagaaaatactttatgaacagtattcaaattggaatggctccatttatctaattgggctagactgtcatcataaagtgagtccttgagcagaaaaaagcaacacacaaaaatggcttctgctggtgacctaattttctaaatcattttttctgctagtgcaagtgctactaaatatattgggtcatcacaagttccacactccaggataggcgtttctaccggtgggtgaattctcagtaatcattgtactgttttgaaattaaaattagatggcattagagagcgttggtgaggggggtgtttcctccttccctccctccctcccttctttcattcctccacagaacaaaataaaagtgaaatatagaacttgccatgattgggaaaccagtaggtagaactggaattcaacctaggtctaccactgcctggatttcacttaagaaattttagagtatcattgttcattatattttttgatgttttctacttctttcattgcctgtttcctggcagaaatgtcctgagagtattcaaaaccctgtcagtccttgatatacttgcagtgccaactgcctgttcttttctgggaggctcattcaatgtagaataaagtaaattggcagaaatgtaatagtacaccagggagggattgtggtttaacatgagtttgatatagttagtaaaaagtgaattagaatagtttgtagatacttttaaacctgtgctcaaaggtattatttgattaaatttaataaaaaaattaattacttagtatgtataatacgtaatggacttacaggtacgggtggatgcaaagatgggtgtaatgagtgaacgacgcctcttccttccaaagtcatgtccatagtctcatcaccagaatccatgactgtgacctgatttgcaaaaagattatttacagatgaaattaaataaaggatctcaaaatgagatcatcttggattatccaagtgggccctaaatccagtgatgtgtgtccttatgagacccacacagaggagaaacacatggaagagaaatctatgtgaagacagaggcagagatcagagtgatgcagccacaaatcaaggaacagctggggccaccagcagctggaagaggccaggatggattcttccctagagccttcccagggagtgccgccccaccttgactccagacttccggcccccggaaactgtgagagagtacatttctgttgtttttaaggcaccaagctcgatataatttgttatggcagccctagaaaattaacaaagtaagtaaaatcagtcggcattgaagagcttgtaatatatgatatgtgacaaactgcacatgctgaagtgaaagtattaaaaatatagacgtgaaggggaattaatttcaaacagagctgcctggaaaggtcttttaaggaggtatgccttgatcagggctttaaagaagatgaaggcaagccgtgcagagatgggccaggaggagatttcagggaggtcagcagagccatgacagaggaggattcagggatactattggagtgaatctagttctgagaaaggagaaggtaagatcaaaacaaagtctaatatcacaagaagtttgattgtggtcagaaatacagagagcctgaattcagtcaaatagagaggtactctgttgttagctttaaattatggagaaacctactctttccatcttcctccatctaaaattacatttaagagatgggttcctgaggaattactgcaaggaaagaaattaaatttagagaggaaagaaataatttcagggatgttctgaaaactctataatgccttggacatgccctggtttgtagtatttaacatgtggtcgtttctatttatgtgactgtcttcattaaatgcatcctgtcttaatttcctagggctgtcacaacatattaccagcaactgggtgacttaccatgatagaaatgtatttctcacagttctagaggctggaggtctgaactaaaaatgtcaacagtgctgtgctccctttgaatgctctagaggagatctctgctgcttcctggcttctggtggctcctggcaatttatggcgttccttgacttgcagacccttactccaatctctgtctctgtctgcacatggccttcttcccggtgtgtctctgtgtcctctcctcttcttcttagaacaccttttattggatggagggcccaacgcaatggagtatgtcctcatctcaagctaactaattatatctgcaaagattctgtttccaaagaaggtcgcatcctgaggctctgggtggacatgaattttgggggagcactattcaacccaccacttagccggtttatgttttaacccatagagcctagcctggaatttgacataaaattgtaacctctcaatttttgctgaatacagaagtggatctgcagtgcccatgaatgatgtggcattgctaaaaaataaaacatgggagagaaaacaacggaagaaaagggaattgggaaagagaaaagaagcatctcaaattttgctgggagatataaatccaaagtttgtgtcagggcctataagggcttattagatttggtctcagcctgcctccacctccttgaaccttaaccttcttccagcttctgtaggtcctatgccctttgctggaaacatcactctccccattctgtacgtcactcactccaacattcttcagctcctggcttcaagggcacctctttttttttttctttgacggagtctcgctctgtcaccagactggcaacagatcttggctcactgcaaactctgcctcctggcttcaaatgattctcctgcctcagcctcccaagtagctgggactacaggcatgcaccaccacacccagctaagttttgtatttttttttttttttttgaaggagtcttgctctgtcgcccagctggagtacagtggtgtgatctcggctcactgcaagctccgcctcccgggttcatgccattctcctgcctcagcctccagagtatctgggactacaggtgcccgccaccgcgcccagctaattttttgtatttttaatagaggcgggatttcacggtgttggccagggttgtctctatctcctgacctcgtgaaccacccaccttggcctcccaaagtgctgggattacaagaatgagccaccatgcccagccaatggcacctctttaaaaaggtgacatctctgccagtgctctacaagacctcatatctttttttttgttgttgttagcagccatcagagtttggaataatgtttttaataatatagtcatttttatgtctcaccctctgccagaccagcagttacgtgaagatatgctcactgcagtctttccagccagggtgtttgataggtccttccgaataacagactttcagatagtttaagactattaccgtgtctaacctcaggctttttccacctgcacagcccacctgccctttgaggcaaccccatcctcttctccaccccatgtctgctgagcataaaggcaaagcacagacacagggcagcgttcaaggcagtcacccacgaccacacaggctggtgttcaggctgtttgtgctctgattccatcatttgtgaactcctgactctaccttgagatcacagctttgcaccctcctgtaggcttgcactttccccatcctgcaaggctctccagttctctgtagaccccagtgtaacccactcctttggttccaatcttcttcccatcacttcaatttggagccagttccctgactctgttcctatggctgtggccagctctggggcagatagtgtgggaggcagagtggaccaggggtgctgtaggaagatcatcacaccaggctatgaattgcttccctgggctgatgactcacctctcaacgaaggccttctaaagcacgatgcttacaataaaatgcgtgtgacctgcctgggtgaattagtgaggggcagattctggaccttgaatttgccctgatgctgcataggcccccgtggccagatcttccaacactgcttgttcctatttagtttaccttccactaaaacctccaaaatcatttccacactgatgctaaattataattctccccaaactcatgaagctaggtatttttaagtatacaacctgatttcaaaatttaaccctactaaattttatgttgttacagtcaatctatccttgcagtaagctgagattgctgtacatgatttttaaagaaaatactagagtctatctagttataaggatgctggtgtctcttaggtagatggaagctttcctctgagcacagaatctggagtctgaccacctggagttcagtgatgcttcctccgctttgcttgtctgatgttggtcccttgttcaacctctttgtgactcagttttgcaactgtaaaattagagagtagagttgtcgtgagctttaacgaggtaacccaggtaaagagcttagtgaagtgcctggcgaattcttcctgctaagtaaatgtgagccattattctgaccaccatttattattaaagccacccatgccagcatttttctcagcaaatcattttgtcagaggactgcgaacctagtcattggccaaatattaggtgctaaagaaaacttcctgttatgaagattcctctttctcttacaaatatagtacatccttttaaaaacaatgtagttgagaatctgtaatgcacctgatgtttagagcagcttccctgacatttattcactgaacccaggtggaatgatgggcatcggtcttgtctttaagacacaaaagtcaggaaatggggacacagaagggaaacactgcattttccaaatgtgagtcatggactcaagatgttaatgagctttctatgagaatggttctctgaagacatctgcctggaagataagattaaataaaattaaacaggcttgtagtcaagcttcttaaagtccttttggtcatgggaagtccgtgagtaccagtgcccttctgaatggggtggcctggtagggtagacagagtatgggctgtgtagccaggtacacctgttctagcctccttgctaggtcagtgagttgtgtaaaaggggggggggggttattgcatgtatctaagccttattgtactccaccctaaattgggtataatacctgctttgcaagattctcctgtggattacagaggacttatgttaaacctgagcacagtgtcaagctcttacttagtaggtattctatacatggtaggtaaacttagtattctaaactgcaatcaggatctcaaataaacctatgacagaacctaacacgtttaattctgtggttctttgtttcaaactttctgttgtcttaatgcattatcttctctccctgaagaacttggttttgataactcaaataaaaactgtttcatgtccactgtacggcagctacatggggtgtatgtgtaatcatgtatccaagaaggaaatattacatatttcatgcttcgggtgccacctagggtccagaaatgatgggcatgtatagaacatttaaacagggtaattgggaagagtttaccagggacttttacaaagttgaagacagagttaagaaggaccctaaaagagatgggaagttccctggtgggtagctcctgggcctgacaggacaaaaggagagatactcctggggcactagccagaactgggagagggcggtcactgtctggggagaagactttgtgtggcagaggaatggctgacttgggagatgctggatagtaaataccctgacttctctcttctccttcccagcctgtttctgctgggctgcccgttactcagttccaaataggagccagagagcaaaggagccttagtagtatatattaatgtagcccttagagatctggctgctgggctccaaacagggtacagaaggttccaaagtgggtctgctggtggaacaatcgcagaagctgattcccaagagtgtcccgtgaaaaacatccatttaatacccacattgcaagcacaacaagtatttttgtttaatccttaaggagtgaatcactgtgtcatcttggagctttaccaatagcaaaccactgtgatgttatgataatgaccagagcccactcaattttatatattcctaaaggcaggaaaaataacagggaaatggtattataatgcacctgacatcgtagctgtcaagcattgtgtgttaaagcaaactcttctggacctcatgattaaatgatgccatggagtatcttcccaggggtttaagaggaagcagaaacgagggtattttcacattacttgtcctttctgtttgattcaccatggattcattgtgaacccagttagtcatgtgctggtggataacccagcaagatgtattcctcctcattccagcccatcctttcaaaggtaagactgtgccatttacatccataatgcatcctggaaaacgtttgaaagctcaatgtctgaacgtcaagcagttgattttgtattaattcatgtggggtgagggaaggcagtattttcattccccgggatttaaacagtgtgatgaaatacctaaaagcagtgatgttggagttacctttcaggaaggtaaagactttgacagggttccaatgagacctggacagaaggcgtccggctttctccaggggtctggaaaactgactcaaggaccctgctttgttcatgctctacagcaccacctccctatcatcaactcagctacaggaccatctggatggatccatgagactgtccttggtgcctgcagagaagcagtggagggatgaggccccctctcctgccacagtagcatagaccaagtgtcccttagctgacagtaccttgatgctcacaccagtggggttcccaaccctatagtccatcttctgcggcacctgtagtctagctggatgacaaaagggaagaatcgaggagagggggagtcagaccaggaactgtcatgggggaaggggaagattaggtaggagaaagtctacttccaagccagccaaccttcaaccttcctgcgtgtgcaagctgcatgcctctggggacagggaagggaggggagctgcagtgccttctgcagctggcagatggaggagccttcccctggtgcagtgcggtgccaccatgttgtagctggaagtcctggatccccaagtgaggaagtgtcttcctctcctagggccgctgtaccaaatactgcaaatgtggtgccttgaaacaacagaagtttattctttcatggttctggaggccagaagtctgaaatcaggtgtcagcagggctgtactcccttggaagggtctggggagactccctcgcatctcccagattctggggactgcaggagttcctggctggaaacttcaaggctcctatcattgccttgtctcacacactttctcctccatgtctgtcctctgatgtctcttataaggatacttattattggatttggggcccatttggataatctagatgatcgtattccaagatcatcattttaattatatctgcaaaaaacgttttccaaataaggtgacgttgctaggttcaagaggttagaacatgaacatatctttatggaggcaacccactgtgggtaggaacacaaaagccctgggtgcaaaggtgttttaggagtttagtgcactgtatagtaacttaagttcagacctgcctagactgatttcttatgataataatttgttcatttattcaacaaatacttgagtgcctcttaagccagattctaacagacactgggtatagaacagtgaagaagatgaatttgatatctgccctgattgtggcagagttagagtttctgcagtgtgttgtcttacataaaaacacagcaacaacacaactacagcatgaaactttaacgactttaaatccctagccatgtgcgcctctcccatgttatcctgcccacactatgcacacacttcatcctgttttcacttcagtggcaacgcatttttggaaacaaagttctctcgtgcctgtgactgccaaaacctgttctcatccagataaatcagtcactaggtttatgatgccatctcgtttaagcatatttgcatcttagcaaggagccacagcaaggggataagcattctcttctcctatggagtgtaacacaaatgttatctctgttggctaaaagcggaatagacagtctacttgtactccagaatgcctttctgtacatttgcaccagttccatagaaagtttttaacactcagactgtttccatagtattttacattgttaatcatttaatcaactgcagtgacatctcctggctgagatgagagattactggtagacattttttaagggaatagaaaattacaacaatgttaaagaaataaaagaaattatgtttgccaaatgtttttgttttaaggccatcagcattttataggctcctattctaagtacccctaagttcagaacaacaaatgactgaaattttaaaaggttagaattaatagtatctcccttgacttaagatgagtaaataaaacaggaagacgtgttttaaaattggcaaactcttgtgggaaatactgccagagccttataaatggggtagtgaaggttttttgctcacagattctggggctttctcttatctttgagcgtgagttgggtgagcagctttgtgaacagtatctttcattttatcttaacaactttgggatacaaggctaaccagtgatcacacaattgtatgctgacgttagtctcctctgttcctgccttacaacaaaaaagctattgtttgcaacctaataataatgtaagaggggagaggcgaaaaaaacaacacaaaaggtttttcctctatagttagaaatttggtttcaatacaggccagagagcaagcagggtgcatttcctgtgggaaatacttttcaactgttttgttttgttttgttttagctttattgcttagtgtgatgccttagcatgaactgcttatgaaacttttaaagatatgttaagattcaggcaggtggacaacaagctcagccagaggcagccttctgtgtgattctgcatctcctctttgctggctacaccctatgtccagtctggtttctgtttgtatgttttgtttttctatagccttctcttcctccagacatccctcaaaagcaattcagggggagagaattcatggctcttacttgagagaatagaagacctctgagaaatgatggtggttagggctgggagaggaagtaataggtatttacactcacagaactagcaagatgttttccgtatatcatcatttgactagattttttctaaatgtatgattgtttgcagttcagaacaatatagctaaaagtggattcatttgttcacactggcattttaaatgtgtgtcaattctggaagcctaatgtaattgtcagaagctgatgcagtttctaggtaggaattctaaaaaaggtatgcctaccggccagatattgcagttgtcatctatgtacctttttaatgaggtaaacttgcaaatttatgtcttatagcatgactaattggagagaaaaaagccttctttaaggactcagtcacagagttatctgccaactaatgatgtgtctgatcattaaaatcagcttatggattttgttcatgggtttttcaggaagcaagtatggatgccacattgttctttagatggggaggtgggacaaaataggggagaaggtaatatgtttatttcaatttggaaggaaataagcacacaccttacatatgtttgcctattcagagatccactatacctgagcatctcattgatttcagaggcacactcatccgattgccactataaatataacagatcaagagaaaagggagctacatcttaaaactgggaataatagtggtccaaaaactgtcaaatttcttattcttaaatgttttcctaataacccataatctattttgtcctatatatttcagtgctatatattctcccttgaattgattgcctgcagagtaaattgttaaattgtgaataaatcttgagatgtaataggattctcagaatcaactttgaaaatttcagaatggttttctgccatagaaaccaacaatgccttgttagctaaggaaaaataaaccagatctttttctatgaattataacgatgataagagcacaatttccaataaatagccaacaggaaagacccattggactcagcccaaagggcaggtgagtcctctaacattagagggtggaaaactgcagccctcgggccaaatctgtcctttccctacttttataaataaaatgttattggaacatagccatgccatttgtttatacatcatctatggctgcttctgcactatgatggcagagttgaatagttgcaacagagaccatttggcctgcaaagcctaaaatatttaccacccatcttgttacagaaaaaaaaaaaattgccaagccttgttcaacaattttatctctgtttagaattggcatcagttcctgatccaaacttccaaaatgaaagtaaaatcctgggtacagacacaggtaattgcaggagagaaaaacgtcaaagcagtcaggttttataccctgccgtgacatccatttctcatatgctttacaagtgagagaagcatccagagcttacagcacctcagcagggagtattttccctctctttggcaccatccagggctcaccgggatccattgtgtgaggccaataaggattacagaattccttccacaacctgaggtattgattaggttggccaagtcaatgctaaaattaggcacagactaggaggcacggaatggattttagaacgtgcgtgatgagatccagagctactcagtgggagattcagagaagcactgcagaatgggtgctttactgtaactgagttttatttttacatacatacaagtggtagttgaagggactgcacatttaccataattctcataaaccagtatatatttttgctggctttaaaaaataccaattatttgtagatagtctgaacgacaaagtaagtttcaaaaaaatgtgacatagctgagtgaccatcttggctcttgctatgtgtatagctttgaaagtgattcagttttgccttgttggttaatctccttgctgtgaaaacagaggttgggcacagcatacaagactagggtgaccaataaaataggtcatcaagtcccaacatgcttaactatgaaagtaccactagaactaattaaaccaggtcaacagctgtaatgtaggaccctcccagaggaacgtgatatgtggtctctctatataaacatgtgacacctgtttctgcctgtggtttgaaagtgcttggcttcagaactgggctagaacatacagaacctttgtgagaataggaagaaggtactgctttctgagaccagttagcaataggatctcccatcttctgggctgatgctctcttgttccataggacgtagctcacagagtggtagaatgaatctcaattccccaattgggccccctggccaaatgtctggcagggcacaaccatatgtggctgttcagcttggcaccacacaatggtaatggcattgaaaataggtttgtgggaatgtatgttgctcaaaatatgcagcattttaaccttgatctaaaatcagtattctttgaatggttacatgttggatagttggaaatgactagattttaataaaaacaaattaagacagatttcagtaatagcctacaatttagacgagaaatttgtgacgtctgtgtttttaaaaatatacgtttatgctcctgaaagaaattatatgttctgaaaacttgaagtcatctcagtcataggaaatattggcttttagatttgcccagacctttcaggggaaagtaatttggatttttttccacttaattttccagataattgctgtggttcctccctatttctccattaatatagcccagatgacagaagagaggtagcaaagaaaaatgtgaacgtggagagggaggaataacacaaaatggccatcatattaagagcattggtgccatttcacatagttcttccgaccacagctgtagcaaaccactcagtctgctattgttcttcatgttcctggcagactctacactttctatttggaaagactgatcagcaaacatatctgtcttgaagcacacagacacccacaggcttgccaggcccctccaccgctctgctgacctgagactctcctcttccctttgctcaaggatgttggaaaagcaaataaaagccacttatacactctactctatgcatttcttttcctccagtttccccttttctttggattaatttaacttctgcttatgaatctgatagttcttccacatcgttctgaatttccttcagcactgaagaattaacatttttaaaattaagtaacattttcccaaaaaatggagcagaaataatttatgtttatatttgtgcatgtaaaagaagtctgtaggatgcacaaaattaataagagaggtgaacttggaaggcgtttgctgatcagacaagagatggaattggaagaagacttctcactatgtatcttgttttttcatttatgatctatatgaatatgttacctattcaagaaaattaaaactttttaaaaatcaaaacacaggcaaaaagacaacagtgacctgaacaaatgcttcatcagccttctctcccatagtagaaccttgaaggtccagcagatatccacatttctgagagaatgtggtcgtcattatatcagaagttctagattcattttttttctaactttggtcagccttgaggaagatgaaattccctgtttgcaaatgaggattctgacttagactaaaaatgcagtgcaatgatatccaggcagttggcagtaccacgtggtgcattgacacagccccctttgcaggagttgattgcaaataatcacacatttttctatgtactgacaaccaagaaataagttgtaaatgggtggcaggtgctcagcactgaccaggcaattgaatacaagagtgaacaagagttttattctgctgagtggagctctcagtgtaattgaggaaacagtaatctaaatgcacaatgtccatgcactgtcacaagtaaaatgcatgttgcaatacaagacagctgactctagagttctgtggatagacagaaggagcgactgacctcctttgagacagatagaggaagaatgcatgtctgcatctcattcccattggaacagctgtaaaagatcttttaggtgcctgccctaaacccctcccttttttttttttttttttttttgagacagagtttcacatttgttccccaggcttgagtacagtggtgcgatgtcagctcacctcaacctccgcctcctggattcaagtgattctccctacctcagcctcccgagtagctgggattacaggcatgcgccaccatgcctggctaattttgtatttttagtagagacggggtttgtccacattggtcaggctggtctcgaactcccaacctcaggtgatccaccagcctcggcctcccgaagtgctaggattacaggcgtgagccaccacgccctgccaaacctctttctaaaaaggaaaaaaggtcacaatgctgagggtgtcttaattcaaaagcttgaggaaaattgttcagtacatcatcacagagcactacacggattagcagcaagtcctcagaaagtctgttccatcatctggcaaaatgtactctcttggggtttcattggtaggtcatgagaaagttgaccagttccaaccaggtcacagtgtttcttcccaactatcactctcagcagttgaaaatgtgtactgtcataaagtgtttttttttattttgttgttttaattactaaaatcacggtccagcaatcttacacaagcttctttttgaagcggtcaggaaacagtgattttgggaggggttttctgccttgaagtgagcaaaagaggaaacattttaataacaatatcttatccatttttgtagattccttgaaatccagggaggagcacacaatgaaacagagactatgtcagttgtgatgtaggcatcatcatgctgaatattaagagtggaagtagattgattttgtctgctgcagaatgatggatatgaaagcaggtgtctggtgggcagcaggaactcatacctcatctcaataggcttcacatctgaaggctcatcttgcttctcagttacatgatgaagggagacaccatccaagcagtaaagataggagcacagcactgctgaaagcaaggctactcctatcgcacgttctgtcttcataaatgaagaacagaagaagagaaaataataaatttctatagaatgacagacaggcctaggcttagggaattcatgaaacaaacaaaccaactcttctcaaaattgagtgggaggaaaatggtcactaatgttgattgaactcctgcaagccaggcacttgatgtaaattatttcatttaatcttcagaacaacctaaaaaggcaggtattttatctttattttgtacgtgataaaatgacaactcaataaggtgaaacatatcaccattgccagtgagcagtaaatgctgaaagtggacagaggagaccatatctcagcatatggaggtgcatatagaccactggacttgatggaggcatgtccggggtgttatcacagaatttttgggaggccataaggctagttacctcggaagttcctgcatccaaacctgaaggtcagacagaccttactagaaggtgcacataaacacaactgttttggggaatgtgtcagtcaggattctccagagaaacagaaacaatacagttctgcttgtattacacacataaccaatagggttcatgtggaagttgtcaagtctaaaatccatagggcaggatagcagtttgcaaagtcaggcaggacctgatgttatggtctaaaggcagaatttacttttctctgggaagccttagcttttgctcttaggatgttcaactgattttattaggcctgcctgtgtgatcaagggtaatctcctttacaaaagtcaactgattgtgtttgttaaccacatctacaaaatacatttgcaataatacctgggtccgtgtttgattaaataactggatactataggctggccaagctgacacataagactaatcattataagggattcattggggcattgccacttagtaggataaaggacaatggtaacttacaggttaagtccatagggctactgtatttaaaaggattacaaagggagccacatatatggagaacttttaatggaaagctaattgtaaatgatgtgtaataaaaaaagtcattgggtcaaaagtgtagctttcattttgacaagaaaagccaagatatggcttgtctagaaaagtgttaaaatttttctgcagtataggcttttatcaactgatgcaaaatccttcatcttggtatctggtgaaataagaaagccagagttttgaaatattctcttatggccttatagatattcattgaagggggagtcagtgtgtgtgtgtgtgtgtgtgtgcgcgcgcgcgtgtgtgtgtgtttgtgtgtgtgtgtgtgttgcacatcaacgtgggacaggttggccctcttacctttggctgtcttctctgaaagtgtctttcattgtttctacttaacactgctaaagattctaaccccaaatagtccacaataataatttcattccatatttcggggggggcggggttagtttgtcagcatgattactagtactctactgcatttgatgaactttttgagagatgtgtatctatctccatttcatcgatgaaattcaagagatgttagggacttcaagttaacagggcatacttagtctgatggggtattgctcacctcagtagaacaaagaaagccttcaacatgagagaaggccctacacttctggttaggcatccccaattctcaccttttcctcacacctcccatcccgttcatcaacaagcccacttggctctacctccaaaatctatcttggatcttagtacttctcactgtctcctctgtgacaatcacgctgagagaccatcatcccttccctcctttggatcttcctccctctatttctcccctaaacaatccactttccacccagtagccagtgtgacctttgagaagcatgacccagatcatgtcaggtccctgcttaaaattcagtcaaattaaggtaatgtccatgtttctctgcatggccaagtagggtctgtatgaccacccccaccccgccccaccgtccctctgattccagatgtctacccttgtgtctgtcatgtttgttcactgctaaacagtgtccagccatgtatctctctcctttgaccatgctagcttagccccgcctcaggacagtggcactggctcttttttcttgaacactttttctcctcacttggctgtctcctttccatctcagcttaaatgtcatctccttaaagtgacttcctccaccatccctgataaactagcactgctctctctcagcaccaccacatcatccttttttttttttttaaagacagagtctcatgctgttgtccaggctggagtacagtagcatgatcttggctcactgcaacctccgcctcccaggttccagtgattctcctggctcagcctcccaagtagctgggattacaggcgtgcaccaccatgcctggctatttttgtatttttagtagacacagggtttcaccatgttggccaggctggtttcaaactcccaacctcaggtgatccgcctgcctcagcctcctgaagtgctgggattataggcgtgagccacggcacccggccccaccacgtcattcttcaccaattaccctctgttgttttctttatctgttgacaaatttcatgctatttatcattcctctggagaaaatgagacccatgaggacaggcaccatctagttatttcccataccttcaatgctttgatctatatataacccatagtaacagttgctgaatatctatggaccacctgatttggaaatcagctacaaaaaatgtaagtatttgaccaacattttgttcctaaatataacataagtataaccttgaccccctaatcttataatacttatctatggaacaatgagtttgagtcattgttcggtatcacccataatcaaccttagtttacccacatcactctgtcttcttcttcaatataacattgtcttctacatgcatttaaaaatcaaaaagaaaagttttaggaaatgagtaattgaagggaggtcacagttaatttgcatgaatccaagcatagattatcttgctatcaatttcgtattgaatttggagattgaaattacatattatgccaaattaaatattctttgttactcatattttcccctttctccccccatccttcctctcatctccctctttcattctccctcccttcttttcttccctatctctctttctctctgcattccttctaatgttttataatgtgtcacatttcatgcaacccccgatgtaaaaatttattagatgacctacctagccttttctccaaaggcttgattattttctttggaaataattagggatgataaattttgatagcatcttttccccctcctcctgtatttgtttgatatctgcattcacaaacttgcccctttaccagggcaaggactctgtgcaagtgaggaaatcaggcactccggtagatgtgtagggggtcacatacctgagaaccaccatgtttgagggacaggccctggcattccatggctggccatcagaacactccatacaggtcctttgtgtcattcaaagaagaaccagtcaaccacatccatacaagtgctattgctcttctgcctgagcccgacatcacaggattcttacaaccacatactgttatttatgactgtcccttctgacccaaatattaaaataattaatcttacaccttaatagtatttgttaattccaggatattttacattttgcaatatattttttactgcagcattcttattctacttctccacatttaaaataagccaggcacaatggctaacacatataatcccaacactttgggaggcccaagagggaggttctcttgaggccaggagtttgagaccagcctggacaacacagagagaccccatctttacaaaaaaatttaagaactagccaggcatggtggcatacaactatagtcccagctactccagaggccgaggtgggaggatcccttgagcccaggagtcagaggctgcagtgagctctggtcatgccactgcagtacagtctggacaacaaaatgagaccttgtctctaaaataaataaataaataatgaataaataaaatgtttacagttgaccattatattatttatagttttgagattccctaacaaagtaccccacactaggtagcttaaatcaggggtccccaacccctaggccgcagaccagtacccatccatgacctgttaggaaccaagctgcacagtaggtgagcactggtgagggagcattgtatcctgagctctgcctcctgtcagatcagtggcagcattagattctcacaggagtgagaacctgattgtgaactgcacatgtgagggatctaggttgcgtatttcttatgaaaatctaatgcctgatgatctgaggtggaactgtttcatccccaaaccatccccctgcacccttccgccaaaccgtggaaaaactgccttccacaaaaccagcccctggtgccaaaaagattggggaccattggcttaaataacagaaatatgttttctcacagttctgggtgccagagggccaagatcaagatgtcagcagggctggcctattctgagaactctctctttggcttgtagatggccatcttctccctgtgtcttcacctcacctgctctctgtatgtgtctatcataactgccttttctcataaggacaccagtcacattagatcaggggccacgctaatgactgccttagagatcataaccttacttacctctttaaagaccctatctccaattacagtcacattctgaggtactggaagttgggactgcagtgtatgaattttctgggagcacagttctgcccacaacagctttatagagacagaatagagaagggtgttgtgctggattccacaatatgacttgctctctgtaggccagtgaggagggatgttacctcttttatatcctcaaatttcactcttcccaaatagatatccacactctttaaattgggttaactgtgaatttggagtttatcttaaaatatcatattgaaacctaactttctaattttgtggagttttaattttttttatagatttaacctaagattttacctaagggccaggtcaacactgtggatgcatataatgatatctaattacaaagttctttgaaaaaacctattttagaagtctataaaaacttccttcttataactagtccacacagggacccaaaggccttattcaacccctaaggtcactgaatttcaagcctaataagttccaggagagaagtaatctattcagaaaaaaagggtatatttaatcaccggattttaaaaagaaagctaagttcttcatgataacttaagtagttaatggaatttatttaagaatctgtttacaataataacttcagtggatataaaatagatttcttcaattttactagtttattttaacttgcagaattctttgggcattgaagtagctgagaggcttatcttcttttctcaggctatgaataaagaggaagaaaaaagtgaagattgatttttgttgtatagtcctttacatttctcaaattttaacctacttaaaaaacctcataatcacagaataaaattttacaagtgatagggctctttaagatcatctaatccaaccctataatttatgaaagtagtaaataagactgaagaaggacaaaatgacttaaactacacatggaacaatttaacagaaatatttaaaacttaactcttttgttacactacttcagtatgcttgtttagaggttatacaagccagttgtttttattctctcaagtaatttaaagactgtcacttgagactcattttattttagtcaaagtagaaaagttaactccccaaatgctagcacttagtgcattaatttgtggatgattcatctcaaaattaccttcccatgtatctgctgcaattaactttgacaagtgtaaaaacaaaaaaacaaaataaatctctcctatggcctgaaaaaaaaatagtatcaataacctcaaaataaattattgctttaaaattgtttgcaaaattaaggagtcagaagtgtatgggaaggcatttaaagattttgagtggggaggtgaccttagggcaacagcatggattaatcttccacactggggcacggtgtagagtgtgggttttctgataattatcaggttgggacaacaggtataaaacagggcttttcccgtccaacttggaggtcatcctgttctttatgaaggttaacccagcagagggcagtgggatagactggcccaatcagggactgatgaatgcgccacaggagacagggggcccacgtatagctagaagtacctcttctctaaggaatgcggcagaagcagcccagagtaaggtggacagctgagctccgccttctcctctccctctgtgactcgctgtgacagctgccctgttgtcaaatgtgcactgtccctgtggcttcttgcatttctgaaatctatggtacaattgcatttttcttttcttttcttttccttttttttgagacggagtttcgctcttgttgcccaggctggagtgcaaatggcacaatctcagcttactgcaacctctgcctcccaggttcaagcaattctcttgcctcagcctcccaagtagctgagattacagaagcacaccaccacgcctggctaatatctgtattttcatatttcatcacgttggtcaggctggtcttgaactccagacttcaggtgacccaccctccttggcctcccaaagtgctgggattacaggtgtgagccaccatgactggcctgattgcgtttctaaacagtaagtaagatattttataatgagaaacagtgaccctttctacatggtgaaatacaccatgctggtacttggagttaggcaaccctgcctcttagagatcctccacatgcctcttctgacccattgtgccgtgtgcactgggaaggagatgaccatggggaaggaagaactgtgttctggaaatcccagagagcttgtggagaagccagaagccatccccgctggctggagagatcatgcagggacaaagcccagcacatgataatggtatgtaggtcagagtattagaaattgaggtttctggcaatactaaatagtcagcactcttgattagaacttaattgcaaactgtttctaatcaaatcctccctaactgcaggtacttttgccccaacatttgtttgtttgggttgtttttcttttctttttttttttacattgctgaggaagttattatacattgaacatccacattctcaaacatcatttccagaaagagctctcgcttacttcttctaatcgcaaattacacagatttctagcagcagggcacccccagaagcaattcagtgttgatatttttgccagtggttacaagtaagtaacacctgagtctgaacaaataaacattacaatacaatccactctaaatctacaggttgtcctgagctgaaaatcatgcggcttttctgagatggtaaagtgaagcttgagctatgaggcagacagggctctgcctgtccactgtcttcccccgtgaccgtagaccaggatttggcagttgagacaacactgcctttccaggtctgtcagcagcagggggcacatctgtgcgggaaattactcacatgctcctgaggcctggctaatttatgatttttttttcttccaaataagctgaaatatgtatgtggcagtgatctaacccactcaacccattgttgagacagcaatgggcatttttcagatttccttcattgtctttctcagtgtcgtatcaaattccacagatctcttgtaggtcaaatttttttttacattaatttgccttcatatttaagtggagtaagaagggcttctgaaaaaaattcatatataaaaccatatatttccagttgtaaatccttccatatctagccatggacttgcgatagccaatgagggtttcttcccagaacctcttccacacactcagcctggacttaccccgttctcatcttcaggcgacaccatgggcatgactgtgtatttcccactgtgtatcctgataacaagtttttgagtacctagtagagtaaaagacagtgacttctgtccctttctcttcccctagccagaaccaaacacataaagatcacattatagcttcataaagtataaagagatttatcccaagtggctagtttccagtggtgacctccttcttttgagtttccctttcaagaaagcatggactctgcacacaggcagtggcttgcacactgctagactgccagtgcttgcacagttcctgacacacagcagggactcggggtgtgcaatctaaatatagcaggactcgtgagttcatgtaggcctgttcttttttgtacatagctgtccttcaggcctcatatgggcacctttttaaaagtctgcttgcactaaatatatcatttcgcccatcctgaatttctgaagacaactgactattatttttatccaacaaaccatccaaaccccagtcattttccttaagtgcaactcagcagaaggaactgccctactttgattttaaaccaatgtcatagatttaactctgcaggaatattttcttgctagtggtctccaccaatcatcatcatgggaagttgctaaacctaaaaaaaaagttgtgcatcaatgtctgcatatcacaaacatctgtggacgcctgttctcaagcaggatggtgtgtgcctattttttggataccttacccagatggttatttgaacgttgaactttgggattgcctgtgggaaatgtccatgcctttgaacttgcagactccttcaggggttaccattccacttgcttaattaggaaatgatcactgtggttaaaagcacagaacccgggacccaacagacctggattgaaatcctaattgctttccctccctaaaatatatttctttctacaaaaagtaagagagaagaccaataatagaattaacttcatagggttgttaggtggaataaatttgataggggatacgtaaggttttggcactgagcctaatatagagtggacattcaataactattagcctttagtattatcaccagagtctcaaagaactaatcgttattaaaataatcattcgtgcacataaatgctttatactcctagaaagcacaaatcaatttaaagaaaaaaaaaagctttaaacattttgatagaccagtgatagtcagtttacagcaaaagagggagtaagattatttagttaaacaggaaacagaactctgaggcactaagctaaatggaaggacaaaagatgagaaaagacaacttgaaaataactttgattttgcatacattaataaatgttaacatgcctgtttgaaacacagtatctgagagttatgatattttatcagccaaagctgcaaatcctgacatttttccctaatgtgtaaatggcagatgtcatttatatgtgcaacattcacatgtgaatctggattcctagaatttctttggaaaacacaaaatattttgctcaatatttcagcaagtataactctaatctattttggtggggtattcatttctttaaactttaaatacatatcaagaataaaatcagacaacaatgatcctttttttcaatttatgtgaaaaataatagaagttaaaatattcaaaattgaagtctatttcttatttttatttttttctagttctttctcaccacaaataatatcaagaaggtgaataaacatgtgccattgaataatcatcagtgaaccatatttaatattaaaaagtatatgagcgggcacagtggctcatgcctgtaatcccagcactttgggaggccgaggtgggcagatcacttgaggtcaagggttcaagaccaggctggccaacatggtgaaaccttgtctctactaaaaatacaaaaaccagccaggcgtggtggtgcatacctgtaaccccaggtatttgggaggctgaggcaggagaatcacttgaacccaggaggcagaggttacagtgagccaagatcctgccattgcactccagcctgggtgacaagagcaaaactccgtctcaaaaaaaaaaaaaagtataaaacatgaaatacagatttgaacctattaatatgaatgccacaattgcaaattttttatttgcatctttattttatctgccttggatttgtccattgaaagctgttatattgttagttataattcggctgccaccatatttttcttttataatacttaccaaaactgaaatgaaataataaattgtaatagtgtttgtttaatacattctttctcttcccaactctaaaatccaagggacagatctctcttatttattttgtattttcattgtttagcatagttcttggttcccagtaggcacttaacacatatctctcaagtaaataatcaaagaaaatgtagacatagaaacatatcggcattttcatcctttctatctttcctaacaaaagcaaacacacaaattgatgcttgagtaaagttaaaagaaactgcagaaggatctctaaatttatagctcacaagcctatgagaaattatgagctttacagttactaaccatcctactgatatcagtaactcctatggtcagatgcaaaagtgagataggcatgggcttgatgtactcctctccacccttttctatgattatgggaacttttgctgtgagatcatattcagttctgatgaatctttaaagtgtgtctattagtctctcagactgccacaacaaagcaccacagatggtgtgtttaaacaatggaaatgtattttctcacagctctggagtcgaaaagtccaagatgaaggtgtcagcagagttggtttcttctgaagtgtctttccttggcttggaaatggtcctcttctcccagtattttgatgtgctcttctctgtgtgtgtgtatacctgtgtcctaatctctttttataagaacagaagtcatattggattagggcccatcctaacacctcactttaagttacttacctttttagagaccttatatccaagtacagtcatattctgaggtcctgggggataggactttaacatatgattttggggaaggggtacaattcagccaataacagtgttccatgcttaaacaaatttacgagaaaaaaaatgaccccatcgaaaagtgggcaaaggacatgagcagacacttcgcaaaagaagacatttatatggccaaaaaacttgaaaaaaaagctgatcatcagtgatcactagagaaatgcaaatcaaaaccacaatgagataccatctcacaccagtcagaatggcaattattaaaaagtcaggaaacaatagatgctggtgaggctgtggagaaataggaatgcttttacactgttggtgggagtgtaaattagttcaaccattgtggaagacagtgtggtgattcctcaaggatctagaaccagaaataccatttgacccagcaatcccattactgggtatatacccaaaggattataaatcattctactctaaagacacatgcacacatatgtttattgcagcactatttacaatagcaaagacttggaaccaacccaaatgcctatcaatgatacattagataaagaaaatgtggcacatatacaccatggaatactatgcagccataaaaaggaataagttcaggtcctttgtgggtacatgggcgaagctggaaaccatcattctcagcaaactaacataggaacaaaaaaacaaaccaccacatgttctcactcataagtgggagttgaacaacgagaacacatggacacagggaagggaacaacacacactggggcctgtggggaaatgggggacaagtgggaggagagcattaggaaaaatacctaatgtatatagggctcaaaacctagatgatgggttgataggttcagcaaaccaccgtggcacatgtatacctatgaaacgaacctgcgcattctgcacatgtatcccagaacttaaagtaaaattttaaaaaaattttaaaaattactgtagccttgtagtatagtttgaagtcaggtagtatgatgcctccagctttgttctttttgcttaggattgtcctggctatccggggtcttttttggttccatatgaaatttaaagtagttttttctaattctgtaaagaatgtcagtggtaccttgatggggatagcattgaatctataaattactttgggcagtatggccattttcatgatattgattcttcctatccatgagcatggaatgtttttccatttgtttgtgttctctcttatttccttgagtagtggtttgtagttctccttgaagaggtccttcacatccttgtaagttgtattcctaagtattttattctctttgtagcagttgtgaatggaagttcactcatgatttgcctctctgtttgtctgttattggtgtataggaatgcttgtgattttttcacattgattttgtatcctgagactttactgaagatgcttatcagcttaaggagattttgggctgagatgatggggttttctaaatatacaatcatgtcatctgcaaacagagataatttgacttcatctcttactatttcaatacctttatttctttctcttgcctgattgccctggacagaacttccaatactatgttgaataggagtggtgagggagggcatccttgtcttgcgttgtactggtaccaaaacagatatacagactgatggaacagaacagatgcctcagaaataacaccacacatctacaaccatctgctctttgacaaatctgacaaaaacaagaaatggggaaaggattccctatttaataaacgatattgggaaaactgactagccatatgcagaaaactgaaactggacccattctttacaccttatacaaaaattaactcaagatggattaaagacttacatgtaagacctaaaaccttaaaattcctagaacaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaatttttgcaatctacccatctgacaaagggctaatatccagaatctacaaagaacttaaacaaatttacaagaaaaaaaataaacaaccccatcaataagtgggtgaaggatatgaacagacacttctcaaaagaagacatttatgcggtcaacaaacatgaaaaaaaagctcatcatcactagtcattagagaaatgcaaatcaaaagcacaatgagataccatctcacaccagttagaatggcaatcattaaaaagtcagaaaacaacagatactggagaggatgtggagaaataggaatgcttttacactgttggtgggagtgtaaattagttcagccattgtggaagacagtgtgatgattccttaaggatctagaaccagaaataccatttgacccagcgatccctttactaggtatatacccaaagtattgtaaatcattctactataatgacacatgcacacatatgtttattgcagcactattcacaatagcaacgacttggaaccaacccaaatgcccatcaatgataggctggataaagaaaatgtggcacatatacaccatggaatactatgcagccataaaaaaggatgagttcgtgtccttcgcagggacatggatgaagctggcaaccatcattctcggcaaactgacacagaaacagaaaaccaaacactgcatgttctcactcttaagtaggagtcgaacaatgagaacacatggacacagggaagggaacatcgcacactggggcctgttggggttggaggactaggggagggatagcattaggagaaatacctaatgtaaaatatgggtcgatgggtgcagcaaaccaccatggcacatgtatacctatgtaatctgcatgttctacacatgtatcccagaacttaaagtatatatatattaaaaaaagaaaacttggtttttatgacatggaaataaaaacaatttttgcattgtaaaaaaattttttttaatggtagaatttaaaaaaatgttccatgatcagattggtttgagaaatactttgtgataccaaatttaataattcctttaatatgctactatgcattaggaatctccaagaaaagactacaggattctggctttgctgaaaacaaaaactgaaaaacttcttacccaccccaattgcttacacctttaacatcccaccatatttttcttggaacaccggctgggtagagcacagcagtggcctggcgctgtatgaatggccctgcatttcactagtgttgtttgagggctgctgattgacctctccctgatcctaagcagccccactggtgagcccctctctgataagcaattatttccaactccataccatgtccaaaatgcactcttaattgaggcaggacttttctttgtgtatttaacaattcttaattatgactttacatttttgtgttctaccaaccagttggtaccaatttttccagcaactttctcactccagttttggaggtactattggaatatttctctttctctgtaactattggcatttgataatattttttgcagctaattatctcattgattgaaaggaatgaaggaagggatccaatgagatgcttcttggaggcaaggaaacacaaatgtacaactttgaatagagtttcaacataaaatagctgtccaacctccatggaaacagagttctttatggacgcattatgcaggcaaacttgctaagctctttgggacattagtgcctttaataatgatgttagcaacttttcctaaactattgcatatgtacagtaggtccttagcagagtgggggttcgtgaattaatccctatttaatgagaaatatttgaaggtgatgagagtcatctgctgctgatgggaaaattctgccttgatagattatttctggaacattaaagaatctactcaatcaagatacttgactatttaggacaggacaattttgtgagaaattgaaataaaatacaggatttatactcaattattttcatcacctataaaatgtcctatatttgctttaagggttttaaattttcacactttcttgctttcatcagacctcagtagcctgtactaaatcaaatggctagatgctgagttttggctgagggtgtttttagtaaggtgataaccaatggctatatttgagaaaatttattttagattaatttgtagtatgtttcatttcaaactgtctggaaagagctatgaaaatatgtttatatgtgaaacgtgctgcagcattctcaccaacgtgatgcaaaatttccacatctacctaatgatttagatagaagtcataattaaaatatattaggtgttagaaaatgtttggctgctcaaaaataaattattataatacaagttattatcatttctttatgcttgacctcatcactgttagaaagtactccgaaattaactggtggaaaaggaaaagaagttactataggaaaaagacacctgcacctatatgtttatcacagcacaattcacaattgcagagatatgaaatgaacctaagtgcccatcagcccatgagtgaatagaaaaaatctggtatgtatatatatatatgtgtgtatatatatatatatatgtgccatggagtactactcagccatggaaaagaacaaagtaagtcttttgcagcaacttggatggagctgaaagccattattcgaagagaagtaactcaggaatggaaaaccaaataccctaagttctcacttacaagtgggagctaagctattggtatgcaaaagcatacagagtggtataatggacattgaagactcagaagtggggaggtgaagtggggaagggttaaaaactacatattgggtacacgtacatgtaatgtacatgactccagtgacagatgcagtaaaatttcagatttcaccactatacaattcatccatataaaaacacttgtacccctaaagctactgaaataaaaaaattaactggtggaaataaataattaaaatatcttatgttcctttcaatctgtctactactctgttctgttctttggaatacaaataaaaagtatttaacctctgaactttttgtaactgtaaatttgaaaagctgcttaattttttattgtgatggcaacagtgttgataatctatacacattttcggagtaaattaatcatattaagaattttgtcagaaaataaaattccacttttgtcaacaaaacaaatccacttttgttaaaaacaaatcagtctctgtttaaaactacaaacacacctctccgaatttctgtgtaggttgtttttgttccttagctccatgcaaagttatgtggctgatggtgagggaatggtaagtttgtggggcttagagcccaaagacctgggagcaggcccagattctactataaactttggacaaatcgtttactctgactgaaccccagtttttctaactgtataatgagaatgacatcccttacaactttgaaaacatagtgagagggaatatctgaggctttgttgatgacagatggacaggtcccaagaagcagacaaatagtcttttaaggacaaacaatgcagtggaaaccttctttcctaaatgcatgacttttgctaactttttttttttttaaaaaaggcaatgatatttcacttatgtctgaatcacaatccctgactagctgatcaagtttcctagcctattagtaatagataaggagagtttagtgttaggatataacagtgatgatcaaataggtgagaaattataggctgggatttagagattggatactgacagagtaatctgagaaataagggctgatatggtttggctatgtccccatccaaatctcatcttgaattgtagttcctattacccaccatgtgtcatggaagggtcccagtggggggtaattgagtcatgggggtggtttttcccatgctgctctcataacagtgaataagtctcatgagatctgatggttccataaaaggcagttcccctgcacaagccctcttgcctgccaccatgtaaaacatgcctttgcacctccttcacctttcgccatgattgtgaggcctccccagccatgtggaactgcgagtccactaaacctctatttctttacagattacccagtctcaggtgtttcttcacagcagtatgaaaacgaactaatacaagggcgaaggaaaccatgtgtctccatgatccagcctcagatgtttgtgctttccttagagcaattccatacaagatagagtcacctagcgcttaggaggcatgaagtgagtctgtaacttttaggagctggggatatggcaggcattgctgtcattcttcatctccagtacaagatgaattttgacccatatgtaaaatgttagtatcatattaatctagtaagttgtgtgtatgcatgtgtgcatatgtgtttttgtaggtgtgtgtgtatgtgtggtgtgtgcgtgttatttgtgaaggaggtaaaatctgagaaaacacttttctttactaggagagattcccaggccatcttccaaagagaaataagaacctgtagacgctagagatacagtggctttttcctcctgtttttcaaactagtgagaaaggatcactttaaactatgagacattaaaacagaagagaaaacattgtaccatcccttcttatccatatgtcttcctggggaagcccatttctaagttttttggctaatagtgattcagatttgttagaaattttgagtattaaggtagccaaatgaatcctttcttttaaaaaatctttaataaccatttaaaaaggtaacttttacaaaatttaaagttttaagtgatatagaaaaaataatcaagtaagtattttaaaatatgtttcttatttcttagcttcctgtatctacaagtcaatttaacattggtaattaaataagcatattagtaaaatctacataataaaattttatgggacttaaatttttatattggagttaatctgaatgtcccattatttcgtgtgtgtgtgtgtgtgtgtgtgtgtgtgtgtgtgtgtgtgagagagagagagatttaaaattcccatgggataaattataaaaatagaaatgaagaagaacatattagttattcatatacctgtgcatctgaaattagccattttcctcactgaatacataatgatttccgagatgaagagcagttaacccaatggcctcctaaatactaaactccattaagcttgcctctgagcaatggccacaatcatgagtgtatcctctagtgttgtttatcgttaatgtccatataaagtatactgatttatgataacttccaaaagacaatcatagggaagccaattagctaaggaaaggagatgacctacataaaggattggccaactttttctgcaaagaaccaaatagtaaataattttctgcattgcaaaccatagtatctctgtcgcagctactccatcagctctgccttgtagcatgaaaatagccagagactataggtacagaaatggcctgggtgggagttggcccgcaagccttcatttgctctcagggatcctgtaagataggtgaataattttaatttctaattatactgttgcacctgaaagagttgtggctccataaaggtctgtagctgtatgaaaactgaaaaaaaaatgtgatcagtcatctagatactgtgagcgaaggccaaacatctggatgtttggaaatctaaactaaaatttaaaaaacacctattatgttatcattatgattactgctaagcatttgtgtactgcattccaagagtgttctcaacatatttaaaaaactggagacaaaatgaaagaataccttttttctgttccctttgaatctgatatttgaaaacaaagggcaaaggagggggaaagtgtttctagtaaaagacaatatatttcttagtatcagatacccttttaaaaccatcacaatgaaagccacaaaagcatggagtgcgtttgatatcaaccagtttgcaaattaaagattcttcgttaggacatctaagcagccccaagaggacacacctgtggccaccagccctgtacttcaccgcacaagccctgtctgagttctaatgccggaaaggaaaccttcagagagaatagctacttcagaaggagggatgagctgagtcgtggtatcccagcttgagtggtggttgttcatcttcagtggtagaatacagaaactatggcctgcagcaaagctcttctggtgatttctcctccttttcaaaacaatattgggaggccaggctgcctccatattgaattctagaatgaaaactgaccagctctgttattcagagtctagggaaaagaaatatgaggattgcaatgcaaaaacatggagtccttgtttgtttgctggtgggatgaactccagcccctcacacttagcattagaagctcctttcccatgattttatggaagaagaaagctgttgactgcccaggcctcttgtgggcacctgcgccattcattatagggctacattcaccacacactcccacactccagccttgctctggctctgttcttgtctgtgtgtgtcctcacctcctcaggcactgtcattgggagggacccctttttccctggagggtcctcccagcacctgatctggatcccatcccatcctctctcccaagagggctctgttaattctcccctgtcttaccccgcctttcactggccttttacttttcttatataatcacttaaacttggtgcagcctctcccatctctcttcctccccttccctctaggtcaagccccatgcaagatgcctccctggttcctccttgtctcctggatgtttgtgggtttcttccacagcatccaatttcagttttcctgtttcctttcaagtgaattatctcctctgagtcttatgtatgcttttctttttgaggacttgaccacaccccaagatctagtgttagttctggatttctccgcatcaaaaaaatgactggttaggaaagggaatgcctggctccacacagaccggtgaagaaagaatgaataccacggttctggaccctgactctagaatgaatgttctcctccctgtgcaatgtgttcttgagagctgtcatgttgcagcaacttggctacactcatcccacacccccaaactccacccttgctctggctctgtccttgtcatctaaagagcttttagaaaatacagatgcctgcacacccctccaccaccccgcaaatcccagtgtcatggtctgcggtattaagtgctgtcgtggaactgggctgctgtcctactgcagtactgtcttcctgatggcaaggataccgcttattcaactttgctcccccatcccactgaatagagtcggacacatggtaggtccccagtaaatggtttgttagatagctttattgtgagtttatttccaaaggtaagaaatcactgggaatttcacaaactggagtcattttacttatactaccttttcataaaatgtatagaaatatcttttcataaaataatttttttagaaatatctttttataaattaatttttttaggttattagcatcagtcttcctgttgtgaagatttctttttaattacatgattgtgtgtgagttacatctcatagaattcctgagagagcccaatcttaggttgctgtaacatgacagctctcaaaaacccgtcgcacagggagaaggacattcattctagaggccagtggccccagcttggaattccacccctgctgctgaatggcagttggatgttgggcaatttacttaacctctcagaacatcattttacttagctgtgaaaatcaataattcagcaacagtgagtgcctattaaggacttgcttggtggttatcagtttattctttctcttatctgaggctcacagttctatgaggaagtaatataattgtcaccataaccactatccatggcttacacatttggaaatctgagatgaaagactttccagattttaagtgtaaagaaattccagagccctcactcatccccaccaagctctacttcctctcaaaggagaaagcagcagggacttttctgagctgttgggagtatgagctgaacatctccaaggtcctcatttcccccttatccttatggtgcctgaattagctaatctctaatttctcagttacaaagaactgccaagctcccagttaacttctatctcgggagtggacatgagagcctaatatttgagaccaagctctgtttgctgcctcagtaaaaaccattttctgtagggtttggtgtggactagctttcaaccaaatcatgtcccctaaaacatgcaaaagtgagacccagtgtggtggctcacacctgtaatcccagcactttgggaggctgagtcaggcgaatcacgaggtcaggagatcgagaccatcctgtctaacatggtgaaagcccatctctactaaaaatacaaaaaaaaaaaaaaaataggctgggtttggtggcacgtgcctatagtcccagctacacaggaggctaaggcaggagaatcgcttgaacccaggaggcagaggttgcagtgagccgagatcacaccattgcactccagcctgggtgacagagcacgactccatctcaaaaacaaaacaaaacataaaagaaacatgcaaaagtggagtgtgcagactcaggcaatgagggcaacaggctgctttccagggcagcttgaccagcctttcctccctagaaattcttgtaagccctggattaagaagcctggatatttctccattccacattccagtgggtctcattattttaattatcgtacttagcccaatagcacttttcctcatttgtctattcctaaaccggatgaacatttgagctggttgctctttttttttttttttttttcttgcagggcgttaaggttagtatagtaatatcagcccaccctttcatatggcttagcaggtaccatgcactgttctcatcactgtagatgtgcgttagctcatatctcaaaataacctgatttgcccccattttatgaatgaggacactaaggcacacagagatagaataggagttcccagatgttagcgtgcatagtaaatcacctagaaggcttgttgaaatagatctctgggtctcaccaccaggttttctgatttgggagggccacagtggggcctgagaatctgcatttctagcaagtgtccaggtgatgcttatgaccataccaccattccagggaccactgagataaattaagttgtccagggccccgcagtcaataaaacataaaggctggattcaaacccaaggaatcaacctttaaatgcatttgcattacctcttgtgataactagacgggtctgatgtacctcacaagaggaatgcctgttgccgtataagccgttttctatttttctgcatataaatgtgagtgtctttgtgggtgtatgtgcttatttgtgaatgagtagacacatgtacattataaccagacactccactgagtccaatgtgtgtcaacagggaatatctattagcaaattctttaatcattcccatacttaatttaacaagtataatcattagtttgtttcaataacaaatctctgagctcatcacagtcattataacctgtcatttggaaataatgggtttatgtttcaaagcatgtgtaatctcacacatatttcctagaagaaaatcagactctgtaatttgacctaatgacaagtgtaattaatgctgtagatttgtagactcttagttatcaaatccaacctctcatcagtttcataaattttgagatctgtgaatgtggtgctggtagccattacttggaggcttcccaggttaatctgactcaactgtgggcagctctgttgctctagtggcttgaaagctctttagctcagttaacccagacctgccctcctgtgagtttcatctgccctaaacctgtgccctccagcaagccgtattgatgtctcacgtgagaccatctcaaatgtacaaagatgccactccaaggattctagccttcaatgacccagcctctcttcagtgactcctcaaagacccaccctctttctgcctccagttccacctgccctgagcacactttgacctggcattgtctcccctttcaaatacagtgtcccgaagtgaatgaaatgccccagaaaatattcaagaacgagaatcctagcacttgatctggaaatggatgctgagattaaacgtaaaccattttagccgggcacagtggctcatgcctgtaatcccagcactttgggaggctgaggcgggcggatcacttgaggtcaggagttcgagaccagcctgaccaacgagaccagcctgaccaacatggtgaaaccccgtctctactaaaaatataaaaattagctgggcgtggtggcacgtgcctgtaatcccagctactcgggaggctgaggcaggagaattgcttgaacccgggaggaggaggttgcagtgggcagagatcacgccactgcattccagcctgggcaacagagcaagactccgtctcaaaaaaaaaaaaaaaagagaaaaacgtggaccattttcactggcagtttcccaaatgcattttgaaaatgtgttgttcctacctgactgtggcttattttctcaggtgtactcctcggcacttcccggcccagtctgtgatgccaacgtttttgtttgtttgctttgcttgtgaccgtggcgccctctactgttcttcagagttgctaaagtgcctttctcaagaaagttccagattgaaaacttaattaaaatagaaaaaaaaaaggttttctgtagctgaaattagctattaaaaagctaagtgcaattcaaaggaaaacataccttctgtttatttaagacaatagcaattttctttttcatggaagacaaaccttctaagcttcctttatcggttttgcttggtcttaaaaaacccagtctcacccactgagtcatgttggaaaacactggatgttttttacactagatatttggaatcgatctagcagaagagtttcagggtcctctcagtagtttttgaaagctgtttcctgaatcataaactttcatagcttgaagacagttttaaaattgtcaggccaatcttttcagttttgaaaccaagattctgagaagctagaagagtttccaaaatgcacaagcagtgtcaaagccagtctgtgaatttcagatgtgaacctaattcattgcgatatgtttttattttcgtaaatcaaatatattaattttggaacatgagatattataaactcaatgggttttttattttaagccaaagtaaataataaacatttagtaaaaatttcacagtaatttaattattttggcatttagttaataaaatccataagctatgacggatgccttaaaagtccaattttcagtgtttattttcttatgtttccttgttatgcttgctaatacggcttctgacagaagtaaatgtattaatagaactgttgtagtcactcttattcctatatgattactaaaaaccaaagaaagtttggaatttgtccaggaatgttaatattatctgaacttggtccagtaaaacagtaaaaccatctttatttggaagaaaaaaaaaactttatatggaatataaggtctcaattcattaaaacaccatatacattgttgtaaaatatcaaatagatcttacaactcattagtagagcaactttgtaatttgcttatttagaattgttagaggttttcaccagcttctagccaacagaaagaactcacctgtgcgtttgaataaagtagacctgtcatgtttgtatcagaaatactaattattctcacttctgttgtaatatataaagctatggaaattttattttaagtgtttcttaatttctaaattcctatacattaggatgggtggaaggcattgtcatctgttccctggatactatccctgttctcatatggtttttctaaattgccaaagatttgaaatgcaaccaggtaaaagtaataccatctaacagctcaagttatagcattagaattctttagactaagtgtcaacttcagttgtcttattttagagaggaagaaaaggagaaactcaacggtttgatttgcccaagtaagaaacaaaaccaggagcaaacccgggtttcattgattaccgggctagcgctcattgccctgtgcctgaagtatatcctataagcttccttaaggagatttttttgtgaacttaaaattatgagatgggagttggaagtttgaggacacagccaacatttcttcgctaggtaacaggcaccaggcctagaataagacttctcttaaggggcaaaattaaatacattgaagccaacgtttttgtgatattttgggatgtctaaccaacatcagctccagttcttttcgaagtctttattttcactccttaccgacagcttaacatgaaaatactagagagagttcacatttgaaaacattttaaagactccctatctaatgctaaatgtctaaagttgagaaactctcagagaaagtatttagctttaaaaacttttgtacttcgagaaaatagcgtctatagggtgtagaattccatcttttaagtacagaatgaggaaagatagcagcaacattttctttttttattttgttgagacaaagtctcactctgtcacccaggctggagtgcagtgtcgtgatctctgctcactgcaacctccacctcccgggttctagtgattcttgtgcctcagcctcttgggtagctgggattacaggcacctgccactatgcccagctaatttttgtattttcagtaaagacggggtttcaccatgttggccaggctggtcccaaactcctgtcctcaagtgatctgcccacctcagtctccctaagtgctgggattacacgcatgatccaccgcacctggccagcaccaacattttctgtgactttgtctttgctccatgcaacataccctgagacctagtcgtatgcctaggctatttcagtactatcaaaaataatgttaaaatgaggagagtcttgaaataacagagtaaaactgtgctccttctcgtagtctcctgacattgcacagaaccagacattctcctctgggctgtacctgtggcttttttttttttccacgagaaatttacacaaaggatgatggatctagctacctaatgatgatgagagacaaggttctctccatttttctgttttcttcacctacaatcaccttccgcacttcctgccccatgaacactttttcattccttacggtttagttcagccatcatttcctccacaaagacatccttatagccccttaatttggagatgcatcaccctgctctgctctgcctttgtgtagattctgcctgtatctctatcctaacattcaatatattacatttaaattctctcaatgtggttttttttgtctgttttgtttttttggtttggttttttttcgatctctgccttaggtatctttggttttcctagatctgacacatgggaagtgcataataaatgaaattatgttaaaacagaaatcttcatttttggggtcattggagctcaattgaatagcgtatgtcaaacaaatagcaggtcaaatcatcagctattgttttagttgactttgttcttctataacagaatgtttgagaatgagtaatttatcataaacaaatttattggttcaaagttctttagtctgggaagttcaatatcaagataccagtatctggtgagggccttcttgatatgtcatcatatggcgaaaggcagcagagtgagagaaagagagaaaggggtctgaacttaccaatgaatccactccatgataacgacattaatccattctggaggacagagccctcacagcccaatcaccactcaaaggtctcctctccctataccattataatggcaatcagatctcactgtgagtctgggaagaggcaaacattcaaaccatggctgctactaagaggcatgcgttgcagccagtttatcttggaagactcacccagaatttaatttcttaaaattcaatatccttatgagggcaattggtaacacctgctgtgaatattttccaggctacaattatacaacaacactccatgccaaaaattgttaaggaccttgatcaagcatttgtccttatgttcaagcagctcagaactgttttctgtggaaaaccttggccctgcccatctctgcaagataggcaaccatccaggctttaggcattcaggtggaagatactgaatttcataagacaatgtttgtttgattcctctgtgcttccagtttcacatcatacctgaaaaatggaaataatacctatcttatgaggttgttgcaagaattaaaaacacatcaaacattttaagtgccaagtgtagtcagtgctatgtaggtattgttgctggctattattagtataagattgagttagaattgccagacttagcaaataaagatatataacacccagataaattcgatttttaagaaaatgacatagtatttctttagtataaatatatctcatgcattatttgggacacacttgtactaagaaataatttattacatgaaattccggtttcactgagtgtcttgtatttaatctggcaatcttaagttgaatgaatgaatgaaccctagttgaatttttcaaatatagcttttaaagggttgttttcattaactgaatagaacatataaatcccctccagctgggagccttctctattaattgaacaccttctgagatggcttcttgactctgcactgtaggctcaggtaacaaggtgaaaggcacctgaaaatgaatcaggaactctgggagacccaaagatttaaagttctggggatccagccgaccttcagtgccaaggaaggacttttaggtttagtctctccctgacttgccgtgttacgttggaaaggctgaacagaatttggtagaaatcttagatatagttgatatccagaatatggccagtctggatataattcatacatagtgtttgccagatcatttgtcaacctacaggaaacaacttcagtggatctgagaaacagattgaagacagggcaacaaatgctaacattttttgatttctgaaaagttatctggcctttaggctattggcatttttaattaaatagctgaagtgaagcatgcaaaaagatcagtgttagtaacgcacccttaatttgaatggtgaaagattcatgatctactgaagcccaggtcactgccccgcattattaggtttttaatatagcttgagttctcaggttgcataaaccagataattaagtgacaatggattttcatattcttatttaatagtgaccctgaattaacccttcaaccttcagagtcatcttaagtcttcatttttatccttgtcttctacagtaattgtctttgtggtggtggtggtggtggtttttgcagctcattggttacagcttcttttgtttttatttgttgtttgtttgccgttagtccctggaaatttgtaactgcaaaaatactatagaatttttaaataagtcttcttataattatgaaaagctgaagctgctattgatgtgcattttaaaaccatgttctatatgtaccctctgcatgcaaaataaaagttgaaattataaaaacaaacaaagcatggtccaatatcatctcaagaaataaatggttaaaaatgaaacagactttttttccattcctacattttttctaatgttgggagttccaagtaacatatggtaatgctttaagattcaaaatcatacgcaattattttcatcttaatagcattggctttctttgctttaaaattcaccacccggcatataagtttgcctgtcctcactcagtctgtattttcctaaaagtgctcctgaaagtaaagaatattaattatcattctgcagtgggatcataactttgaaaagttgaacatcaagatttgcttttaatatatcaccattttgttattaaaataataaggtgtgacacttggatatttcctttgtaaagatcctgagaagtgattgccttcaggttttctgtcttctctagtacagtataataatttgggtaatttaaaataaaactgaaatccgaatcatttacatcttgagacgtacccagagaattacatgttgtgatgacaaatgagcaaagaaaaactcatttagcacgttttttgcccagatctccccctgtttcaaactctccccagcaaagctgcatttattctgaagccactgagacttaaacttcagctccccaacctcatcccttccccaaacctgggtccttccaaggtcttggaaatgtattcacataggtttttgaaaacttagcaaggtggctgggcgtggtggctcacacctgtaaccccagcactttgggaggccaaggcgggcagatcacttgaggtcaggagttcgagaccagcctggcccacatggtaaaaccccatctctactaaaaatacaaaaattaactgggcatggtggcacacgcctgtaatcccagctactcaggaggccaaggctggagaatcactggaacctgggaggcagaggttgcagtgagccgagatcatgccactatactctagcctgggcgacagagtgagactccatctaaaacacacacacacacacacacacacacacacacacacacacggaaaattttgcaaaggttagacatttttaacacaatcaggtaagacttcaatctctttcttctccaactttagaggagaccctcaagttgtacaaacctcaggcgccaccagactggggcccaccactgttcccaaagtgcagcttattttaattattacacatatcttgcattattagtgaggttgaaccttttctgatttatgtttattagtcacatgttgaccttgaggccagttttgctccctattgactgtgcccaaagggagagaagatggtggaggggagtggggatgccagggcagcacccagtcccagcactcaggctcaactccaaatcctctccctggagctgcccattgcccacccgagggcagattccctccccttgttctttttacccttagagtctagtttcctccaattattacatctggagagtctcaagcagcaaggcctcagtcctggagtctagttctttctctgaatctgaggacaaaatgtgaaacccaatggcgtccttatcatccatgcctttgatgaaaatacagcacttacaaggttaactggcatcactcatgaactgctgctgctatcattgtgactcttgggactgcagcagtcttctcaaactgcctataacctcaccccttgcatgatggaataagtagcttgtgaagggaatttgcgattgttttgtctcaggtatctgagaagaggtgggaaagggagtagacaaggcatttttcagatcttacgacatgccagtttctgcattttacatggcacagtctctcctgatacctccagtgatactaagtggtattctccctatttggggaagacctggaacaggaggcaaacccagggcacactgaccgcatagccgaggacctggcctggtggtctccaaagtgccattcacacaacagctagctagcctcacagggcgtcagtatgattcccgggaaagaggtgtctgtgtttaatggatttctatggtccagtgctgtggggaaacactaggacatgaccctgttaagcacagaactcttataaaagctttaattggctaatgtgcagggtgagccaagaggtctgttttccacagactgtgttctgtgaaacgcactctgggaaacattgttggagaactccaggctgctctcatggagcatggagagaaaattccccttttcagaaagtggtgtaaattctggagggatagtggaggggagggaaggggcaggatatgagaaggggacatggacagcatcttttctttcggaatgaagacaatagacacctatctgcacccatggcagccccaggttgtgacttgcccctttgtaaaaccaccatgccctcccattgcccatggcccttgctctgtccacacccctcaagccctcttccaaggatgggaagtccttcccatcgctggccttcagggtaagaaagcagccactggtcttaactgcttcctcctgatctccagcatttgtgctataaactctctactctaaatactttatttagactctggttaatggaacctacacatctgggaagtcccggacctttctaatgaatttagattattctggctttaaagagtcttgtttctactaagactttcgagagcttgttttgaagctctccttgtatcaccctttccctgagggcagtacatggaggaagctatttatgctgcctcagtagcagagaaaaaagatatagaagcaagtaatctttgcgaatagcagccttgtaatatcatgaaatattattttgttacatctgtttaaagcttgtttttacaaatcctagaaatgacactcactagggaataaatcaagcaagggagtgatttgttccttaacaaataccagtttgtcagacctccgtgtgaagttatatattcaaaggtaacagactgtggaataattaccagaaatgtgactaaaaacatcttgatttcatctcaggttcaactgaaccttcttaatacaaggcatttgagttaaccatctcgaaaacagctagtttaaggaggttttgcaagtggctatcagtagaagaaggaaagctgatgcagacactttggtgacaaacaacattgagtttgtagaaactctctttatccaaagacagagaggaaccaaggcaataagagatctcagagggcttcattctgcaggtcgggatgattgagacagaaattcaaagagagcctttgtcttagtccttttgggctgcctataacaaaataccataaactaggtggctttttgatatgatttggctgtgtccccacccaaatctcatcttaaattgtagctcctacaattcccacatgttgtggaaaggacccggtgggaggtaatttaaccataggggcgggtctttcccatgctattctcatgatagtgaataagcctcatgatatctgatggttttataaagggcagttttcctgcacaagttctcttctcttgtctgccctcatatgagacatggctttcaccttccaccatgattgtgaagcctccccagccatgtggaactgtgaattgattaaacctctttcttttgtaaattgcgtcagtctcgggtatgtctttatcagcagaatgaaagcggactaatacacttataaacaacagaaatctacttcttatagttctggaaggtggggagtccatgatcaaggtcccagtagggctcagtctctggctgagagatggcaccttcttgctgtgtcctcacatggtggaaggacaggaaagctctctggggtctctttgataagggcactcgtctcattcatgaggtcagagccctcataacctaatcactttccaaaggcaccattttctaataccatcaccgattagtgatggtattagattagtgaaatttcaacatatgaattttatggggacacaaacagtgagattagagcagtcccagagtgcgttatttactcagctttgctgaggcagaacagctccagtatcttccctgatgatttaatttcagcaaacatggaacaagactctcctctctaaagcaatagtcacacaagacaagtctttccagatttaccctcaaccttgttattagctgatggggcaaggctttgccgtttttctgtgtgatgcacggagacccatattcaagctaagagaggttgtaacactggaaggatgcttgtttgtctttctatccaggttgggaatatcaccttcagtccatcactttccctttcttgcactggcttttcagtactgtttaagaggaagggcatggacattctaaaattttcgtgatgatattgactactttgacaaaaataagcattttcatttgaaacacatatttaagtaacaattttatatagggaagatctgatttctactcttagaatataacagtcataagaagttgcatcagaaacatccaggtgctctttttaccatctaggcaattgtgtaaactataaaatgttgaactatagagccatctgtaaataaaacattattgtatttgttagtgtattttctttttccagaaaaatgcttaccaggagttaagaaaagttatccaaaacttggaaattaggcaaacagagggcagcatgtcatttcaatatcatataggtggaacactggttaacaaatccacctaagggctgtacgcttatctagggaacgtaactttgttttaatcaccaattactattaactgaaagcctagattatgtgatgttacatgttaatatgcagatttttgtccaattttgtatctcacccagaaatcttattccaaatttttttcttctctgcctatatattcttcttatgcacttttgaatcagcatattcatctggttggctccctcattaaggtgttaaagagtatttttacaccagttttctctatttatataagggtcatgtttttaaactttgaaaattattctttggcataggtagctttctttttttcagtggatctccatcttccatgaaagacacatacataaaagggataaaagtattgtttctctgaacccgatagaggagaagctctccagacaatcttaaatgcacatctttctgattataaatcccgtggccttaactggcttctcttcaagaagttcatatcacaactctgccacgtagaagctgtgtgaacctgacaaagttcttaatgctttcatgctctcatttccttttctttcagcatgcctgttttgtagccttgaggctgaaaacctagacttctgggagtatgcagattacagaagtgctcctttctcagtaagatttacatcctgcaaatggtattgttaaagacctaagtaggcaacaaaaaatttagcaaattcattggttgctgaattgcttatcctttaattccagaagctatgtgttaatcacatatcagtaggaaatccttccaagtaatgagctgggctactcttgtaaactacagtttcatattttaatggttacttttgcttagtaatcaagtcatgacttatcagggatatacaccattagcttcttgccaatgtaaatagtgggtgatttgtgaatcattgctctgcccttttagtaaatattctgatgaatgctataatttttaaggaactcagcatgaataaccactcttggctatcaccagcaggttttgaactgaggaaagaaatgaaatggccggtactttaactccatttcttatggcatttttcttctatgtagcaccaatgcaaaatgcaagaagaaattaagagaagaaagtggtctgataattagaccttgaatgagaaaaacaaaatcttatttagaattataatatgaaattatacattattatgcaattataatatgcgatagaatttttaagaaccaatattagaatggaaccattagaatcatgtttagaaaggtcacagagggcagagcagagtgactttttttgaatgtctactaagcgttttacttgacacatgcttctcagcttcacagtatcctggaagagtggatattactttaaaatatgagaaataggggcctggagaatgtaagtgactttctgagagtcacgcagtatagaacatgaaggccatctgatgcaggtctgactctaaagctgggcatctcctattaccactcaagaaaataacactggacagtgactgcaatggaatcccaagcatttctgttacaggacaaaaatcatcttcatgtgcttttgctttgcataagaggcactgtcacttgtgttaggactttctgttaagttgtagtcctttgaagttctcaagtaactaaaaaaactatatgtcttgtggcatcctgggtaattttatgatctgcaggaagctaaagaactctgggcaggattttagacacaggagtacctccagcctggtcaaaataatttatttttccactaatacttagataggttataggaaccctcctccttcccaataacatttatttgcttttttactcattcaaaaagtagaattcctgggcactgtcctagatgtcgaggatgtcagggtaaacaaaattcagatggtctctgcctttcatggttcttgtatcttatcattgtaccatattctatcaggttccttcattcactcttattcatctgtcaaatacttattgtacacttactatgtgccagaaattgttttgaaagctttgggatatgtcagtcaacaaaagaaagatttctgcttttctgggctctaacgaaggaagacggacaataagaaacatgaaaaatgagacaaattatatagtattttgaaaggtgatgagagctatacagaacaaaaagaaaaagaaaaactagatcatgttaagagagattgggaagatcagggtagcagggaaacagtttacagtttgaaataagatgccctaggtaaacctcatcaggaaggtaatgttggaataaagatttgcatgaggtgagggagtgagccgtgtagatatttgtgatcagaacagtctagacaggtagtgtcaagcttctaggtgggagtgtgcctcgtctgtttgaagaacagtgaggagcaattcactagaacaagttggaaaagaacagtaacaagaactgagttcgggaggcaataggaggccagaatgtgtgatgcagtatgccccatttagtcagaggtactcttcaagtttaggagcagagggtaatgtgactggcctgtgtcaggtttcagcctcctgtcaacaaaatgctgtggccatccacatcatatattatgatggaaccttagtgacaaaccttatcaagagaaatgggataaattagccatcagctgtgtcgtcaccctttctccaggcaagacccctcttgttagctgttggcatcttctgctacttcacttataagtaagcagtgaagcatccagactttgtgtttttagtcccctccctcgtgtccagcagacaaatatccagaattagatagaattacatagtatatggctgaaatattgtgtcactcattaatctatgacagcaagatccctaatactttagtgacaagtctagagcacttgcccaattcagactaaagccattataacactcaaatgtgaaaagccaacattaattgaaatgtaaatgatagtctctcatgaagttggatacttgctttatattagaaacttaaagagaatcttaatcctttcataaagcaggtaaatacttttaattgatctttaactgcatatataggataaaattaaacatgacacttgttctttcaaagttcatagaagaaattctaaagcattttaagggatctgagccatacagtttttcccatatgtagctgacataccatcaagaggaaaaaaagcaaccataaatatgccttatttaggctctaaagagctaatcagagactacagttaagtttagtgatgataaacttgttttaacaagacatttatgtctggttacaattggcatttaggaaaagcgtgcttagattgaatccagcaaagtaaaattgagccaaattctagatagagctcatttagaccaccctctgtagataatttattatctaatcacttcccatttaaaaaaattcttagtatgtttagtgttaagatattatgagagccaaggatggcagccagaggtcaagttagtcaaagaccatgaacatagtgcattgtccttgaaaataacttggtggagagaaaggaatgtgaggtctgcatctgacagcttcagttctctgggctcgttgaaactctgttctcagtggtcatttatgtttctctcagatcagcagtagcatttatttttagagagagttttgaaacttaatcactcagcacaatacagaactataaatggataaataagttttgttcaggagcaaaagagatataatcatttctcctgacattttgaagctgcttctgtggagttgggttgttaggccatggagcaagaggactgttgtctggtgtggtgtcatactgcaggactgtccccttactctagtcagagttcagtatgttggtgtccaagtgggagatgtggatggatgaggctccaggttgtcccaggcagctcagtcctctgttttagtccattcaggctgctataacaaagtgccatataagccacaagatggctggcttataaacaacagaaatttacattgtacagttctagaggctggagaaccctagattgaagcgttggcaggttcagtgcctagtaacagctcaattcctcatagatggccatcatctcattgtgtcctcatattgtggaagatgcgaggggtctcttttataagagcactaatcccactcatgagtgctccaccctcatgacctaatcacctcccaggcaccccacctcctaatgccataacattgggggttaggatttcaacataagaatttttgtggtaacacaacattcagtctatagcaccacattagggatttagataagcacaccctagacggatattgagcatcctcgttgctgaatgtaaaagatctgcaaggatttgtttctttatatcaatgcatatttcagctgtatttggcactgatgaccctacctcctccttcttttacccttgatttcttggtctttctctactcccacgactaaggctgtcttcctttattgacatctcttcctccttaactacccattcaaaatgctcttcttccctggggagtctccctgggccctgtgtttatctcacacatccctttctagtgcacactgagagtttgaactacttgaaaattaatgactttaaagttgttatctttacattatattttgccctaaattctaagtatggctctatctatagatgtatttataacagtaactgccactaaattactataattatgtatttggttttgcttgtttgtttttaaaaccttttcatgcattgcagttccactcaagtttcctctgctatggactgcttcttcatacactttacccatttttctgttgggtcatcttttttttttttccaatttgtaggaatcctactgttagtacttagattctgagtactaattttttgactatcatacaattttctaatttctttctccttttcataacttatctttcattcgtgttctttgtcatacaaagattttaattttcatgtagtcaaatttatctatcattttgtgatttctgctttttgtgttccttttaaaaataattctctcccctgacatcaaggagacactctcaagtattttattctaaaattataaaattttgttctttgtatttaggtctttagtctatttagagtttattcattgtacgataaaatatagcaatctatctgattttttttatatggggaaccagattgtcattactaaatattgcatatatctttttttccattgaattctagtgcttcttttattttattccaaacttctgtatgtgccctgatcaatgtattggttcattctaatgaatggtgaaatgaatatttaatgcactaagaacaaccaaatggatattttttgttgttgatatttgttctcttttatttatttactaacaaaatagtaataaaggcgttacatttaggctacactagatttaatatttatttaataagatcatttctcttatttctcttcctcctccttttctttttctcctcttcctcttcctcttactcctacctctcctccctgtccttctttttctcccaatgctcaagtagatccaagccccccacttttggaaggagagttgcagtgttttaccccaacagggtgactgcttaataaaagaagaaaaatctgcttactcttttacaactaaatggttacattgattacatttagttacaacttttatttttttacttgggctatgaataaaccatttttgtccagagtaaaatataaaatttctgtaggatatcttctgtctttatgtccttctcttgttgcatttttataaattatttcttaggctgaaatgacctaagctttcaagtacatgctgtaggagcaatactgacatttgttccatcccagtctttcctcggagaaagtgtcacaatgtaaatatcctagaagacctcaggctgcaaaggaaaaaccttcaagtgtgccttgaaaagtcttttttatgtgctttttattctgtctcactgatctatttttctatccctctgccaatatcacacagtcttatttactcaaactcagtagtaagttatgacacctgttagtaaaaacccctcctcctcattcttttccaagttaagaatagagcttagctttactctttcatatgaattttggaatcagtttgtcaagttccacagataatttcattgggattttgatttgtggtcagttgaatttatggaataatttggagaagattaacaccattatgatattgaacattttctgcctcgaatatgataaatattgctatttaataatagattattgaccgggcacagtggcctgtaatcccagcactttgggaggccgagccaggtggatcacgaggtcaagggatggagaccatcctggccagcgtggtgaaaccccgtctctactaaaaatacaaaaattagctgggcacggtggcacgcgcttgtagtctcagctacttgggaggctgaggcaggagaatcgcttgaacccaggaggtggacgttgcagtaagctgagatcacgccactgcactccagcctggcaacagagcaagactctgtctcaaaaaaaaaaaaaaaaaaaaaagttatagattgttaagtaacattttgtaatatttttgatatagatactcataggcatttagtaaattttattatcatgtgtttatactttttatcacacttactagtcaattaaggcctatagcaatgtcactggcttttgtgtgtcttgtatctgacaacactatagaactttcccattagttccaaaagtttatctatagttacccttgaaatttttttgtgtagagtaatgacatttatcagttagtataactttgctctttttttcccaattcttatactattaacttctttttttcttgtttttgtttgttttgctggttggtttttttggtagtggttggaatttctagtataatgttgaatagtcagaatgatatgagaatcattttttgtttctggttcatagaaatgccaaagtttccctattaaatttgacctatgttagcagttgggaataaatctcagttttaaaatgtccctccatttatagtttgctaagagtttctattataaatgagtgttttataatagaataatgaaataaaaaacataaatagaaaaaaatgaattttgttgaatctttcagcagaatccagaaagatgttcattttttttttctcattttaacctggtaacctggtagcttgcagtggtcgatttctgatgttgaaccaccttcttgcattcctgaaatatgtcccaacatcatgatatattaaagtttgtatcccttgcttgaactactttgtattttacagagtaaaatacattttccctatgagggaaaaatggtttcctgggccaggtccagggaccccttgctgtgtgcagcctagggacttggtgcccagtgtcccagccactccagctgtagctgaaaggggccaatgtaaggctggggctgtggcttcagaggaggcaagccccaagcctttgcagcttccacatggtgttggtcctgcaggtgcacacatatcaagaattgaggtttgggaacctttgtctagatttcagaggatgtatggaaacacctggatgtccaggcagaggtctgtttcaggggcggagccctcatagagaacctctgctagggcagtgcagaagggaaatgtgggattggagacccaacaccacatccccactggggcactgcttagtggagctgtgataagagggaaaccatcctccagaacccagagtggtagatccaccaacagcttgcaccgtgtgcctggaaaagccacagacactcaacgccatcagtgaaagcagctgggaggggggctgaaccctgcaaaaccacagggaccaatctgcccaaggttgtggcagcccacctcttgcatcagcatgacctggatgtgggatatagagtcaaaggagatcattttggaacttgaagatttaatgactgccctattggacatcagacttgcatgggacctatagccgcttcattttggccaatttcttccatttggaaagggcgtattcacccaatacctgtacccacattgtacgtgggaagtaactaactttctttcgaatttacaggctcataggtggaagggacttgccttgtctcagatgagacttttgagttaatgctgaaatgagttaagactttgggtgactgttgggaaggcatgattggttttgaaatgtgaggacatgagatttgggagggtcccagggtgtaatgatatggtttggatgtgtccccacccaaatctcaccttgaactgtaataatgccctcatgttaagggtggggccaggtggagataatagaatcatggaggcagtttcctccatattgttctcattgtagtgattaaatctcacaatatctgatggttttataaatagaagttcccctgcacaagctcttgtttgccactatgtaagacgttattttgctcatttgccttccaccatgattgtgaggcctcccagctacgtggaactgtgagtcaattaaatctcctttctttataaatttaaattacccagtcttgattatgtcttttttagcaggaggagaacagaataatacaaagctgtaccacattttattactacctatcattggcaaagttttacctttgctacaaatataaggttatatacaaatgtacaaatacgaggttgtatacaaataacaggttatattttgaaacatctttatatcaggcttatgtttttaggtgattctctatataattttcaggaaatttctatctctcttgtttatttcctcaaattttctacatatgtatagtgttaagatatttgtatatgctaatataaaatgatgagcatataagcttttgcctttgtcaaagtgtattcttctcttcttctaacatacacagtataaaataaactcccatttttctctccttattaccccctctggttcttcataaccctttcaccacagcacacacacacatttgcttattggcgtgtagtctttctggctttcctgtctaaatgaaagcttcacaaggtcatagatttcacctctgtttttcactgctgtattcctgccacacagtatgaatttagtaaatattcgaatgaataaaattgaaaatatgaatctttccttctgtttggttgagtgatcatggaattaaaactatgcatgaagccccatagtctaagaatgcaaagaacagtagtgttcagaagacgaataataaatgtccataaattgctcttctcaaattgcaatatctgatgaatgcagtttaaaagaggactttaaaatctctaaaatttctaagaatttgagacatattgcaaattactgaataattgtgattttattgtcaggtttcattgaaattttaaaatcttaaagctaatttaaaacccaagaaggtgtcagatgaataatctttaatgaagaatctacacacaggagcagcaatatagttcctaaatatatagcttaatatgtgtattaagctatactatatatatttaagctttatatttacatataaagctatatatttagaaactatatatagtatagaatatatagtttctaaatatatatgtatagtttctaaagattaagctaaaaagcttagtaactacatctctagagaagtgccttttttttaagttaaaagcaaaaacaaaaatcttcattcctttgatgcatctattcttgccagtaactgcctgaagacgctactcccaactgtggcaatttagcacaggaggggggacacactaagaaggtgggaaatttggatgtctgcttttttagcaggggaaggaaaagcaattgccagtagaagcatttaattgcatacagattggcctttcattttgcttcaatcttttccattcaagtgccagggaaggggaagtattacctccactgcttacatcggaggtctgcttccacttagctgctgaagcaagcctctccttctttccagagatgccccccgtgaaaacccactgtgagaggagttgggcttgagtggctccaaatacacagcagtaatattctgaagcctgtcctgttcctaatcctgcacggcagctcttggcactgctggacagttccccaggcttctttccaattcttcctgtggagcagggaaagaaaaccaggtggggtggccaggccatctctcatgatcggtagagcatagctgagtatagagtatgcaggataatgcagctacatgaagatgaatggtcagaagtcaggaaggattatggggccacagcccccagtgtcttacccctctggagagcatcactcaaacccaagaggaggatacaggtgggagtgtgagagaaaacccaacactatgaagggagtgtctaccttaggaaacatgatagagcctcagggaggaagccaaggcaggtgtgcttgacagggaacccatgcttccacagaaaaaaaaaatgacaatatttctgtacaagggataaatctcaatcattcacagaccactcctgcatcctctccctaaaaacagacttcagaaatagctaagagtcatgaatataagaaagctcaatggccaagcaccctataagaaacaacttttccttaagccactgtggcctccaaatctgtccttctttgcataggacacgtctcagcctccagcttagccatcggccttctgtgctgtgcttccagacatgaagccatcctgcagcctgggactgcttcccactttctcttctgccttgcacaagttagtacccaattgtgttgatccctctgatttaactgctgggtgaaaattcttccttctgagaaatggtttctttcaacttgaggaagcacacatttggacaatttccttatgctggtaatggttatttctgtgtactcttctgatgcggtgaattgactgtttctagtttgtctttctgcacataccagccaaatacaacttgaatgcattcaataagttcccattgatgggtgacatgtaaaatagatgttctgataggattttaagtgtcaaggttatagttcccctttacatactaaccaacccctgacccctagccaagtaacatacttttacctcctcttacaagctgagaaaattaggactaacccatctagtataaataattggaaggagctcatattgctaaataaatatctgttaaatattaaaatgataatattcaaataattaagatacagcaaaatgccatgtttcatattaaaagtagattaaacattatatcattacttaacttctttttaatgataaaatcaaagattatttattacaaaattgaatttaaaaatacagaggctgggtgtggtggctcatgcctgtaatcccagcactttgggaggccaaggtgggtggatcatgaggtcaggagatcgagaccatcctggctaacacggtgaaaccccgtctctagtaaaaatacaaaaaattagccgggcgtggtggcgggtgcctggagtcccagctactcgggaggctgaggcaggagaatggcgtgaaccccaggaggcggagcttgcaatgagccgagattgcaccactgcactccagcctgggcaacagagcgagactccgtctcaaaaaataaaaataaaaatacataaatgaataaagtaaaaagtcaaagccatctgcctagtccagttctccaaatatatccactatggtgtgtggatatatcttggcatgtgccattctggacatttttaaatgaatacacaattattcaaatatgtagataacaaacatttgatcaagcagggtatcacaatgaatgaatccttttttataacttgtttttctactgattgtaatagagttcttctttccatatccatagcttataaattcatctcatcttctaatgtttgaagagtattaatacatgtcagttttttaacaaattaatggagtttacattgtttttatttcactattatatatttgttataaaaatctctccatggcaaaaagagtgaaagaaatataagtcacaaaatctcttaaatatgtgaaccgaggcacaataaaattttcaagagtttctttgagcaaacagcaatttatgaatcaggtagctccaagccagaagatgttctggagtttcaccaagagaatgcaagggtagggggacttttatatgataacctgcaaaggaaagccaagaaaatatttgattggttacaattataccgttgtcttatttggtccatcttgttgcaaagtccctagttatacaggttgttggctgcttctgactggttgagcttaaaatctgatttttctttaaaagtggcattaatgagacacagctcaagttacattcttgggagagagagaaagagaagagagaatagttgtaacagatgaaaaaagagaaggttgtcatctgttatatacagacagcttttatcagtaaaaacaaaataaatgaccatttaaaatgaaagcaaatgatgtaaaaagttaattcacagatttgtgaacacatgaaattatgctcaatctttttttcaaagatatagaaattaaaaattataagaaaaaaatgttctaccagattgggtggaaaattaaagaaccaataatcttgaatattgatgaggtatgagaaaatagcaaatcgtacactcttggtgaactcataattatcccaccctctttagaggacaatttagcatactgatccagagttttaaaggaagcactgctttacccagtgtggtaggcagaattcccagatggtccctgaattaatccattctcatgctactaatacagacatacccaagactgggtaatttataaaggaaagaggtttaattgactcacagttcaacatggctgaggaggcctcaggaaacttacagtcatggtggaaggggaagcaaacacatccttattcacatggcagcagcaagaaatgctgagcaaaagcagggaaagccccttataaaaccatcagatctcatgagaactcatccactatcacaagaacagcagcatgagggcaaccacccccatgatttgattacctttcactgggtccctcccatgacacgtggggattatgggaactacaattcaagatgagatttgggtggggacaagccaaaccatatcagcccccacaatatctgtcctctgtgtacatcctgtatataattcactccttttagggcaagcaagacctatgcatatgaaagaatttcactctcttgattaggtttcattatatggaaaaggtggggggaccttgcagatatcagaaagctctcaaatcagttgattttgatttaattgaaagggagattatccaaggaggacctgacctaatcaggtgaaagccctcagaagagagactagggccttgttaaagagaaaaatcctcctgctgacctttaagaagtaaactgccatgttgtgggagaggttatgggagcctcttggagcagagagccacccgcagtgggcagacagcaagaaaacaggggctatagtcttactgccaaaaggacctgaattcttctaacaacacctaagtttgaaaggggacgcttagcactggagaggaacacagcccagctaacactgattgcagtcttgtgaggcccttgctgagtgcccaaacaatactcctgacccacaaaaactgtgagaaaataaatagctttgtttaaagccgttgagtttatgataattatttacacagcaacaggcagatactccatccagcagttgtactgctagaaatgtattggacaaaaatatcaaagtgtacattgttgtatgtacaattatgttctttgaataattatttataataatctgttctttctgtgataatttggaaggcttttctgatgctttgtgtcatcaggactacctcaattacttaattctacctttcttaaaaaaaaaacacaatatggcagacacaacattctttgaagcttaaacagttttccgagtgtatatgcatgcatgcattttgtttttgtttttttgagacggagtctagctctgtcacctaggctggagtgcagtggcgtgatttcggctcactgaaacctccacctcccaggttcaagcgattctcctgcctcagcctcccgagtagctgggattaccagcacctgccaccacgcccagctaatatttgtatttttagtagagatggggtttcaccacgttagccaggctagtcttgaaatcctgacctcgtgatctgcctgcctcagtctcccaaagagctgggattacaagcgtgagccaccatccccggccgcatgtttaatggaatcatttaactaagagagaactttaagtcaaaagtaaacctttctaatgaaactaaagtaactgtgggattttgttgtggctgagagcccaaaatttatttcatgaaaaaggaagaaagagcccctgttttttctgcagaaactttaggggcctcaattacttcaaacaatatttttcaggagcactgaatttttgactgtttaaaaggaaacaaagcccgagtgaatgttttcaaatgctatagtctggattattgtctcttttggaaaagtaaatccaagatggcagctgctgagatggaatgtttctttgggtgttcttagcgcttaatgtataaatgattgctctagtaatgtgcagtttcatgaactccactgatacatggtctgtgcaggtgattcctccatgcattaaaaaccttaataggcttcacctactccttttatcctttggactgtgattttaatatttgcaaacttaaagccaaatttaattaaagccaactgtgcagtgaatgcagtgtgtgactcctctcttgatctgcctattacaatttagtatcagtttgttttttctcttcattgcatctgaaagagatcctctaggagaggctaatagtcatttggtgaatggatgaatagaattagcgaattagaaacaaattccttgatatggtttgctgtgcccccagccaaatctcatcttgaattttagctcccataactaccacctgttgtaggagggacttgataggagataattgaattgtgggagtggtttcccccataccgttctcatggtagtgaataagtctcacaagatctgatggttttataaggggaagtttccttggacaagttcactcttgtctgccaccatgtaagacgtgtctttcaccttctgccatgagtgtgaggcctccccagccatgtggaactgtgagtccactaaacctctttttctttataaattacccagtctcaggtgtgtctttattagcagagtggaaacagattaagacatccctacaaattcaaaatgcaaattttcatgtttgtttttaacttcttgaaatgattcatactattatgacagtttacccaaattcatacctgtaaaaatgtgaagttcattaaaatcttttagcttctgcctcgtctgtttttagagcttgataattattaagaactccttcaattctcccatgagtgaagcactctcatttttcccattatacagatgagaaaactgaagcatggagtgattaatcaacttatctgacctgagctagtgggggttgacttaggacttgaacccagtctatttccaggtcctgctttcacaagcaccagcacttctgcctgtatagattagagcttagattgatatcttagatatccacacactgtaacttcaaagctggtaaaatattttaaattaaataaatagctattactttttagtatacaaaaactttaaatgttgggggatgaaaaagttatggtaagagattaaggcaatccaagcaacaataggaaaacattccgttattatgaagctttgcattgataagttccaaagaagatcacaaacgtgattccaggctgaaaagtagtaattttgtagacgttattgtacaatattctttcccagttgggctctaagagctaagctcatagcctcccttgcagagtagcttctagctatggtccctttgaaccacagcttccgtagagaaagggggtattgccaggtaaatcagccctgggtctttgtggtgtcacagccacataaactatgactttatccatgtcatttacagggtgacaaaggtagaagggccttttaaaatttagatgtttgttataatgattagtattaatgttgggaatgataatgttttcatagaacttactgctaggcattgtggcaagtgtgttccagcattgtatcccattcggttcttgcagggcagcgcccactcatttcccaatgttgtccggacatgttcccattacccatgaggctcagatatcctagctgtgacttgaaatctgaatgtcactttttgttccagagagttcactataaagtggaaagacatgctggactttccacaggctgatctatgcttttgagttttgattttcctgaatcctttttcaaacatcctgtagaggtaaaagtcaacactggattttcctttgaacgtgtgctctgtgccctgctcatctcttgcggcttggctgtcgccagcatgtaagaactcccaactccttcccctctcctagagccgctttgcctctttccagacaggctcagctgagtgctcattctctttccttttgaaaacacgactctgagatgcagcctttcttgatagacagcattgcttgtggagctattatacatgtaatcagcaaggatacacacacccggccatttcctgaagaacgtgctgccaggtccgttcacaatcactccttttatttggcatcagcttgtctatttggagagtctgaccactgttcagagaatttttttttctctatcaagtactttgtgtttgaaagtgatgcataaatggcctcttttcctattttagcctgtgtgcaaaatgaagtgcaagttgaaaacagatattctctttgtcagaatcactcatacaatagcatgtgcctcaggtcgcaacggcacctaaccataggaataaagccttgttcttctcttcttgtccgccaacaggctagaactcattttatcagcaaccagaaatgtacttaaattaatgaaataatgggtcactctaatagtttgaaatatactctgcagcataaggacatgtttagcctcttgttctgcccgtgagtgggggttgtagtcaccctgagtctcttagcataaagtaattctcaaggctaaatccatataaattaaataaatattattttccatgtctctttgcattatcattttagttccttcacaattctttttaagagtcaggtagttaatatagtttgggagggctagggagggctgaggataaatataagcctgtgtattgctattctcacgcaaataaataacaaatggaaaaaaagattctgcaaactaatacacacacacacacacacacacacacacacacacacaaagttccttggctagtttttttgtaatatatatatttcctatatgtagctaccctgtggcctccccctaaggtaaccactttactttttagtagtgaagaatgtctaaaatataataaaggtatatctagaacacaaacctccaagcaggaacaacccattatctctcctttgcatgccctgtcaatggcttcaaggtcaaagctagctaagtctctgagtgtgtagggagctgacatcttggtgaaaagtccttcagtacatgctagatcatagctgacttgcactatccttccaaactttggaatatctctctggtattggattggttacaatggaaacagaaagattctgatcatacaaaataaagattttcatttgtgagctcaaccattggatctgtcatcttccattagtagaaaaaatgaggaaatcaaatactttgttttgtttttaaccacgcagagaaggaagagagtagagtgtgggaaattgatatatctgccttactgccccagcccctccctctggagtgtgcaagtggtcagaagtcagcaaattacttttccatcatatttggccccaaactaccctggtgagtgaggagaaagggaatcatttgataaggtttggaaaatagcatctgtttttcttagtgtttctggatgaatttatcaggcatccggtaatttgtactttctgttgaaaactataatagaataccgtgcatagacatgaaaccttttggtattagtcagaagctacatactgactgctgttggagaagaccacatttacagtcaagggtagaatcatctgaaatagtttcccctggaaaaaaaaaaaacatggccatatatgcctacatagatctcctctttgcttcatgaatttggaactaaacctgggtgtttagataattccagttctaggattttctcaccttgagtttattccccttattcttactagttcagtttggccactgtacatatggagcttactagaggcaaagcactctgtgaggggcaatggttatacaaataagtaagactttcctgggaaaactaaatcctgacatcaagggtgaagcacaaatacagtcacttatggagggctgtcactcatggagggctgactattgtaagctttagatatattgatttatttaatcctcttctctatgaggcagatcatgctttttatgtctagtttacaaataaggaaggtgaagcaagtcacttgtcttatgtaatcctgctggcaaatgaagagccagaatttgagcccaggggcacttgttccagagtccacactcagaatcactgtgctacagtggaacacagcaaatgtgttgaacatgcaagcactgagtgccatagagcatggagaagagccagccggcacaccccagggctgattcagtgaagtggggtttgagatagaggggccatgagcagtctctggctgtgcttctgtattttcaaggaggtgacatcttgaaggggaatttatgggatgagaaaggggttactagttgaatgaagagatctgaggagcctaccacggagaaggcatggctgggtagagacctcgagttgagagatggtacttggggctagtggcaggggtggcgagaggtgagcggggaacatctattcctgggaccttagtaatgagactcaatcctggacaagcatccttgtgatagggatgttcaatgcggagtaactgggaggagaccttgtcgaggagcatatcatgctgtccttcaagtccaagtccttcatgccccaggcaggcaggtggatgcatgctctgacttgagaagaaacgccattcacagggctggatttttaagtattaatacaaggcaagaaggggcaaagcatgaagtcaaggctatgggcaagggtaagatctaaagagttttgtgtttgtgaccaggaatatgaattttccttatggtgatggttttagaaaaatcagtgcagtagctttgtggagtttgaatttgttcagtacacagctctaaattccacatttataataattggctatcttcttgaatgacatatggatatttgatctttgcaagtctcttaatgaacagtgacagcgatgtaacagattgttttcatcaacatctacaaaggtcctctctgccaagccattggactaaaatattcagtagaataaagtggaccacttgggagtttccttactctgatttcatctttctgtctttagagagaaatggttatgttaccagaatactcagcagaaataagagagagaggcagaggagctgtgaaatccatataataaacaaccatctgttagtaatttatcagacacatatagggcctcagcacagtgggttcatttggacatgcaacactaagaagtgttttttcctcataagtgtgtacatacggtaattgactataattaataggtcagcctaaaggtgaaaaaaaatcaaattccaaaaatataattttgacaaacatcctgttagccatcatattaattattctatctttcagtaggatctgaagtctgtctgggtaatcttcagcctatgtgccatgtgactttacctgaatgttaattacattagcatgctttagtggaaaggaaagaaggaagaaggttgagatgggagatctgggttccagaaccagttcaagttcaactcaaatgcttttctagaaataggagaaattaaactgtatgatttttaaatccttttttaatttgaaaatgcttttgaatttgaacatattaagagtataatacttcatactttctcacgcactctcccacctgttgcaggctcatgctttcagcctgaaacaggtcattttggctgaagcgagtgacaaacatccttcacccatttttaacaatttcccattgcattaagttacccaaactttttagtcaagttctgttttgagtgagcatttgatggttattcccttctcacaaatacactaaactattcgatcataacagactcagtcaaaccaaaaaaaacagatgctattccctaaataatacccatcaatttcttcattaatgtgtttttgaattgtttacaataaaacaaaagtaacaatccactgttgtaatgataagaccagggtatttcctcatattagaaacaagtcaaaatccattgtctctacttcctttgcagaatttagttgacctcatccaaattaagaaaacacttagcttgaaagtttgccctgctaattttcatagaaaattaaagtaaaatcattatcaagggccatggtttatttttcatcattgtataactctacatattttaggtataaacaaaattttgtgcatttttatttcaaaagacataaattttgttaatgtgtaaaatataaaaaagctcagaagaaatttacttgtaattttacatctgaaaaatagacacttgatgctgaggtgcttttaccctttcagacgtttttctgcatatatatatatagaaataactctcacttcactatgtggtgctttactgttttatagatggattgagacacagtggacacccatacttttattctggatggacctactgtaaaatagtgctaaatgttaaccattttttttcagatcttaggtcatatattttcttgttcctcctaaaataactctgatcgtaggaaaaatgatacatttaaggtaaaagttatcacaaattcaatctgttaaatttgtgtcacacctagagctaaataaaaatctttgtagagaaatatatttctatttttaaactataaacagcttcataagcagatattttgtaattagcagggagtggagggaagagaaccaacatttatggaacatttacagtttgccaggctttgtgatagtgaatttaaatgtactttctaaactaatttttatgtaacaaggagagttccatattatccattttacaactaaggaaataagaacagagagtttaaatagtttgaacttggtcacactgctttaaagctataaagatacaatttgaacccaagcttgtctgattccaaagtctatgattgttcttaaaaagaaaaacttaacagctttttgtttcaaactaccaaagtaatatttacttatggacaaatagaggggatgtattagtccattttcacactgctgataaagacatacctgagactgggaagaaaaagaggtttcattggacatatacttccatgtggctggggagatctcagaatcatgacagggaggtgaaaggcacttcttacatggtggtggcaagagaaaatgaagaagatgcaaaagcggaaacccctgataaaaccatcagatcttgtgagacttattcactatcacaagaacagtatcatggggaaaccgaccccatgattcaaattatttcccacctggtccctcccacaacacgtaggaattatgggagctacaattcaagatgagatttgggtggggacacagagctaaaccaggggaaaagcacattctggggcctatcagagggtggaaggtgggaggtgggagaggatcaggaaaaataaataatgggtgctaggcttaattcctgggtgatgaaataatctgcacaacaaacacccacaacccaagtttacctatataacaaacctgcacatgtacccccaaactgaaagtaaaattaaaaaaaaaactagagaataaagaaatacatgacataaaagatagagacatcaataaatccactccagattaactactgttaattgtctggcacatgtttttaaaatctgttttctgtccatattctaagatacacatgtatttttttactgctttcattcacttttccttccttccttccttccttttttttctttcttttcaaaatgtgaccatgatatacatacttgtgtttttccacttggctgtttacttccatgactccttccaaactccttttgaatagctataaattaaagtagcattatctgtcatagttaaccagttactaataaatgcatattgcggtcatttttaaacatgttttaataaacattcatatatatttatctttatgtatgtatgcaagtatttttgtaagataaattacctacattacaaattcccaagactaaaagtatgaacccattacattataaaccatactgcaacattgccttccataacatcttaccaatttatactcccatggcactgccgcaggcattgtcagtaaaccctaaccaaatgacagggatagagatcattcatcccacctcaattttactgatcaaaacactgagcctgagaggggtaggggtttgctcatccttacacctgtagaaagtactggggtcaagcccagctgaattataatattaactatgtaaagtataataatagcaagccaacacttcagagttccaggcactgttctaattttaaactcatttaattctcatatcaactctgtgagttgggtacaattactatccccagattgcagataaggaagctgaggaacacagagagagcctaaatgacgtttcccatcagcacatctcctgagaggctgagccaccattagaattaggcaatatggtcccagagtccatgctcttcacttgcatgctatatttctatgttttacttattttctataaagtaagttgtttccaagaggtattccaacaaagtcacctagtgaagttcactaaaatgtcatgagcataagagagccgtaggcaccatcaaacatagaagatcaggatcaaagattttaaaggtggcaaaagtagtgaatgttttcttgtggtcttaggcaaagtgagaaatcaatacaattagattgggatcagaaaacatatttgagcttagcttaattatgcagaaatagatgatttattttttcctccaataaagttaggtatctttttaactactagcagacatatgtgaaaatgatttgcaaagggtgacttcattgtaaatgctacagcatctggtatatgtgtatatgtgtataattattgaatgtgtatgtttgtcatgtctctattttgaggaccgatagatataagttgaggaaatagaaacaggtaagttaaagaattgttccaagttggcacattggttcaagaaaatgtagtattcaccagtatgccagtttggatttctttccaagttcatggcttggtattccagtcttattcctttttttcttattcacattagaattctgtaacactgtaaaagaattattgcaaattttatccttacaactattagagatggaaaaaactggagcagggaggaaaaagtatatatatattttacataatatatataacatatgcatattatatataatacatattcaaaacttatttaggatttatcattcaaacattttatctatcatataacaaataaccataaatgacacatcagcattgatagctaagataagggattattctacagtaaaccattcagctaatattttattcaggaaagaggttcttttggtattcattggatgaaaaaaaggttttcagaagaaagccagtagttttgaagcttaagtccttctgtggtgggatctgagaactggagaattctttgagggcatttattgttaagtactgtgtttataaaggacaggcaataaatgctgtcagatgtccataaattttatttgcaagagatgctttagtgggaattatctaatgtgcacatttgtactgatatgtcttcagtaactttcagctctgaatccacaagggagcaagctacctcggccaaatgttagttttttgttgatctttctttgctttttaaaggagccaaattattttgattttttgagtctgatttaagttgttgcttctcttatttaataaaatctaatatagaaccattttgcagattttaccatttttccacttactatactcatggatgctcagtgaccaccggaaatgtagtataataaaatattgttttatggctatgaactaggatataattaatacacaatatggtctggaaacaattctacttatataacttaaccagtatttttatatctgatatccatttttaatatgttgaaataaaacataccttggatcctcttcctcacattatttaaagttaggttttcaaatccaatacttacgatcaagtgctagacagagatcaaagaagccatccaattgtctgtgccccagtgtgaagtagatgatgcagtgattcaaggaggtgatgggtggagcttttgaggagcccctactgtgtccaccaggattggagccaagagagaaagtgaactgggcccaggctgcagtagaagctttttatccatcttctattccatccttccagtgacacaataagataagcatgattaccccagttgagataagcatcagagatcctcaacctagggtgattttgccccacagggaacacagaacaatgtctagagacattgttggttgtcacaactgctggtatccaactggcatctactgagtaaaggacaaattatctcacctgtattagtccattccacactgataataaagacatacgcaagacaaggtaactgataaaggaaagggttttaattgactcacagttccacgtggctcgggaagtctcacaatcatggcagaaggcaaaaggagcaaagtcatgtctcgcatggcggcagacaagagagtgtgtgcagaggaactcccttttataaaaacaatcagatctcattagtcttatttactataatgagaacagcacaggaaagacctgcccccattattcaattacctcccatcaggtccctcccacgacatgtagggattacgggaacaacagttcaagatgagattcgggtgaggacacagacaaaccatgtcaccactcaagatatcaatagcgccaaggctgagaaaccctgacccattttacagataaagaacctgaggatataaaaatttgaatacgttgaccaaggttcacaatttgtgaatggtagagttaacatcaaactcaggcttgactcataagtttatcctctttatcaataaaactcattccttcatgggtagttagaaacacaatcagaaaatgcagatcaacatccagttgcagacagttgtaaatattaggggactgtacatcatagagattttagatccattgaatatttatatctagaactattaaataaaaagcacatacttctaggaaatcaaagttcagctgagaagactagggaaaatatataggcatacgtggaattccagttttcaaacaatttattggtaacaaaattttattccttgtacttttctatttatgtggacacatattctcctatctgacagcctagagttacctaaatttattaagtatgagaaaattgaatcagatattttattttcaatattatttccagaactcttcatttttagtttataaatattgagaaatgccctctggctgtcctgcttgatttattttattctttgtatctcttgtcaaagaagtccagtgcatccaggctaccaataaggaattctgatccaagccttgcacatcgtattgaaaagtcctagttgcacagataatatttaattctttaggaagttgggcttattttagtttcggataagcttatgcaaattcaggtcccttggagccagtccttgaaaagcacttattccagtctttgttgtcttctcacattcatcctcatcagtgtattaatttcccttaacctggctttttagttcctcattttcgtagttgtcaacaaatccaaggcttctttaaccaattagatacttaggggtgatatggttcttattattggacttgtcttggaaaattactagactatgggccgaaataatcatagagtattagagttgacaggagatttagaaactaattgtctagaccagatgtctaattatatacttagagaagctaaggtccaaagaggttaagtatctttgccaaggtcaaacagctggttagcagttatggtggaaccgcagttcttatctgctgattctcatttctaggctgtctgcaccacactttttgctaccctagaatgtgcttcaagataatatttgctacatggcattccacagtggtacatctgtacccagtgtgtattctttaacactgcatgttttgtggcttaattggccttaccaagataataggtggtttcttaggcccaggtgtgaccatggcagtactgatacctaaaacttgaaacaggagtgccattgtcatcacactttcttataattcagacacaggcacaagctcccaaggatggctgcctcacagaccacatatgcaaggatattaccagaatgactgacatttacattgtccctgtatctgaagtctttgaaaagagcaacaacaaccactcaaactagaaggcagaaagcaaatgcttgagatcttctgtcaagccaaagccctctcttgctcagccacctatgtggttgaaggcaaaaggcatctttgctatggcacagagtgatggggcataaggtagtgacagttgcacggacacccaacaaaggacatctatactgactcagtgggaaactacactgtacttggtgattctcagagccactgagcatagaggactgcatggagcagaccttattacccatacttcccaacctctggttttaaggccaagcaaagatagaaacacaggcttctctagaatatagcagcagggatatgaacagaagagagagagctggtagcatagtcctattaacataaccagccctgctggtgtcctgaagtcgtggggtgttgaccacagaaaatcagcagccctcttcaggtcacctggtgcaatgtggcacattgttgggctccttctgaaaaacgtggcacatgctcaccctgttatatccgccatattccaactccatttgtctaaggacctaggttgcagtaatcttctacaaatacatattttaatatatgatcagccagacttcatttaattgtttattaaacatttatttatggagtatctactataggccaggcataattagtggtataaggtgacatggaaaattaaacttatggaaagagttttaacactgactgtctttgagaatggaaagaaaagaatggagaaatgaccttaatgtggtttgactgtgtccccacccaaatctcatcttgaattgtagctcccataattctctcatgttgtgggagggatcctgtggaagataactgaatcatgggggcggtttcccccatactgttctcgtggtagtgaataagtctcacaagatctgatggttttataaggggaaatgcctttcacttggctctcattcttctcttgtctgccaccatgtgaaacgtgcctttcaccttccaccatgattgtgaggcctccacagccacatggaactgtgaatccattaaacccctttcatttgtaaattgccctgtctcggctatgtccttatcaacagcataaaaacagactaatacagacctttattgaacatctacaaaaaccgggcattttatgtatattattgtactgaatcctcacaagactcttattaggcagtcatttttattctcaattaacaaattaaggaaacaactcaaagatctgtagagtacctgaggttcacagctagcgagcagggagctggtggtgctctttcccatgctccagtggcttcaatgaagatgctctttcctgtatttcagtggcttcatgggctgagttgggtcccctgccatgcagaacaggaacatgccactgaagcagctggatgatgtggcagtgggaaggtgggcaaagctgatttggggcagaagcagggagtgctgatgtgcagcagaaaggaacctcaactccctgagagtccagctggggtggagcctcgtccttactgacgtggaggaaagggattctgtcccatactccctatcctatgccacatccaaaacctgaggccagtagggctgctcattcccatctaagaaagcccctggggaactcaaacattttactacatgtgcacatctgtgtgtattgagagcatgttcttatgtatgggtgtgtgtacactgcacaggggtatctcggttgactgcaatccccacacatgatgtatagcaaagtgtttaaacagtgacctcttgtactaaaatttcccaaagggcactgtgaggtagcagacgtccactctaaattagatttcattttatttgctctctagtgcaggtagcaataagtagcaaaaacccaaggatggaaagcgagaaatagaagcttaagagaagaactgaggaaatccctaaaattaaagattttcagtgttaaccttttccacttggaacatgtgctttctggtcatcattttctttttaagggcccatttttatttaagaagaaaaagtcttttttcatgtgcttttgccagagaatatagagttatattcacataaatcaaggcaggaatttgacaggtaccagtctgatgtgatccacgtgggctagggtcataaaatatctacatgggagccatggagaatggtcgatgtgacctcacattggtgacaaaattccttttactgtctggcaccatttctgtgttcctcttgctgtctcttatggtttggatatggttcatttgtcaccaccaaatctcatgttgaaatttcatcagtgtgtcagtcctgggaggtggggcctagtgggaggtatttgggtcatggagacagagccctcatgaatagaataatgctctcttttggtgatgagtgagttctcaccctgttagttcaccaagagagctggttgttaaaaagaacctggtacctcctcactctctcatgcttcctctctttgtatgctctctgcccatgcagggtcctcctcgccttccaccatgagtggaagcagctgttggccctcactagatgcctaatcttgaacttggtagccattagaattgtaaatcaattctagagttgtaggtggttccctatcactgatagtctattgactagagttacggatgggtattgaggactgtgatgtgctaagaatggatgaaaataagattatctgtcaggtctctcagagaagagtaaccaaacttggcagaaatcacttaacatgagtgtctaggtattcctttatagcaacccaaatggactaagacaccatttctagaagccctgtcattgatattctagagttgtaggtggttccctatcactgcctaatcttgaacttggtggtcattagaattgtaaatcaaacaaacttttttttcattctgaattacccagtctaggtattcctttatagcaacccaaatggactaagacaccatttctagaagccctgtcactgatattctagagttgtaggtggttctctatcagtgcctaatcttgtacttggtggtcattagaattgtaaatcaaactttttttttccattctgaattactcagcctaggtattcctttatagcaatccaaatggactaagacaccatttccagaagccctgtcattgatattctagagttgtaggtggttccctatcactgatggtctattgactagagttacggatgggtattgaggactgcgaggtgctaagaatggatgaaaataagattatctgttaggtctctcagagaagagtaaccaaacttggcagaaatcgcttaacacaagtgtcacagaacaagtagaataaagttactgggaggaaccagaaaagtagtgcagatttgttaatgctgaaatgtagccaagacacatggtttacgttgcagtagaataagtcagcaggttcagtagattctaatttctattgaaatccatcttaagaaaatattaaagaaatattattatatctaaggccttttccattgcagggaaaagaatgcaagctcaaactagcctcaacttaagatggagtctattggctgctgcagataaaaaggtctggtattgtcttcctttaggctggctaaattcagacattctgtgaatgatctcaggaactgattctccctccaagacttggctctgatttctggcagtgctgctttcatttgctgaaggattctctttacatgatgggaaggattaccattttaaacttaagtggtcattataactcaaaatttcataaggagagaaaccatctctggctccaaacatccattccagcccccaaaaggtctctgatgggtaagtaagcatcatttgtccagcttctgtgggagaggagtaacgccctgactgacagctccatctaaatgctacgagctgaaggaagggctgttcccaaaggaaaggttgcaaggaggttgaatgagtaccatagctatccataatgagactgattagatcctggtcccacagggagaaaacagcttaaaagcaaattggagcttacctgaatgttcgaagagggctttaaagagagaaagatttgaattgagattatatatgtcaggaggatctagaagcaaagatacttctataacttagacttaattcctgcactgcataatgctgcctctccatcacacttcacagacccacggatgaagctaagaattgatgacaagcctctcactcttagcaccctctctcctaatccctttacatcttcactcagcattttgcttactccgttcttggtctctgggtctctctctctctccccacccccacttctatttctgtctcccttttttccccttcttcttccctcctcccttctctctccttaaaatgccttcttgaaaacaatatacaatagaaccatgtggtgaggacagttcctttcaactcacttttacttagagctattttcatcataattgttgtgagatgaaatgctggcctttctttacatgttgaaaaaattaaaagtgcttcaaaggtcagagaaaacaatcccctaaataacagcttcagggaaaatgcccacataaagtaactgctccctccctgacaccagaacatgtaattctctagttttcgttaagagtagatctcctacccattcttattatctttaaagatgacaacaatgggaccccttagaccagaaggcccaccatagccaaataattcttacagaaataaaattgtttgtattttttctcctaggataaaatctatatgacagttttgttactggaaaaaaaagtctccttttccctagaaattgtgcgaatgaaacagaggtagattttgttttcaattatggctgcagttctacatgttatttgtcacatgtagacacaggaatgagccttgcaactgtggaattattagctgagtgaaaaatgttactggaccaagatgttttcctaaccattgctagaattagttaagtcactgacatcaatgtctaatatataatgtgcattatcagagaaaaccaccaaaacattcacaggttgtgaatacagtaatataacacatatgtgcagatagctagccactcatgatcagaagttttcaaatgatacttctgagaaattgttcctgtattttttcctttaactttatctgtagctaatgcccattactttttttttatttcttctaaaaaaaaatgggatacatgtgcagaatgtgcaggtttgttacataggcatatgtgtgccatggtggtttgccgcacctattgacccatcctttaatttccctcccctcaccccccaccccccaacaagacctggcgtgtgttgttccccctctgtgtccatgtgttctcattgttcaactcccacttataagtgagaatatgcggtatttggttttctgttactgtgttagtttactgaggatgatggcttccagcttcatccatatccctgcaaaagacacaatttcattcctttttatggctgtatagtcttccatggtgtatatgtaccacatttttttaacccagtctattaatgcccatcacttatatggaatggggtagaatgaaccaacttttgtccctgtctaacttgagagttaagttagaaacttaagaaagatacattatggtaggaaataaatttggaggtgaggcatagagcagcgctttttttccactctacatataaatcctgatattcaaatctctttaattagaagaccttgtaaattcaaatccatatcctttaggataaagtttcagtactcactatgcactaaagtcccctgttctctcagacttggaatcactcacagtcttcccttccctaaagcaggtggctttcagttcttagcatacagttctttaaactgggcatgctgttcatcaacttagtgattttgctccaggcttcctctctctagaagactacctatcatctccaccttctcctgactatccttaagacttaactcaaacacacgtcctacagaaagcctgtcttgacagtccttcagtctaaggaagttggtgtcagtcccataaataacatctatcacatagacctgtcacagcagtgactggtttacttgtgtttcaactccaacagaacatccttgtatcttcagtaattctgatattgttttcccaaaatgcccctctgggaagtacaataatggcccccaaagtgtctgtatgccaatctctggaatctgtgaatgagttctattaaatggcaaaaaggattttgcagattgaattaaggttactgaacttaatagagggagattaatcttgattacttaagtgggctcagtctgatcacctgggtgcttaaagtggaagagacaggcagaagaaacacaaccacaacaaagaggcaggaaagattcaaagtgttagagggactctacccactgttgctggctttaaaaatggaggaaaagggctgggtgcagtggctcatgcctgtaatcccagcactgtgggagggtgaggcaggcggatcacaaggtcaagagatcaagaccatcctggccaacatggtgaaaccccgtctctggtaaaaatacaaaaattagccgggtgtggtggtgtgcacctgtagtctcagctacttaggaggctgaggcaggagaatcacttgaacccgggaggcggaggttgcggtgagctgagattgcgccactgtactccagcgtggcgacagagcaagactccgtctcaaaaaaaaaaaaaaaaaaaaaatggaggaaagggaccatgggccaaggaatgtgggtgtcctctagaatcagggagcagcccctggctggcaagccagcaaggcaacaggaacctacaacctgcaaagccaagtcctacagtggaattctgtcaacagtctgaatgagaagataaatgagtttgcctctagaacctccagaaaagaatgcagctctcctgatgccttgatcttagcctggtgagatccatgccagaattctgacccacaaaactgtaaaattataaatttgcatgtgttaagccactaagtccatgataattcattacagcagcaaaaggaaactaagataccttctccggcatggacttggactcaacagaactgtgtttagtacccagcatcaatgctactgcagtgtgatttggggaactaaatctgagtggccacattctgtacatggatagaatccagaacctgtcgcttaggcttctgtgtggacagcatgtgaaggtataggtaaagcactcagaagatggttggcacatatgaattttcacctccacctcattacaaatccatgcccctcagcctggaaggatctccccgcagatgtctacatgacacaatctcacctctgtcaagtttccattcaatggaacctcctccttaaagtccttccttggtcatgctacttaagatttcaactcatccctcacccccaacctcatcacattctagttctcttccctacttcatttttttccccgtagtacttaccactagagtaattgtatataagagttaactatcgctgtgtaacaaatcaccccaaaactaagggacttcaaacaatacgtacttactctctcactgtctttgtgggccaggaatccaggcacaggttagctagggggctttggttgtctcaaagctcattatgagtcattgaacgaagagctccattcctcaccagctgctggttgggggtgaactcagttccatgccacataagcttctcattaaaatggacaagcctagaaggcaagagagagtgctagtaagacgggagtcacagactttgtagcctaatcttggaagtgatatcccatcactttgcctatattttctttgttagaaggaagtcactaggtctagcccatagttagaggtgattacacaagggtgtgaataccaggaagcaggcatttgggggagccttgtcagaagctgcctaccacatcatgctccccaggctaaatgggacagtccccgttaacaaacactgctttaatgttgttatcagccgtacttccggccgacacatgtggccctggtgtaattatcaggggcacttctttcacgcaagaattgtccagactgagacaataaattacgtcatcttccctcttaatgctttccaatataatatagaatttactaatttgttttggtatcttatccaaatccttctctaaatagcagatccctaagcaggatttagggatccctaaatagagatttttatatgttttgttcgccgctgtatccccagtgcccagattagtagtcaatcttcaaaacatattttgagcatatattttgtcatgaagtgtttaaaactacgccactgagtaaaattggtgttttgggaatacatattgttgctatgtaatctcacggttttcatcaatactgttttggggaatcatcaaaataataattaagctggccatggtggctcacacctgtaatcccaatactttgggaggctgagatgtgcagatcacttgagtccaggagttccagaccagcctgggcaacatgatgaaatcctgtctttacaaaaaatacaaaaattagctggatgtggtggcacactcctgtagtatcagctacgcaggaggctgaggtggaaggatcacttaaacccaggagcttaaggatatagtgatccgcgattgcaccactgtactccaggatgggtgacagagtgagaccctctgtcaataataacaataataagttagttgctattgtcaaggtatggtgaggggggaaaagaagggacctaccaacctaaatgatccatgggggtgggatggggatgatgttttggagttggtgagccagggttgagtttaaaatcataagcaggcattcaggggttgcatggagatgggggtgtggcaatgtatgaagagcagaggttggtgaggtggcacagacaaaatcaagaggcttaaagaccatgctgtggagtgtggacttatcccaaagactccaaggcactgctggagcatttgaagagggagaatggagaaacaaatgcacggatcagaaaagtccctcctgtggcagtagagaggatgaggttagatacacctggaaggaaggaaaagattaagggttttttggagtgtcagttagggtagagggaaatttagtaagaaaaagatggtggggggattactcaaacatgttcatgctggttttgctgggtatattgactataaattagtttttctatcacatttttattatgtagttatatcacttgtaaattaaagaagttatattaaagtgttcccactaagtttggactgggtggagcccaccacagtgccacagagccactatagccagaatgcctctctagattcctcctctctgagcagggcatctctgaaagaaaggcagcagccccactcaggggcttatagataaaactcccatctcactcaggcaagcacccaggggaaggggcggctgtgggcacagcttcagcagacttacacgttccttcctgccagctctgaagagagcagcagatctcccagcacagcgttcaagctctgctaagggacagactgcctcctcaagtgggtccctgacccacgtgcctcctgatggggagacatctcccagcaggagctgacaaacacctcatacaggagagctcttgctggcatctggcaggtgtccctctgggatgaagcttccacaggaaggagcaggcagcaatatctgctgttctgcagcctctgctggtgacacccaggcaaacagggtctggagtggacccccagcaaactccagcagacctgcagactgttagaaggaaaactaacaaacaaaaagcaatagcatcaacatcaacaaaaaggatgacaatgcaaaagctccatccaaaggtcaccaacaccaaagaccaaaggtagataaatccacgaagatgaggaaaaaccagcacaaaaaggctgaaaattccaaaaactagaatgcctcttctcctccaaaagatcacaactccttgccagcaagggaacaaaagtggatggagaatgagtttgacgaattgacagaagtaggcttcagaaggtgggtaataacaaactcctctgagctaaaggagcatgttctaacccaatgcaaggaagctaagaaccttgataaaaggtgagaggaattgctaactagaataactagtttacagaagaacttaaatgacctgatggagctgaaaaacacagcacgagaacttcgtggagcatacacaagtatcaatagctgaattgatcaagtggaagaaaggatatcagagattgaagatcattaaagcatgaagacaagattagagaaaaaagaatgaaaaggaaggaaaaagcctccaggaaatatgggactatgtgaaaaaaccaacgtttgattgatgtacctgaaagtgatggggagaatggaaccaagttggaaaacacacttcaggatattattcaggagaacttatccaccatagcaagataggcaaacattcaaatttatgaaatacagagaacaccacaaagataatcctcaagaatagcaactccaagacacacaatcatcagattccccaaagttgaaatgaaggaaaaaatgttaagggcagccagagagaaaggtcgggttacccacaaagggaagtccagcagactaagagcggatctctctgcagaaaccctacaagccacaagacagtgggggacaatattcaacattcttaaaagaattttcaacccagaatttcatatccagccaaacagcttcataagcaaaggagaaataaaatcctttccagacaaggaaatactgagggattttgtcaccaccagacctgccttacaagagcaggaagcactaaatacagaaaggaaaaactggtaccagccattgcaaaaacataccaacttgtaaagaccatcaacactatgaagaagctgcatcaactagccagctagcatcataatgacaggatcaagttcacacataacaataacaataacaataacaatattaaccttaaatgtaaatggactaaattccccaattaaaaggcacagactggcaaattggatagagagtctaggcccatcgctgtgctgtattcaggagacccatctcatgtgcaaagacacacataggctcaaaataagcagatggaggaagatttaccaagcaaatgtaaagcaagaaaaaaaacaggggttgcaatcctagtctctgataaaacagactttaaaccaacaaagatcaaaaaagacagaaggacattacataatggtaaagggatcactgcaacaagaagggttaactatcctaaatatatttgcacccaatacaggagcacccagattcataaagcaagttcatagagactacatagagatgtagattcccacacaataatagtgagcgaccttaacaccccactatcaatattagacatatcaacaagacagaaaattaagaaggatattcaggacttgaactcagctctggaccaagtggacctaatagacatctagagaactctccaccccaaatcaacagaatatacattcttctcagcaccacatagcacttattctaaaatcaaccacataattggaagtaaaacactcctcggcaaatgcaaaagaatggaaatcataagaaagagtctgtcagtccacagtgcaatcaaattagaactcaggattaagaaactcactcaaaactgcacaactacatggaaactgaacaacctgctcctgaatgacttaaggcaaaaatgaataagttgtttgaaaccaatgagaacaaagacacaatgtaccagaatctgtgggacacagctaaagcagtgtttagagggaaatttatagcactaaatgcccccaggagaaagcgggaaagatctaaaattgacaccctaacatcacaattaaaagaactagagaagcaagagcaaacaaattcaaaagccagcagaagacaagaaataacaaagattagagcagaactgagggagatagagacacaaaaaaacccttcaaaaaaatcaatgaatccaggaggtggttttttgaaaagaatagcaaaatagatagaccactagccagactaataaagaagaaaatagagaagaatcaaatatacacaataaaagaatgataaaggggagatcatcactgatcccgcagaaatacaaagtactctcagagaataccataaacacctctacacaaatatactagaaaatctagaagaagtgcataaattcctggacacatacgccctcccaagactaaaccaggaagaagtcaaatccctgactagaccaataacaagttctgaaattgaggcagcaattaatagcctaccaaccaaaagaggcccaggaccaggtgtattcacagctgaattctaccagaggtacaaagaggagctggtaccattccttctgaaactattccaaacgatagaaaaagagggaatcctccctaactcattttttatgaggccaaaatcatcctaataacaaaacctggcagagacacacacaaaaaaagaaaatttcaggccaatatccctgatgaagatcaatgcgaaaatacccaataaaatactggcaaaccaaatccagtagcacattaaaaagcttatccaccacaatcaagtcagcttcatccctgggatgcaaagctggttcaacatatgcaaatcaataaacgtaatccatcacataaacagaaccaacgacaaaaaccacatgattatctcaaaagatgcagaaaaagcctttgacaaaattcaacagcccttcatgctaaaaacacacaataaactaggtattgatgaaacatgtctcaaaataataagagctgtatatggcagacccacagccaatatactgaatggacaaaagctggaagcattccctttgaaaaccagcacaggacaaggatgccctctctcaccactcctattcaacatagtattggaagttctggtcagggcagtcaggcaagagaaagaaataaagcatattcaaataggaagagatgaagtcaatttatctctgtttgcagatgacatgattttatatttagagaaccccatcatctcagcccagaaactccttaagctgataagcaacttcagctaagtctcaggatacaaaatcaatgtgcaaaaatcacaaccattcctatacaccaataatagacaaacagccaaatcatgagcaaactcccattcacaattgctacaaagagaataaaatacctaggaatacaacttacaagggatgtgaaggacctcttcaaggagaactacaaaccactgctcaaggaaatcagagaggacacaaacaaatggaagaacattccatgctcatggataggaaaaataaatattgtgaaaatggccatactgcccaaagtaatttatagattcaatgctatccccatcaagctaccattgactttcttcacagaattagaaaaacctactttaaatttcatatggaatgaaaaaagagcccatatagccaagaaaatcctaagcaaaaagaacaaagctggaggcatcacgctacctgacttcaaactatactacaaggctaaaataaccaaaacagcatagtactggtaccaaaacagatatatagaccaatggaacagaacagaggcctcagaaataacgtcacacatctacacacatctgatctttgacaaacctgataaaacaagcagtggggaaaggattccctatttaataaatggtgctaggaaaattggctagccataggcagaaagttgacactggaccccttccttacatcttacgcaaaaattaactccagatagattaaagatgtaaacataagatctaaaaccataaaaaccctagaagaaaacctaggcaataccattgcatgtgcaaagacttcatgactaaaacaccaaaagcaatggcaacaaaagccaaaattgacaaataggatctaattaaactaaatagcttctgcacaggaaaagaaactatcatcagagtgaacaggcaacctacagaatgggagaaaatttttgcaatccatccatctgacaaagagctaatacccagaatctacaaggaacttaagcaaatttacaagaaaaaaacaaaaaaccccatcaaaaattgggcagagtatatgaacagacacttttcaaaagaagacatttatacggccagcaaacatgaaaaaaagctcatcgtcgctggccattagagaaatgcaaatcaaaaccacaatgaaataccatctcacaccagttaaaatggtgatcattaaaaagtcaggaaacaacagatcctggagaggatgtggagaaataagaaagcttttacactgacggtgggagtgtaaattagttcaaccattgtggaagacagtgtggcaatttcttaaggatctagaactagaaataccatttgacccagcaatcccattactgggtatatacccaaaggattataaatcattctactataaagacacatgcacacgtatgtttattaaagcactattcacaatatcaaagacttggaaccaacccagatgcccatcagtgatagactggataaagaaaatgtggcaaatatacaccatggaataatatgcagccataaaacagaatgagttcatgtcctttgcagggacatggatgaagctggaaaccatcattctcagcaaactaacagaacagaaaacccaataccgcatgttctcactcataagtgggagttgaacaatgagaacacatggatacagggaagggaacatcgcacatgggtgcctgtcagagggtggggggttaggggagggatagcattaggagaaatacctaatgtagatgacgggttgatgggtgcagcaaaccaccatggcacatgtatatctatgtaagaaacctgaacgttctacacatgtgtcccagaacttaaagtataataattaaaaaaaaaaggtgttcccattattttaaactagatacttattatgttgcatttaaagttagtttgaaaatatgacattttagttgattaatttatagctaatgtgttgattttgcactcagtaagggcattgcttttaagctccatgttcaaaggtttctcttcatttgagtattagaaacgtgaaacttagaaactctaccagttactgcacatggacatcaaaataagaaactgactttacttcttatagtaagaaactattaacctgtatctattttttaacctttctgtgttatagttaggtatatttgtcatctaagttccacttatgggagctcttatttcaatttctttaaaataagcaattagaaaactaaagtcaggtaatgccttttagaaagtattttcactacatgatgcctgatagtttgcagaatgaaacaaatttatcagtgtgaggcactgagccctactagtgggagatggttactaagtattttgtgaattgatgaatgaagaactgaaaaggcattctaaacctgggttcattcctctaaagttttgtatgtcaaagagcagagattttaaatatttaacatcactgtgaatttgctttttctagatatcagcgtttattccaaattcagaaaggtcagctggcttgtatctgatcacatagctagttactaccaaagacaaatcaaacccccagcacacagcatcccatttttcctgaaaagctgtcgctggcttcacaacatatctgcaactcttgacatttgcagcagttttctcttcagtaacatgtaaaaattgtttcaagtctccagaagtcctcctacttattccatgattatatttgggttatgaaaatgaatgagcctatttgagaatttgaatggaaagctcttgctcagtcactttgcatagtttctattgactttataatgcaatattcaaagaaaagttagactaatgtgaaatggcaacagaaataataatttccttcttgttgcctgttaattttcatgagggattcatttaatcgtatttcaattccatagagactgaagagatgcagttgggatgatacaaacagcctatctttgtcattctaattttttgctgtgtagatctatgcacttggcaaggtaaataacaatgaataataaaataatgtaaaatgattatgtggagccatctctctgtaggtagcaaaagacagattctgtaatagaggaaattaataaagcaaagagaaaattagtaatattaatttttagtctactgttatttctgcattgccaagcctatctgtggtactgagtttctctttttaaaataactcataatgctttctaaatttttgcgggtctgatcacctgtttgctaaagaaattactatatttttaatattcccgctaaagagaaacatagcacttataaccagttaccctctgaaaaaattctgatcttccacacttgttcgtgttcatctctcatgcccatccttactctgtgtctcttcatacagtttctcgcatgaccttctagccttaccagactttcaggcctagtcctaaaggggcgaggtgctgggtttcagccctctgggagtgtagcttagctacaaatgcagaccaaaacccagaccaatgagctccccaaagtgctgcactatgaggacaacgtgagtgtgaaaaggctatgtaaatccttcagttgttctggcaggcacttcacagagcacgccaccctcaaggtcagccacatctttttgaacaaagaacactgcagaagttgcggggagtcagggattatagaggactgaagttacttctacagtagctataatggaagctgtttagggagatgtcaatatttctgtcaataaactcctgatacttatacatactgaaacacacaataaactcaaagtgatgccctacaaataatgcctttctgagctgttaaccaaatacccactgatggcttctttccccccaagtctctctccatgttctccagcaactctgcatgaagatggaccagtgtgggctctcgatttaatcttcatagcccaggagaaagagcctggaacttatcttcaaactatttataattaattctcaaattatgatctagtttctggatctccaactccttgaggagttctctaatgtttggacacatgtatttcctacagaaaatctggaaccctttctaatggtgaccctttttattaaaccacactgcctttcatccatactaaagcacagctcatacagtcaattaaagaatgtgatggaagctagagaaaatggagacgcagccaggctgagttttctgtccatacactacattttggaggagattaaatgcacttagggtcttcatatattctttcctagcctccttctcacttttcaagctgcccttggctgacctgaactctggctacatctcccctaagaagggaaagcagaacccagagtctccaccagaaaccagaaagcaatggttctgtcattttgcattagtatcagaaagctggggagctttttaaaaatcttgatgtttaggtccatctagatcagttgcatcagttgctctaggaatgggaccagacttggatagttttctgggtaacaatttcacttgttttctttctcaagaattatttctgtcttgatgatgaaagctagtgcattaattttcacttctagaagttcatctttttttatccttttacctccttgcagaagtcatgcaaaatatgctagtatgctagccgattaaactggaagcccagcatttataacggccagaagaaatccttaaagacagtaacctgattctcagttgtgaagggaaaagaaatcttcaggtttaatctccttctttctaattctaaagcatccctaccagacgccaggatagcctctgcttgccctccaccaggaatgaagaacacgtgtccctaggggagtctgcaccatacttagcctctctggaggttaaagaggcctttagccaccaagcaaaacattacctttgctgcccattaaatggcaggaggctttcacatgagcagtttcctatgagagaaatcagctttagggaacaaaatctttgcttagtatcacagaagagtgaattcttggtataaattcccccaggctaaaaaaggaaactctgggaagatcagttcctttcatccttgtgacagatggcttgcctacaagcccatgacacttaaacctgtcataaggtagtatcaaattcatccatcttcagctcgatttcagatctaaactgaagggtattgttagcatgtactgtgaacaagaccaaaaaggagtagagctagagtgagtacatgagatgataatacagagatcaataccaaagcattctaaacatctataggatccccagctgtgatgagatgccaaatgccaggatcacctatcttcatggttttcttttctaaatccatatgaattaatcctggttctgagttttcaagcaatacaaatctatcgactaatttaagcagaaaaaaaaaacttgttaaaagagtgttgggtcaatcactatccctccagaagaatctgaaaaccagagagactccaccttgaggacagcagaccacaaccatgtcaggatgctggtctggtgaaggaccattcacagctgccttccatgatgcttctaaaatcacggctactattacctctggaagtagagggtgctgctggtgctgcctctaccatttactggacttgctcctgtgttcttcctgcttcttctcatgtttagcttgcattctaagtatgagtgtgtctgatgggtccaggtccaccgccctgagctggccatagctataagaacagtgagattgcaagcaccagacgtttttagcactagccctcagagctgagctccacctcaggaggaggggagtccccaacacaggagaagctgcacgtgcaccacagtccagcagaaacacagctgctttttttcttccagtgctactctgtgaacaggtgcccacctgggaactatgcaacccagtgacaaagacagaagtacagaaattgagaggaagcatttagaaactcttcttacagctgtttaagcttaggttttgtatatctttgtttcattttatttcatttttctactaattcgttttgattataatttgcaaaactatcaggctacaatggattgcaaacaaaaaacctggccttttaatgcagagagtttgagaagcactctacttagtatatataatatatatactatattatatatatatatatataaagtaatatatacttagtaaaataaattcaattcctgtaagccaaggaaagttgtaatttttattcaatagcaaaaaactaatatattgaacacttactgtagtaagtgtagtatgctctgtagtatgctcatttaagcctagctctgtagtatgatcatttaagctttattattctatgattctagtactgttttttattttggttttagagataagaaaactgagacacagaaagattaatggactttcccaagctatctgattccagaaatttcactctttttaaatttttaaaatattttacttattttattttgttttttgggaacaggtggtgatgggttacatgaataagttctttagtggtgatttctgagattttggtgcacccatcacccaagcagtacccaatgtgtagtcttttatccctcaccaccccctacctttccctcaagtctccaaagttcattgtatcattcttatgcctttgcatcctcatagcttagctcccacatatgagtgagaatacaccatgtttggctttccattcctgagttacttcacttagaataataggctccagtaccatccacgttgctgcagagtgccattattttgtttcttttatggctgaatagtattttgtggtatatttataccacattttctttgtcctttccttgattgatgggcatttgggctggttccatatttttgcaattgcagattatgctgctataaatatgcatgtgcaagtatctttttcatatcatgacttcttttccactgagtagatacctagtagtgggattgctggatcaaatggtagatctacttttagttctttaaggaatctccacactttttttccatagtggttatattagtttacattcccaccaatagtatgaaagtgttcccttttctcttacccaccaaaacatactttccctaccttgtatgacattcccaacctaagagcagccaagagctaacacagttaatagtattcagttcttaaaagttgattatctttaaagggcaaacatattcatttgtaagactcacttgctgtactagtctcttctcacattgctataaagaaatacctgagattgggtaatttataaagaaaagaggtctaattggctcatggttcttcaggctatataggaagcataatgctggcatctgctcaccttctggggaggcctcaggaaacttacaatcatgatggaaggcaaagaggggacaggcacttcacatggctggagcaagaggaggagtgttgggagaggtgctgcaaacttttaaaggaccaggtcaaatgagaattcattcactatcgtgacgacagcaccaaggggaatggtgctaaaccattcatgagaaatctgcccccatgatccaatcacctccaaccaggccccacctccaacaatggggattacattttaatatgagatttgggcaggaacacagatttaaactcttatcactagctttacttctgagtaggcttctgtgacttctgactagtcacaccggatatactgaatgtaagatcctagaagaagctgtcaggaagtggtggcgccaggtcatctggagctgctgggctcagtgactagccagagatgagtgtcccagcacctgacatgtcaggctttcttgtgggacctagtccaggttggtgttggggttgtagagctttctctgggtagctgacctgtccaaagtgtggtaccatgagaagaggaatgtctgttcacaatgactaggaatcaatccaccttccccattcttcttacacagccaggatttctataaaactaacatttcagacctgacagaagtcactagtcagaaacagaaatacatctgtgctctgaggaagggagtatcaacaataagtcttatgaagccaaatggcctttaatgcaagaaaccacaatctcttctcaatctcctttggaagaaaaccataccatatgggcacagttcattctccttgaacagaaccctaagattaaactgaggtctaatgattgagtttgcagagcagcaatcatatgagtgtgggatcacccgatgagatagttcttttaaggcctaatacagctcgaatgtcagagctcttcatgttgaaaataatataagagtattttttcattgcagggattataaattaaatgtattttctgatatatcactttaatcattttagaaaaaaaaatcaataaaatgggacccagcttgctctgtcttagcctcagacacattatcaataattatctcatctttcaaaatggcagccaactcccaactgttaaaaattcttcattataattaaaatcatccttttcaaatttatcatcatatattattgtgtacccttcaagcatttaagttaaggtagaaaatataaggattatgtttaacctacatgttcagggttggcataattgctatcttggtatagatgctgcctaaaagccttgtgatggggcagggaattcagaagaatgtacatttatctttgacagagaagttttaaggtttgatttgtttttctttaatttttgttttttctggaagataaaatactaccattttgccccattcttattgaaaaatagactatgagatactcggtggtttctaaacccatgtatagaaaaactgtgattcaccaaactagatttcccacatgttggtttctcatcacaagttttatgcataacaattttttcgtgttgtaagaatgggttttataacaccaaattgggcaccacgaattcacttaccattcttcaggtggtgaaatatgcgtcatttttgttggaaatattggggcagaaagtccaaaatgtgatcataggtacattcccttaagtcccagatcactgctggtcaaattgccagttttattgatcactcagccttgttgaacatctggagacaattttttcagtgggtggtagtggacaagaatatgtggctgagtcattcaaactaattaaattctaaaacccacctatttttaccagaccattccaagtagagataatctgtaaataccaaactatttcctaaagtgtctagtataatttcaaacatggataactgcctaataaatacttatgggattaattttgtataaggaaagttttaatctttcctccaaataactgcatttgtcttctccattattttgttgctgaagtgatcaaacaaaaccagactgagagggtacagaagtcaacttaggctgctgtaacaaaatcccacacacttaatagaaatttacctcacagttctggaggctgcaagtccaagatcaaagtaccagcaaggtagatttcatcttgaggccacttctcttggcttctaggcagccaccatctccctgcctgctcacatggccactgggagagaaggagagaaagagtgagctcccctgtttcctcttcttaggaggacactaatactatgggatcagggaatcttctttctttctttctttctttcttctttttttttgagatggagtctcgctctgtctcccaggctggagtgcagtggtgcgatctcggctcaatgccagctccacctcccgggttcacaccattctcctgcctcagcctcccgagtagctgggactacaggtacctgctaccacgcccggctaattttttgtatttttagtagagatggggtttcaccgtgttagccaagatgggatcagggaatcttatggccaaatttaacgagaattacttccttagaggcctcatctttaaatatagccacactgggaattacagcctcaacatatgaattttgaagagatacaaacattcagttcataatagagggaaaaacgcaattcatttacaagtgaattcaatagagatagttgaaaatatcaaattcaagatattagtggagaaaacacagctttctaagcaagaaatccagttggtataaagtctttatttcactgggaaaatttttaccatttgaatcacagtaatcctaacacattcttttagaaagggcaaagcggtgggataagaagtaaaacatttcccctccaaaataaatgtggaaggaaatataataagctgtgtatatgtgtgtttaccctttttaaaaacccaaagtcttccaatcaatgatggagaatgtttctagtttgatgtattggctatctactgctagataacaaattaccccaaacttgggtgacttacaacaacagcactattatctcatggtttttgagggccaggaattggcactgcttggcgccagctgcatcacaaggcagcagtcaaggtgttgtctgggactgcagtcatctcaaggctggaccagggaaagatccacctgacctcactcacgcagttggtggcaggatgcagttctttgcaagttgatgggtttagggctttagtttctcaagagctgttgctcagaggccttccctggtttttcaccatgtatgcctctccacagggcaggttccagcacggcatcttgcttcatcagagtgagcaagtgagagggcgagagagaggatgaaaccaagaaggaagtagtcatctttcataatctaaccttggaagtgacatcttaccactttttccaaatttcatttattagagacacaccactgcatccaatccacacactccaggggatgtgattacacaagtatataaattccagaagatgagattccactggcacccacgtcagggagcacctaccacaaacagcaactggcttcctctttaatcaggacaaaatgaaatgtggaagaccaaagaaatgttgaaactccaaggacattttcctgtaaaatgttcaaaacatacagataattctctaatgcctggttctgtatctgtggccatatgtataagtcgcactgggcaagttaaatatccatattattgttagtcacatttttttttatttttttgagacaggtctcactcttccatccaggcaggcagtggtgtgatcacggctcaccacagcctcaatttcccaggtttaaggaatcctcctacctcagcctcctgagtagctgggaatacaggtgtgtaccacctaaccagggattttttaatttattttatttttttttttgtagagacgaggtttcaccgtgtagcccaggctggtcttgaacgcctcagctcaagtgatctgcctgactcagcctctcaaagtgctgggattataggcatgagccactgtgcccagcctagtcacatttttaaaaatgatattctcctgtttgatatatatgtgaataaattaccaaaagagagcaagaggaagagagaaggaaatcaactgaggcacaaagctggaatgttctctaccaaatgtagcctggatatggtgtgttcctgtttctgtttctacaaagcagtatcaagaaataattttgaggtgtgtgtgtgtgtgtgtgcatgcaaatgtatatgtgcatacctgtgtgtgtgcatgaatgcatgtgtgtgtgtctgtgtgtatgcatgtgtgtgagtggccatgcatatttttacagtgagaacacaggcaggggaaaggctctgtgtccctgtgggtggccttgtatatttaccttgctcttttctcactatggccgtaaaatcaggcaaagggactttttagattagagaggcctaaatttgtcctgactccaaaaagcatttcctttctcagaagtacactgttttttccttaaaaagcaaccccaatgtatgttgcttagtgcatccccaaagttacccccagataatccccattatcatcagttagtggctaatttcagttatccctacttggccccttcctgaggctggtttatggatggttatcctgccacttgggcttttcaccctataaaccaaggatcttccacttcccttaactagcagggtacaagcagtgtacacggagccaaggagaaaatcctcttctaataaaatctgacaaaactttggaagctgcatatgtgtttgcccaagtgtttgcatgtgcacatgtgtgtgcctaagtctcagacattttccaagaatcgtggctcacaaggcaacacctcttatctaacaactatattctccccaaaatgatttaaagtgccatgaagatttctttacattgagcaagttcattgtggctcacccgcaattacaaggtgaaacagtgctttgttttactttgggctggaaagaggaaagagaaaaagcttaccaattcaggagacagacaaattgctttttctaaacaaagattcactgcacttataaatgtgtatctcccataattttaaaaaaatcgtttatatatgggatgaaccttataaacaacagaatagtcaaggctatggttttgtccaatttaaggactggacttgacaagaccaccaattgttctgttgtgttttggaaactcgatccaagtttacatttccagccaatgtttcactccttatgtttatgacagcacaaaagagcaggctctgggaatttcttgaggggaagtcatggcagtcagcactgtcactgagagggagaacgagggaggaacatatgtggaagggcaagcaggagaatggatgatcccttttgggttaacatttaaatcccaaattgaattcccctacatgtcaaaaatgaaaatattttcagtgtttgcacatacataggaattgccaaatgggatttaagtctgagaaagcaccataacatcaaccatttgtacagctgttgttggaaatggctccaaaccatcaaggcatgtctaacaagtataaatattggccctctgcgcttctaagctttgttaaggtgtatccctaaagacagggagctaacaagtacctcagtaaacacgtagagtattggaatattaactccgctactcatgggggttgtcactccacaatcttggtattatctaggcataatacagcccttttatggaaactagacagtatcttttggtacactcaagaagcttggctgtgcattagtatatgtgaaactcttttaaatacatatgtgttgtttccagtagagtggggaggaaaagccagtgttaaaaaacaataaatttcttggattctttgctccgccagtagcttccatgttctctctctcagcatagagagctcttccagagtccagacacctgactgggtctcctgtgtctgacatcataacagaaccaaaagttcagaatatccttgaacacttttcctcaaaaatcccctgatggacaatctgagacagcaaattaaattaaaggagataagtgcttttatagtaactaattcatattgcactatcatccaggaaattgtcaataagaatcaattttgccctccaaattctgatgaactgattgttatgatccctttgtaaacaccactttatttatttatttatttatttatttatttatttatttatttatttttgagatggagtttcgctctgtcacctaggctggagtgcagtggcgcaatctcggctcactgcaacctctgcctcctgggttcaaacgattctcccgcctcagcctcctgagtagctgggatcacagatgtgtgccaccacgcctggctgatttttgtattttttagtagaaatgggatttcaccgtgttggccaggctggtctcgaactcctgacctcaagtgatctgccgacctcagcctcccaaagtgctgggattacaggtatgagctataaacaccacctcaaatgctagtacaaatgccttccagaagccaccgagctttttcccctttgatttaatttttgtaaagtgattttttaaaccatgtgagtacttcagtagaccatttggtcaggtttagaaaaaaatctaacaaggaaatgaggtctaagaccaataaccttctgcacttctctttcacggcccactctgccactcttgcatatttccctctactttacaaaaaaatggcaaaattggtcttttgccttcgatcaagagtttattaactaaatcctgataataaatttggtgaaaacattttggataaattgaaattacttgaatagtgatatatttaaagagataatctagacaattagaagaaccaaaaaaaatcttcaaaaatctattatctgtgcagagagatttctagcttaagtagagctgtattatccttggcactgccagtactgcggttcccctaagagtttgctttttctgtgtccctgtagaaatatctgggccttggtctctccacatcataaatagtcaaggaagcagacaaacaagcagaaaaaagtggggcggggggaaagaaggaacattcacaacctctcagagacaaggaatggtataatccactaggaaggaaactggtatgtggccagatcttaccaatgcctggccacaagttaatgaaaacactcctctctgggcttcagtggttaaagattcacaggctgagagatcattctcctcagaagtgattacccattcttctgatacacccccaaacatccctacctgggattaagattccttgctgtgtgacttaccggagtgctcgaacatgacttctgagtatcttcctcattgaaaggcagaagctcatgtttcttggaaaatcactaagcggcagagattttcctattgaaccaaagtgggagaatgcaagaggaactgtagtgtctctagagttaaagcagcagaagctacttgtgactagaatcagtgaaacctgcatcaaatgtatgccagtgatgtttggatggcctaaatcagcagttcaccaactctctgccatattagaatacccaagagctttgaaaacctccaatgcttgtgatgtaccccatatcaattaaatcatggtctctagggataggatccaggtatcagtgttgttctgaaactccctcaggtgatttcaacatgcagccaagtgtgagaataggtgcatttgtaaatgactgcaggcatatggcactgtgcattgaacatttctgtctccagagtccatttattcttttcttccacagacatatgatcattcaacagctattcccaactaaaaaccaggactaacacttgtaagatacaaacaatacacaaacaaaaaaaaccaggtgctataacccaggctgacttaaaaagtgagatgggaggaggtggaccattcctaaccggagggagatttctgatagtcctgactttagaatgaaagaaaaagttcttgggcctatcagacttcattctctcatttcaaatgaagagcagaacattaacagagctcaactttggtatcctgtaaggcagaggtcccctagcccctgggccacagaccactaccggtctgtggccagttaggaactgggccacacagcaggaggtgagcagctggtgagcgagcattaccacctgagctccaccacctgtcagatcagcaggggcatttgattctttttgtttttttgttttttttaagacagagttttgctcttgttgcccaggctggatcgcagcacaatctgctcactgcaacctccgcctcccgggttcaagcgattctcctgcctcagcatcccaagtagctgggattacaggcatgacgcccagctaattttgtatttttagtacagacggggtttctccatgttggtcaggctgctcttgaactctcgacctcaggtgatccacccacctcagcctcccaaagtactgggattacaggtgtgagtcaccgtgcccggctggctttcgattcttacaggagtgcaagccctattgtgaactgcgcatgcaacggacctaggttgcacgccctttatgagactctaattcctgatgatctgagatggaaaagtttcatcctgaaaccatcctctgcccctccctgcatgtgtgaaaaaatggtcttccatggaactagtctctggtgccgaaaaggctggggaccgctgttctaaggctcatctgaaaatgaagatctacgtgattgaagtcttgagattagccctaccttttaacatgtaaactcaaaacgccataaacaaattcaggaggagatcaagagtttattaactaatttctgatcataaatgtggtgatatttaggataaaataaaattacttgaatagtgatatatttaaaaagataatctagataattagaaaaaaaaacttgaaaatctattatctgttcagagagagtctagcttaatgatggccatattatccttagtgttttctctgcataatttatcttttttgtggtattgttggtgccataacctattaccatttagatactcagggtgagaaatactgagatggagtacttttaaaaggcctccagtgaaaccatttaattcatcacttgctaattctactgtaggcactcagatatgtcaggagagtagaatgtttaaatatcttcaagttcttgctcaagtcagagatgtaccagttacttttactacaagcctaacctagggacagtcaggttttcaatgattttatatcccatcctctccttaaattctgctctgcatggatcagaatagtttctgtgtctattagttcactgcccttaccatttaaaatgttagaaagaaatgaaatccccaatgtaattttctacattttagaatccatccactcaacaaacatttattaaagtacatatttatgtaaactagactctgtaataggaactggagacacatcaggaaacaaaagaaagatgatgtcctttgagcttacagtctagtagagggagacacaatcagcaaatataaatgagtatattatatgtcagatggtggtaagtaccgccaggataaagtatcataaatgagtgagaggattattattttaaagaggttattctggaaggcttccctctggaggtgacctctgagcccagtttagatcccagcaggaacagatggcacattcaaaggagaaattgacgagaactgaataaaggtgctatttacacaggtatagacagtacccacggactagctacagtaggaagctgttaccacacacagtcctgaaggggcagagggagagagtggcggtgttggaacttagcaagagctgtagccaagaggaaaagtctgcttgactgcagtggggccagaagtaaaggaactcagccactgcccaaagcaccaggcaggagggaacagccccaggttgcaagggagatcagtgctccctgcctcctcctgctcaccagcctcctgccagtgctcctgggagccacagcactagggagccaggagaagcagttcatggaggtcagcctcctgcagcacaaagcgcagagcacagagaaagcctgggggacaggggaacaaacggagtgagccctcccatatcttgaagacaacactccaaccagagggtaggtcctgagggaagtgtgcatggcacattctaggaacagcaagggggtccctgtgagcaagaggaaggcatgtagaaagccaggtggttgacacacggtaggggcagatgatgtggaaccatgcatgttctacaaagactgtggctcttatgctaagaggtgagttgaagatgttgctggagagttttgagcagaggcgggacatgcagctgtgtggaagacagatcctcaggggtctacaacggcaatggctgcaggagctcagaagtcacagcggaaggtcagatgggagactggtagtttgaaataaggtggtagcagcagaggttatgagcagggttgatgaaattgattccactgtgctttgggttcgcagcttacttattacatctgaaaacgtattatatcatatcctcattcattttaaagacattgattaagcaactactatgtgcaaggcaggaattcagacagttcctcagctcaagcgaaggagaaagggaatgcagtgtgcctgacccttcattaagtatttcacctgggcccatttgttttctgtttcatttttataacaatgctgtgaggtggaaactattttcctcattttacagattaagagatcaaggcttaggccgggcgcggtggctcacgcctgtaatcccagcactttgggaggccgaggggggcggatcacgaggtcaggagatcgagaccatcctggctaacagggtgaaaccccgtctctactaaaaatacaaaaattagctgggcgtggtggtgggcacctgtagtcccagctactcgggaggctgagacaggagaatggcgcgaacctgggaggcagagcttgcagtgagcggagatcacgccactgcactccagcctgggtgacagagtgagactctgtctcaaaaaaaaaaaaaaaagaaatcaaggcttagagagttaaatatgtacaaggcctctcagctggggagaggcaggacagggtggaaatcagtctgaccccaatcagtctctcccactaaccatcatgcccccactaatatgggatgtaagacacggacagatactgtttattctataacaattggcaaactctttcaatgcctctttcaaaggatgctatgaaattatgaaacaagaaatggccagagttaatttgtattcattttaataatcagatataagcataatacttagggatgttataaatcaattctgagtttatgcacagaaaattagtgccactggggccaatgaacgtatcacctgaataatttatgttaataatcgcatacatggaagaaatgaccatagtaagcatagtacctattgaatttcagttaacttactgcataaaagcatgatctgaatgtacttttttttttaattttgaatatgcctttgtctacaaggtccaattaaaaaataatggcattgggtattctttttaatgtttcaaatgcaacttcaagccaaaattagtcacctggttgaaacggagttatccaattgtgatcaaaataatttaggtcaaatatttcatattagaacttatatttgaagacataatgctataggatgaattaaatcatttctctctgttttaccttgtattgaagagacaaactcaggttcaatgcatacgcctggtaaacacccatatggaggcatgatcaaactccaatccaggcagaagtccagtccatcaggtagggctatagagaaaacatgtcaacatttggaaaagctaggtgcttagccccaggctggcagccttcatagaatattagtcccagccaggcgcggtggcttacgcctgtaatcccaacactttgggaggccaaggcgggcggtcgggagttcaagaccagcctgaccaacagagaaaccccatttctactaaaagtacaaaattagccaggcatggtggcacacctgttgtcccagctactcacttgctcctcgcttgaactcaggaggcagagattgcggtgagccgagatcgcaccattgcgctccagcctgggcaacaagagtaaaactctgtctcaaaaacaaaacaaacaaaacaaacaaacaaacaaaaaagaatatcagtcccagtaacagaagggtcaaatggacttctggaatatgtagctggttattgcaacacacagctagcttataatgttctaataacaaaaatcaaagctgataacatttttatttcagggcatattgaaatatgagacttatctaaccaaatcctgatggaagcacaaacagtaaatttcagtgatagatatcatgcaggtataagaactatggagaagttactgattgatagcagtgacatatcacctttacatatgaaattgtattttctattgcgttttctgtttagggtttagatgaggttttactgatgtctatgggagttacctaaaagattccttctaaggagaatattctgccacatttttagtaggtatgtatggaatatgtcaaatcttgacacaatatttatgaggtagagttttactgttattaagcctcaaaaaaaggtcaattcatagaagaaaatatctggagttggcccaaaaactacacccaactcaattctagctgtgccatcaggcctagagagaaatttaaatctttttttaaggtttttttttcttagaattggacagagtgaatgctaattttttaaaaggtgatagcaagttgcttcacagaagaaaaaataagccttccaaacagtttaatggttttaagaatttgggtttcattgtgtgatgtttcaggtattgactcattaatgtctataaaacaaattaccaaatgaaagtgtttcaaaaatagttcaaaactgtcaatattctaaaatacctttgtcctatctattctactcgttaatctgttaggttggcacaaaagtaattgtggtttttgctgttaaaagtagtggcaaaaacctcaattacctacctatgtttggaaagatatatatcaaaaagttaaaatgattaccgatgagtgagggggattatagataatcatttttcctctttttgatattatttcctgaatttttagcattgtgcatgtattatttctaaaattggcattctataaagctatttaaactttttttaatctagttaattttgaaggcaaggaaaccaagtatcatgcttagcacatggaacagggcataattggcactctcatagaaagccttaaaagtcctttaaagttttccagagaagaatatgagattaaaatatcataagtaaagaaggtgctataagctagatatattgcacttagtgaatatttcatttgcaaacattacaacgtgaacatctccaattatttaaactctgttgccttacaaatgatcacccatttttgatgcttagggccctttttcatacttttttttttttttttttttttttttgagatggagtctcgctctgttgcccaggctctggagtgcagtggcgcaaactcggctcactgcaaactctgcctcctgggttcacgccattctcctgcctcagcctccctagtagctgggactacaggtgcccgccaccacgcctggctaatttttttgtatttttagtagagacggggtttcactctgttagccaggatggtctcaatctcctgacctcatgatccaccttcctcagcctcccaaagtgctgggattacaggcgtgagccaccggcccggcccctttttcatacttttaaacccaaggccagctgtaaaattaggatttaagacatgagctcagagtcagctgaatgactgagtctacttttttttttttttgagacagagtctcaatctgttgcccaggctggagtgcaatggcaggatctcagctcactgcaaccgctgcctcccaggttcaggcaattctcctgcctcagcctcccaagtatgtgggattacaggcatatgccaccatgcctggctaattttttgtatttttagtagagatggggtttcaccatgttggccagcctggtctcgaactcctgacctcaagtgatccacccacctcgtctacttttgaccttagatgtttaggtcggaaatgtcagaggttaggtagagaggcatggatactaaaattgttgatctgtcatctattcctcatttctgaaacctaatgcaaatgaataagccatcagaatgttgaaaaaagcctctaaaacgacctatctcatagttccagctagggtgtgggagaatctcaccgggtgtgaagataatggtctttaagccaatctgtatattgtggctctggcggaccaacagtggcatgtgccaccagttctccagctggaaagcccagatcacaggcctaggagaataactcctgccagttcctccttcctctgcccctttgaaatggagattatctggggatgggttactcaggcatctgttgttattgacaagcatcagaaaaccagcagtcctatcccagggctactatttccatttctgtgtatgccttaataactcaatctgaacatgagaagaaaaaaaaaaaacccagatttgcccaacttaaggcattaagtctgaagaaaggtaactatttaaaggtgttttacaatacgtaataggatggcctggcatggtgggccttgcctgtaatcccggcattttgggaggctgaggtgggcagatcacttgaggccaggagttcgagatcagtttggccaacatggcaaaaccccatctctactaaaaatataaaaattagcaaggcgtggtggcatgtgcctgtaatcccagctgctctggagggtgaggcacaagaatcgcttgaacctggaagcagaggttgcagtgaactgagattgtgccactgcactccagcctgggtgatggagtgagactctatctctctctatatatacgtatatatttttttttcataaacatagtttttcctaattcaacaaaattttgaagggtcttctaaatttaacaaatatttatccagtcttctatgcaatcactcaccttgatgctgcaagagatagaaagaaagattttaaggaactaaatctaacgcctttgttcgtcttactcatttattcaacaaatacttattgtattttcctcttaagtgtgaggcacttctgtagatgttggaaaatagttttgaacaggatcatcagggcatgcatgatcatggagtttacagtctggtagtaggctgaggaacaaatatcttaattaacatagaacatgctgtaatagtttaagtgaggtgtacatcagatgttgaagatcccaggaaatactttatgaagaagataccaattgagtcagatgtgaaaagattttaaagtaaaaacataaattcccaaggatgagaaggaagaggggacaacatgagtagtgtctgaagggtgggagagtttaggctatgctcccggaaatagggaatagtctagtttttctagaagtcagaaaggtataggagaagaggatgaaaaattgtgttgaagccccagccaggcctgccttatgtggataggcaagaactttgtttggaattcagcaggcaatgcaagatgttgcgtaagggatcagtggatggatagcagctgtgtttttaaaaaattaatccaatgggaatggactagagttggaaaagagtagaaggtgtgaaacccattgggaggccatcactatcaatatatttcataatgtcactgtgactcctacaaataatgagacacattgcaaagccagcatgcaaatgcgatagacttagtgatgtatatagccagagtttcccattcacttccacctcctcctcaatacaaatcccatgttttccaaactcatgactatgaagatctgtcttcagccttgtttagtatagctattgcatccaaagtaagagaaaccaggatttcacctacaggcagagtgaagatactcagaaagtaaactcagccccagccagggacttcatgagctggaacatttgttcagccagcaactatccatcagctactcatttctggtgggacgaaaatgtctgagcctccttctccccagccacgttcaaaattctgttaatttacttgaaaacatgacgaaaaggcctaagcaatggtcaccaaaaacctggtagtgatatataggggtagtgcaatgtcagccaaccacgagactgattgatagacacataacatttatgtgtgtgagagagaaaaagggagaaagcagaagggatatcctgcctatcagtcagcattaaaagagagaaatgaagagattgtcttgagcactcatcattctcaaaggagatttgtgcattgattccaacaaaattgtccttaggcatagaaatgtgaaaagtgcttttatggtaaaatttagattttagcctcaagctaaaaagatgtgtcgcaggatacagttcttcacctgaaatagttcccatagacacgaggagaaaactcaatgtattctcggctcagctaatccattatgcccatagaaaaacggcagctcagagctgtgttatgaacccattcaataccacatgcgtttgcagcgccatttcctcagtttctgttgcctttcatctgggatgtcacttcattgctcctgctcagcctttgccaagtatttattttttggccagcaaattacaaggattttttttttcctcctttttgaaaggactgaataagtcacagagctttcaaaaccaagattatgtgtatataatataaatgtgtgtgagatatgtatacacacattctatcaatcattatatatatatttatacacacattctatcaatcattacaaaatatatatatatattttttgagacggagttttgcttttgttgcccaggctggagtgcaatggtgcaatctcggctcaccgcaacctccacctcctgggttcaagcgattcttctgcctcatcctcccaagtagctgggattacaggcatgtgcaaccacacccagctaattttgtatttttagtagagacggggtttctccatgttggtcaggctggtcttgaactcccaacctcaggtgatccgcctgcctcggcctcccaatgtgctgggattaacaggcgtgagccaccgcgcctggccaatcattacaatatttttaactcttaactttaattctgaaacagtgtaatgattcaagtgttctgctgattgaaatgatagcatgtgataacatttctatgaaaaaggagttatcattgagataagcggatttgaaaagcaaagttttacaagatttttttataagctttggtctgaatgacttaagaaaatcaagaaaccaaaccaaaccaaaaaaccctagttttgccccagcagtgcttaagacctggagaacaaccatatcaatgccttagagaagctcagaagggtgatgtcatgcagtctccccagtcaggaactattcagaggcctgaaagggaaatctgaaacaaaaagacccataatctaaatcattaatgagaagaaaaaatttcaggagcccataaagaccttcctgcaaataactgagaagggaaagagctttcaacagacttattataagaatgttggtggtaatgaccaaagatatgaaactcatctttaatgctttttaaagatacacacctaagaaaatgtcgccaagtatttcctcagggtctttgatgcagaaatttgtccctggtactgagaattagtatcaagattaactggcctttggaatatctgttggggaagtctacctggtaaccacactatgatccaactcaggttctcagcttggtcagctcaattttttttttttcttccagcatatagggaatggtcctacttgggacagccttctgttgtctaagctcacaagaatataatcaatttattttttacacgaagaaataaataattaatagtactgtacaaacactggatccagaaatatcctcatcttaaacctgaggttacaggacagcatctctaaaaacaaaagtccattattagggtaagaaaaaggaagtcatcctcaccacattcctcaatactaagtgtaatcttttctcacacgatggccttccaccaccctagtaacatcaatctataccaaagaactgcaaagaaagaagaaaaacctacttttcttggtgttggggtctgtagggatctgttcgtggtgccactagccaagccagccatggtaagagacagaatgacaggtgatggcattaaacaacagaatcacttcctttgcatagatttttcttttttactttctcaatgaaattctttataattcccagcaaacgttttattttggattcctttagaagtcaaggcagcatataaaaacaaatcaaaggtataaactttagaaccttatgagcaaacatcatagtacatcataaatgtctccaaataacaaataaatcaataaaactaaaaatgatgattataagaattgaagtagtatggactgtctgaaatgtaaacggtttggttcaaggacaaagaaaatcattgctactccaacttctgctaatatttagaagagcatgtgccccttggcctaattttcaggcttccagttttctttagaacaagtttactttacaatctgaagaaaagctaaacagataactcataaaaagtgcttcattgaaattaagaatctttagagcactctggactcttgatgaaacctaaattcttcaaaagtatcaagtaggaacctgcttaacttcaaaaacacatgtggaaaaattagaaaaatcagaagtagattcttcagtggccactctaaaaatgcattcttcagtggctaccccaatttctaaaagctattaatgtatactccaccactacagttcactgaatgtcttattctgttcaggatgctgtaacaaaaataccacagactagatggcttataaacaacagaaatgtatttctcacagctggaggctgaggggtccaaaatcaagcctctgcagattggtgcctggtgggggcctgctttttgattcatggatgactgtcttctgactgtgtcttcacgtggtagaagaagggcaagagagctctctaaggtccctttcataaaagcactaattccattcatgaaggttctgcccacatgacctaatcacgtcccaaagaccccacttgcaaatatcagcacatcaggaatcaggtttcaacacatgaattttgcaaggatataaacacattcagtctattgcactaaataatgaatgctgggaggaccaaaagttccttcccttgttatcatgtttttaaattaataatccataatttacttccctacaagattctaagtgacccacaagacattagaacaaacaaaaatgggatgaagctaaagttagatcttactgctaaatttttcacaaagtattgcccttctgagtaggacgaagacctggataatttctctcacttcaaaaagatttttgattcatacatagcacagtgcactaaatactcattcatgagtgttaatacttggtttttcattcttgaagagttttaatctggatatgattgccgtgtcttgctgtatgttgtataggtttatttttcaggtaaataccaatttcagaatgcaaggacctaggaaatttaactgcatccttcaacatttaactgcatccttcaacatttaacttgcattgttcagactagcaaaagtgatgtgatgattatatggccagaaaacttgcatataataggccccataaacactccactcctctcatgctgccaccccattacctgttttacttcctcagtgggacaggttccatgcagctgcctcccatcttgttgctcttaaccttctctctgtatggggagtacacagtgacggttttatattggttgtcttgcttccacatggctgagttttcccccttcccccacagcatgttcaatatttggattggaacaggatgtttacagctacggagttattagtttgtttcctttagaaggctcagaagccccaaccgtgaagccctagagttcttcctgtctccacagtacggagtgccaaacgttgcatccgtgtccacacagtcattactattactatctaaatgggctgatgttttcagccagcatctttttgccatttgctgccattatgttgacataatgaagacaactgaataatatacaaagaagaactcagaggctttgattaaaagaaaaaagtgtccagatgacttgaggaagttggtacaatccagatttcacatgtgatttacttttgtctgctcttattatcccagtgtatggctccattggtgacagtggctttcaaaatttgcccatgtttgtgtgtaaagcttactcttgatgacagaatttgctagctgcttttctgaagccccttaaatagatttcaagttggcttggaaccattcaggaagcagcagtagagttggttcagcaagtcctccaaattgagagaaataatagagctgtactcagaaatccaagatcatgttgtcattgtcagtccttcggggtggattcagtattttcacttctggctttctaggtgagcacagtgcagcctcttggcaaagttgcaatgatgctaatgatgcaggcttcgagcagtaggtctaggcagtcagagcagggcaagccccgtgggactgactagtgtccaacccaccacgggtctgggctccagagctcttctgcaaaagtgcttgggcaggaaagatacagcatcaccactgtgaggaccactgggagccacttgcagaaaaaaatccactgggttgaaggccaagcaagccaaatgactacattgaggggtagaggccatttcaaagtcgatattaaacttcgtgtataacatttcaggagcaatcgagtagagaatgggacccatctagggaagaaaatgtttcttaaaagatcagactctcaactctttcactgaaggattctgacaaataaatcctgcctacctggagttcactctaattcaggggttgggagaaggggtttagagtaagcaccatgaaatctgacaggttctccacatctttccaaattctggcacattgtctccagaaagaccagcaccctctgcattgacatggttttgttgtttcctgacctctggcctatgtataaatgtgaaagtctttctgactagcaataattattccttccttcatacaaaaacagagaaggagtagggaaacccacaatttattccaactgacattttttatgcttttagttcttaattttaatagagttttttttggaatatcctttaaaggaggttagaaaacttgacagtatagcaacttaatgtttctttctcttctcacccaactcaaattgtgatggctctgctaatcaccctgatctgatcattatacattatatgtatcaaaagatccctgtgtaccccatgaatatgtacaattattatttgtcaacttaagaatttttattaaattaaattaaattaaaacaaacaggttagaggacagtgccattaattcattcaaagaaatccagtacagaggtggcagaactcttttatctttctatcttctgccctttcacaatataaaaatcagaattgtagttaatggctttctttttatgtaacttttggagagtacttttttatagcctatggtaagggaagggaagaaataatggttatttcagggatctaagtgtaaggttgacaccatgaaatacagcactgttagtataccttacaatagttactacattttgaggcataagataagagtatctctaaatcttcgtagctacatttttctatttttcttactttttatcagtaaagtcataagactactgcaagcatcatttttcttagcaactctaatttaaagatgtcgtcttgtgttttgataggttttcaagatttgaaccagatttgttcctactcggttatctgttagtcaaatgtaaacagcaacagaccctttctgacatcttgtgtactcatgtaaaatgaaacaatacaaaactcataaccgtcatgtgaatacacaatacactttgttccctcttttgattacagagcaatgccagactctaaagagggataattataaactctttgtggattttgtggcaaaagcagagattccttgctatgattattagatagattatggttggaatgggttgcttctaattttattttggtctttacacaattcgaatcataaggagaaaaactgtttcaaaggataaagaacaactgtggtcaaagtcaaaattatttgttaggaatgcaagacacccacaaaaaacagtcatattaataactatgtatttgatatcttgcacattaatctttgtcaagatgttcctaaatttttccctaaaaaaatctctatttcatatatatttggctgtatttatgagttattttttaataataataataatgtgtgctctttagttaatacattagcctaagaaaaatgttaaaagtactaatatctggccacccatgtcacaatgtaaaatcataacttcctagagggaactggaactgtaaccaactaggatgttaccatactaggatactgaatatgcaacatcgtagtatgtaaaatatcaacataaacgatgagccagaatccaccattctttttattttatgattgagttataagccttgaattcgcttaaacaggaactaaaagcaaaagttgttctttgtggcctgtgcttctctgcactacatttaagcattaccatagtcaatcactggatattcagctctgttatttcacaagactcttgacattgccaaaagagccaacttggccattttgcaagacactgttttaatcaactttttattttcctgatccataaagcaacatgaagcaatcttttagctataagccatgcttgcttccttcaaatgaacttaaaattaattctaagacaataaaacactgaagtttctctttttaagctaaaattaaggtgttgttttcattttattttcactttttgaaccattttaaaagatgtggtctttttaccaaagaggactaatctattgcttggaggccagcctgcaaataatctggcctagagtgaggaatcctttttaagacagtttgtattgaatgaaccaaaacaatttccaccctgaggcttccatctggtcaacctctgttcagtcccataaataattaatatggaaaaatggtgttgtttttttttttgtatcttcagtcctctttgcttttactaatttaacagagagatatttaaaaaccaaacaaacaaatgtaacaacaacaacaaaatcttgaagaaagctcaggccaccagcctggaatatgatgtcagactgttaacatttgctggcaagaattaaatattttcagttcagttctaaacttatgaagataaacaaagtggtctgcccatcagaaaagtgtgaatattgtgatgtggcttgggggacacataagaaagaaaacagaaggcaggaatggagaggataggtcataattaatacactcaatctacccttgtgcctcctcttcgaccccaaccccaaccccacccatgtcacaatgtaaaatcataacttcctggagggaacaggaagtgtaaccaactaggatgttaccatactaggatgctgaatacgcaacatcctagtatataaaatatcaacgtaaatgatgagccagaatccaccattctgtttattttatgattgagttataagccttgaatttgcttaaaagggaactaaaagcaaagattgcctagaaaagtggttctaaataaagatcatcgccaacatatcaaatgtacacttccttccctcctggttccaaacccaggcatttttttttaatgatattgcaaaattttattgaggagctttacacattggtcaatgctatgttatatagttacatttaaatttattttttcaaacttgatttaaatgccattaagaaatacagcctataaatataaacttctaagtatctttctaaagagaaacatgactcagaaattataggctgttgagatatgggtgctttgcagagtttatgataggtccccattctatagagctattttacatagttgacctagaaggatttttttttttttttttttatgtaacatgtattttaccataattattattttttagttgttcaggatccacaaaaaatttttttttttttttattatactctaagttttagggtacatgtgcatattgtgcagattagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatacggctagccagttttcccagcaccatttattaaatagggaatcctttccccattgcttgtttttcccaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccaattgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgacactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcgtctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaacgttttcaacttctttgcctttggtttgaatgtcctcccgtaggtcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgaacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgttgccgccttgcagtttgatctcagactgccgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctatttggccatcttggctcctccccaccgacctagaaggattttccacaagtatttcagtttgcttgaattctactccacaactgaatttccaaaacattattattaactttgcattaaaatggagctttctattaaaaaaaaaagaagtatgacaagttctgaaaactaagatgatcactctagaattaggcccatgttactccaccataaaagtcctgcctcccgcactcagggacccaccgaaacgccagtctttgtgctatttaatattgggtccattcactggaaaagccctgccctagaaaggggctctggggtctttaaagaagagattatgaacttagactgtagtaggcccagggaactacccatgcgaaatgtatcccaggtcaatataaggtgacctttagaatcagagcccagcgtgctgcagagagacccttagcagagaaattaaacaatgtttaagtgtactaagtctctttacgtgttctttctctctatatttgataatatagaaagaataaaatgtttctctatatccttgggtcactggtttttccaagcatttaaaaatgttaatgggaatgtggaatttatgagtttacatttgtttggcacttagtgccttggatatagtaagtgctttacacaaaactttatgttaaaagaaattgttgtaaagattttcaacaacagtggatcatattttctttttttttttaatgtttttttttattaatttttttttttattatactctaagttttagggtacatgtgcacattgtgcaggttagttacatatgtatacatgtgccatgctggtgcgctgcacccactaacgatcatattttcaaatgactaaggaaatgcaaggattcactatgctatgaaagtgttctaattacttattgatcttttacatggtcgtaagtttagtggagatttctctttttttctcgttgaaagttgaatttgtgagctagactattgctccctgtggggcttgttttctgctgtgaactgaaaatgtattagtatctttttactagaatctaaattcaatactatgccatctattgtaaagatgtaaacgttggaattttgtaactattcatggggaaatgagactaaagaattatctgacaattgaatatagaaaataattaaggcagctacataaagtgcaactcgaagattgaaaattacggattgcaagcctttgcatgaaaatacatgtgtttcttctcttgtcaagacaagaaagagctggctcctttcccaagctttgcaaaactatctctgagctctctggaagacagggaattagaaatactgtcgcttccacactgtcaaagagaagccagttccagttattacagttgatgcgtgacttagttcgggggttggggagggcagggggacaggaatacaaacaaaagtttctgttacatcttaggtaactaaatttcaacagtagagatcttaaaattctgggccaatgtaaaagtgttactcatttttatttattgtgagttttcaggtatcgttgttattagaaatgagcagggggccgggcgggcgtggtggctcacgcctgtaatcccagcactttgggaggccgaggcgggcggatctcgaggtcaggtgatcgagaccatcctggctaacatgataaaaccctgtctctactaaacatacaaaaaattagtcgggcgtggtggcgggtgcctgtagtcccagctactcatgaggctgaggcaggagaatggtgtgaacctgggaggcagagcttgcagtgagccgagatcgcgccactgcactccagcctgggcgacagagcaagactccctctcaaaaaaaaaaaaaaaaaaaaggaatgagcagggatctggataatctatgatagcaggtattgtgaagaaaaaagcaccaagcatttggttctgagatgctttaggtgatgtgggctgcatgagattgtttttgggtgtacatgtgtctttttaaatatcttctgagtagattaatactattaaactaagtgtatgtactagctaagcctaaattaagtggaggggcaaaaacaaaagacctgaaaatgaaatattgataaatcacagaaatgttccaacttcttcaatctgaaacatctggttcctccaagtaattcctgtaaatatttccaactgcaaccaaaaagaaaatgaaagtgatttgtggtaggaccgagcgagcacattctccccttggtgcattagttgagcagcttctgggtggctgaatccatataagactctggactgactcagagatgaaggaggcatctcctggcctcgaagtgctcacagtatactggatggagaggcactctgtgcaaagggctatgatgcagatatatttgaattcagtggaaacactaaaagtagctaaatattaataattcagccttgctggatctgggaaggcttggcagaaaagctgacttctgaccaggagcttgagtgatgactgaaaattcatcagttaatctggagaaacaggccttctgggctgggagaacatgagcatgtgctctgcaatgtaaattttggggaagaatctcatacatactctaaaaaatggattttgttccctgggtagtgttccgtacaatgcctggcatatagtaagcattcaatataaaagtgtggaaagagctgtactggcttcctgggctgctgtaacaaaatactgcaaactaggtggcatacagcaacagaatttattgtctcacagttctagaggttggaattcccaaaccaaggtgttgacagagatgtggagtaggatcctttcttgcttcttgcagctcctggaagccccagatgtttctggagtgttgcagtgtaactctagtttcggcctccgtcttcacagtgccatctccctctgcatatgagtctttctgtgtctataccctgtgtctctgtcttgcctgcttatgaagacactagtcatattggattaagagtctactctaatcgagcatgacctcctcttaacctaatacgtcaatagaccttatttccaaataaggtcactttcacagacacagggctggttaagacttcatcatatcttttgcaggggacgcaattcaacccgtaacagaaggaatgagctagtcaaggttttgatgccgggaaaaatggtccatattttagaaagtaaaccctgaatgcaggatggagtccatattagtaaggtgaagggtgggaaggaagactagaatcaggagtctcagttaacgagttgttgaaaggagatgagagatgatgagcacttgagcagggtgggagcagtggagagagaagggaaacagacgtgaaatccatagccagtcaaagtgagggacttggggactgattagatataggtagatgagggtcagggaggattcaagatgattcctagggttctatcctgggaggcagacctgatgaatggtgatgccactaatgataatacagaacgtaaggcggaacttttgttttgcaaaggatattgatgagttcacccttgtacacattgtattggtgatacatcaaatacacttgtggggagaggactagttgtccatagaactccatggaatcattctatgcctgtgctatgtaaaatactgttttgtggctgctgagctcttgaaatgtggctagtgcacctgaggacctgaattttcagtttaataaatttaatttccaatagtcacctgtgcctagtggttaccatattagagagcactgacctagcaggtacttagacatgtgtgtttgatatttgagagagatgcagagatgggggagcatggtctagattgaaaatcgaatttggggagtcattagcttataggcaattgctgaagccttgtgggccgtgagcccatcgagcagggagccagatacagagatgagttaagagtgcaacccttggggaacatcagtgtataagttgtataccacaaaagagagtgagcaaaggacacctgagaagcagaaaggaaaagcagaagagaggacagtgttgcagaaggcagaggaaaaatttcaaggagaatgcagtctaccatatccgaggaaaacaaatttcatttaataaactatgaaaaggggctttcacaattacaatattcctttaccaataaatgaaatagccatattttattaacaaagagtaagtacattgtgctctaaccatggaatttatctttatcttccctccacctccagccaaaggttaatggaggcaacaataaggaatttataaagatgggagtattccagggaatccagaataatatgcctctaaaaacattgccctatagcaggagggcccagaatgcatttcccatgaagtcctcaatagaagttgtgtaactgttttaatgcctgtactgatggtagtatcacttttcatagactctgcctaaatactctgtgaagtgggtagacttatttccagtttacgtaagaggaatctgtggctcatggagtttcagtgtcttgcctcagatgatacaagctgcacatagtagagttaggaatccaggtttttctgtccatgctctttccacctcaacagtgttttctaaacttaagacattgacattctgctctcatgattttttccatatatgctcaccacttcaaccgatattcacttaatatttttaaagtaaacttaaattattatttaaaagctgaatattatagttttacttggaaaaccagtatcactcgccataaatatatggtgattttgaaataaaaaaaaatcacacctgtaatcccaatatgttggaggctaaggtggcaagatcacttgagcccaggagttcaggacatgggaaatatagcaagatctcatctctacagaaaattttaaaaatgagccaggcatggcagcatgtgcctgtagttccatctactcgggaggctgaagcaggaggatcccttgagtccaggggttcaaggttgcagtgagctttgatcatgtcactgcactccagcctgggtgacagagtaagaccctgtctcaaaaataaagtaaatgaaagaaagtaaaggaagggagggaaggaaggaaggaaggaaggaaggaaggaaggaaggaaggaaggaaggaagaaagaaaggaaggaaggaaggacgatgctagcgaaatactactgcctgccaaagactttaaatcagaggcttatgcctttttttttttttttcattaaaaagggacatcagcaaatgtttaaagatattctagaaacattctctaccataggagattaaccccttgccttgtgaaaaaagtggcctctaatagcaatgctactctagctcagggatgaaaatgaaacttcctgctttccattaaagagtaaatattacaggccacatgcagtggctcatgcctgtaatcccagcactttgggaggctgaggcgggcagatcacttgaggtcaggagttcgaagccagcctggccaacatggtgaaaccccatctctacaaaaaatacaaaaattagctgggcatggtggtgtgcgcctataatcccagctactcaggaggctgaggcaggagaatcactagaacctgggaggcagaggttgcaatgagctgagatcatgccactgcactccagcctgggtgacagggtgagattccgtctcaaaagaaaaaaagaaaagaataaagtccttctgcgatttaaggaaaaagagggtactaagaagttgtttgataaaaccatgaagagtctgatggattataatctaggactcacacactttctgaggccacccaatctttattcggacagaaatttcttagaagatactttctagatactcacactggaggcaaaaaccaaactgtattatagatttcaaaagtgcattctgtacatttcattgatatacttatggattttagaacaatgtggcttaaacgtttccttagctgtatgaatattcccttctagaagagctaaaggaaaaacaaaacccacgcttagttcggatcagactcaaaaactgggcaacactggaaaactggggtttgtgactcagtgaagagctgaacagtggactggcctctgtgactgatattacatgagttccaccatcctcgccaatttcccacacatcagtcaccacaatgctacccttatcagactggtccatgtgaccaagaaagcaggtcttttgtccttggacaggagtctctgccatcgtctgatcctggggggtaccaactgctggacgatattctcagcaagaactcttgagtcctaaagctaactccctccaggtgaaatgcaagattaacgtctgcatacatttctactttatcacaactaatgccttaagtaggttctaggttgtgtagatgatctgaaccacattaaaagaaaatatttttaagtaaaacaagaagaaaaacgatcgctcagattgtgttcttttctcactagctaggttttattgatctatttttttaagcttgagtttaagctaagaaaagaaatcttgctttttatggcaagagttcttgaggaaaaagacaacttataatagaaagcatcttgcacaaaagttttggtaatcagagggggaagatgaagaggagctttgtaaattttgactttgaaaggccattgtaatgtaaatatgacttcctagagtgtaaacaacagtggtttgaaattaaaaatttgtacaaaacaggcagctatctagttaaaagaaaatgtgtctaataagcatgtgtgtctgagatgtcttgaatattttgatactatactgtaattactaacgatataaaatttccaagacttttgaaaccatgagaaagtttttaggattttttttccccagaaaaagacagctatacttttttggtactctacacatttaaagtaatttaagaataaaaaacatactgttcccacacaaatacttgaaagtattttaaattattaatggaaccacaagttcttaaactttaaagaatcctctgtctcttagtttagccaacagatgattatattaacataaaaaagtacggttacatatatttgagttaaggatcatcattgtgtcaagaaaatattacatttataatgagaaaatccaaaagttcactaagaatattgtttaattcaaacgttatatttattgtcttcatcttggacttctgaaaactgacttttttctcagacttgcacaaaccattctattctttaccatgctgggttttgcatgatttggaggcattctcaccatagagccatttttctctcaccctgaaggacataggaaagaaattagagatgtcagaacagttgtgtggaggtactttaatgggaccatggtgcagaaaggaggtggggtaaaaatatttgctttaggccaaccatggtggctcacgcctgtagtcccaggactttgggaggctgatgtgggcagatcacaaggtcaggagttccagaccagcctgaccaacatggtgaaaccccatctctactacaaatacaaaaattagccaggtatgctggcaggcgcctgtaatcccagcgactcaggaggctgaggcaggagaattgcttgaacccaggaggcggaggttgcagtgagccaagattgcaccactgcactccagcctggatgacagagcgagactccatctcaaaaaaaaaaaaattgctttataatctagttaaatgcaatgactcctccctttctagaccaaactgggcacttgggcagcagtaacaatgtatattaaatgatccaataaacaaacggtctcttttgcctgtaaatctgtaatgcaaaaatctgcagcagtgcagtttactgaattttaatgccaaatgtctattgctgtatattccttgccatctactctgtgtatcttcctgcagacatcaatgtgggtttgttattttttgtttgtttttttttgttttgagacagagtctccctctgtcacccacactggagtgcagtggctcaatctcggctcactgcaacctccacctcctgggttcaagcgattctcctgcctcagccacccaagtagctgggattacaggcacctgccaccatgcccagctaatttttgtatttttaatagagatggggtttcaccatgttcaccaggctggtctcaaactcctgacctctggtgatccgcctgcctcagcctcccaaagtgctggaattacaggtgtgaggcaccacgctcagcctctttggttctttttgtgtcttttggttgtattcagctttctgatatcattgggagacagttaaatcacaaaatacactagatatcattaggagacagtccacaaaatatacatcctattgcaaaagtgtgtggtcatttctcctttaaattctcccattctgccttcatgacacttgtagtgtgctcctctgtctttcctcgagaggaaattttataattttaataaaattttacgattttataattgttgcctttttcaagtcttatatttgaaattagctgggaacagtggctcacgcctgtaatctcagcaatttgggaggccgaggcaggcagatcacttaaggtcaggagttcgagaccagcctggccaaatgctgaaaccctatctctactaaaaatacaaagattagccaggtgtggtggtgtgcgcctgtagtcccggctgctcaggaggctgagtcaggagaatcacttcagctgggaaggtggaggttgcagtgagctgagatggcaccattgcactccagcctgggtgacagaacaagactccatctcaaaaaaaaaaaaaaaaaaatcaaccagcagtatcccttttgcagattttataatttttaccttttcagatctgtctgtccatgtctccattcatccatccacccatccacgctaatacacagtaactcattgagtttacctttaacagatttcattttcaattcatgcaattattcccagggaaaaaaagtttgctcaaagactgcctgctggaagataaggggctaacatctaagatttataaataactcatgcaactcaatagcaagaaaacatataatccaattttaaaaatgagcaaaagacttaaatagaaatttttctaaagatgtcataaaagtggccaacaggtacatgaaaaggtgctcaatatcactaatcatcagggaaatgcaaatcaaaactactgtgaaatatcacctcacacgtgttaggagatctgttatcaaaaagacaagagataataagtgtgacagggtgtgaagaaaagagaacccttggaatctagattgttgcaaccattatggaaaacagtatggagctgtctaaataaattgaaagtagagtaccatatgacccagcaatccctcttttgggcacatacccaaaggagatgaaatcaccagctcgtaaatatatgtgcattcccatgttcattacagcactgttcacaacagccgagatactgaaacaacctagggtttatcaatggatgaatgggtaaagaaactattttatatttatgaaatattatttagtatataatatatacatatatcatatatgttatatatatgaaatactattcagccattaaaaaggaggcggtcctgccattttccacaatatagatggatctagaggtcttggtggattttaaaaaggcacctgctctacatatgttctggaagttttttatgtgttatgaaaatgtactgctgtcttaaaaattggggcatttttttcctgatacttcagggaatattttatcttcaagtaaaatgatcaagagctttttatgtatactgctttgcattgtttcttgccagggatgctgtgggtgatatctgctccttggtgataaggattccacctcggagaacagaagctgcagggaaggaaggcgtttaggggaactatgctacagtttcaccacaatccccattttcagttaccaaaaggccttctcagaatttaaggacacgcaaagcagacagcaattaatttaattccagatagaagcttttgaccatgtatatttcactggcactttttgcaaatctcactctccctgttcagaataattcctggcagtgttgtagcattcttccaattaccactcatgcatctcaccgtcttgcctaaaggaaaagtgaaggaagatgtagtctaaacagctaattttcatataaatgtatataaaaatgtaaaatacattaaaattaacaataatatccccttagtgttactgctaaactgtattttagcccaatgcatatcatcttactactaagataaatggcaattttgcaccaagacatcagatcaatggaaattcacttggaatagatattcaggcatgaaagtatgttcatacctacaaaatattctaaatccataatctaagttcaaatatagtcagctttattttctttcagcacatatagtcagtttgtattgcaatgtcgtaagaccaggaggagggttgcagaattcttctacctctgtcatcttaatatttgtctctgatgttctcctctctgagtgtgtgtcctggtacccctgcatcggggtccctgtttctactctcagaagaatcagcagctattgccaatgtccatttagctgccagtcttctgaaagaaacgtaggagaaaaaaactgtgtacaaagagtacacctggtctttctacattctcttctgtgaacgaaatatactacttaggagatagaaatggtccttgttttgaatttgaagccatgctttattttcctgctatagagacatattctggtactctttataataatatctagtgacagtaaataggtcctgatatcaaagggtaaaacacattgtatgacaagctattcatagtttatccataacaaaatttattttcaaatgtaaatacatatatatgtatatttttaaatttggaaatacatttaatgtatttgtggaaaatatcaagaaaagatattttgtgacaacttctaggtatgcatctctgtactttttacttgtcatgctttataatctttttaattatcaggtactatttatttaattgagacaaattgttaatcatcttttcaaaagttccctgaggttgttggcctgctgtaggaatagcaggaaggaatcagagactcttggtgtgtcttctggtaaaagagacatccagctttcctaagcgcttggagtatgaaagagtgacaggttttagaaatccacttcaccctcccccctccgcccccatgcacagggtaagtatctttcattcctcagtggccacctctaggcaggtagtgtcttctgcttcaagatgaatacaacctaggcaggcaggagagggatttctgtgccctcacagctgctaaaatgtcagagctgagagcctaggattgtctttccctcctggcccaaaataagttgttcacctgcctccaagaaacactggtttcagcgataaatctctgcgtactcataataatgaaggtgggtaccatggtaacttggatggcagttttgaagtccaaaattggtttatatttaagattttccttaaagatttgctattcattctagatgattaccaaagggaagtacgatttcttttcttatgaacgatttaaaatgcagcatgtataccacctggaacagaaaaatacatgccaagctggaattattttttaacatatacttccattcaattcaagatgtttgttgtgcacctactatatatcataaacaatggcaggtgctgccaggacagaaacaaggaaaggatgtaatccttgtctcaaaggagtttttagtgtaatagaaggtatgtccatcatctgttgcgacagtaatactgtgtaaaaaatcacccccaaactcagtgtttaaaaacattgtttatgctagctcatgcatctgtggttcatctgggtattggctgaaccaagctggccttggttgagcctgtctgtaaggtacaggttggaggaagttctgtctgcttcacgggtctctcattattctttttttttttttttttttttgacagagtttcactgtgcagtggcacagtctcaactcactgcaacctccaacctctgcctcctgggtgcaagcaaaaattcacgtgcctcaccctcctgagtagctgggatcatagaggtgtgccaccacacctgactaatttttgtatttttagtagagacaggtttttgccattctggccaggctggtctcaaactcttggcctcaagtgatccacccacctcagcctcccaaagggctgggattataggcatgagccactgtgcctgcaaggggctagtgaggcatgttctcctcactgtgaaggtagaagattgagaggtcaagccagctgcacaaatggctttcctctaacattttctgccaaagcaagtcacatggacaagccctatgtcactagaatgaggaaatatactctgtctgaggtgaactgcaaagcatatgacaaaggatatggggacacagggagggatgcaaaattaggaaaatatatagcaggtgcgcaaatgtcttgaattgaatggtaatgctaatatgttaaaaataatacaatcaaccacattggaaaagataaattcacaaatgtctgtataacaaagggtgggggcttcacaagggaagggatcctatcccaaagacaggaagaaaacttcttaaaggagatggcatttgcagctactcaagaaaggtgtttgtatttcaagaggctaacatgggaggttggggcagcacataattcaaagatgctccatgagcacagcgtggatgcacataagccattctcagtgttaggttataaacaagcaactgaacagaaaaattgcagcgatagaaaaaggagatctgtaagaaaactacaagtagggggagacttcaggtctcagaaatttttgtattgcatgttattgctggaagttctttgagaagatggtatgagtgttaatttccagggtatgaaatatgcaaaagcatataagcatagagcttttgtttaaatcttgagaactataattagagctggaaatgacttagaaattgtttagctcagttcacttattttatagatgaggaaatatgtattttgaagataaatgctctatgtgtggatatgtatgtgtagctatatagatacatacctatacagatagttcctgattttactatggcttaaatacaattttcagactttatgacggtacaaaagtgatacacattcagtagaaagtgtactttgagtacccatacaaccattctgttttttactttcagtacagtattcaataagtcacgtgagatattcaacacttcattataaaataggctctatgttaaatgactttgttactgtaggctattgtaagccttcagagcacatttaaggtaggctaggacaagcaaacatgtttggcagattagatgttttaaatgcattttcaacctgggatatgttaaatttatgatgggcttatggcccgaaaaccccatagtaagctggggagtatcttcatgtgtgtgggtatatgtatgtgtgtaaaatatgtaaaatatataaatatgttaacagagaaaatacatttcttcctaaataaaaccatatatgtggtattattaccatatatatccaacgtgtatatatgtattattatatccaatgtatattgtatataatatccaatgtatattattaaatatattatttatataatatatattatataatatcaatgtatattatgtagatacaaaatttatattatattggatctaataatacatatatacattggatatatatggtaataataccatgtatatggttatatataatatacattggatattatatatatcaaaaatatatcatatgcaattgtatttagagagaaagactaaattcttctgtgtatattgagaaaaagagagaggaaatgagcctacttcttgaagtggcattctaaagaattcttaatccctcacaaactttaaaactgctgtgtccttatcagcgatctttctagttccaaggaatagaatatggctcatactattcaaatgcaaaggggaggttgttaataagaagaaaaaataaacatgtttccagttacccaaggactggaaatgctgtgtgtaatgcctgagctagcagaggcctttcattggctccccttgtctggggcactgttttcaacagaaacgggagcagacactgggagaagtgagccaaggcagcaggtgtcctctgcgcctactcactactcttcctgtcttctgaaactcactcccctcatttgtaaatgcaacataatcacccatctaaccaaaatataattagggaggtaaatcagtttgtgtatctagtatatgaggtttctccagaatagaaacaatgaaactttgaagttgtgccctaccgtaatccccgttcatgtagactggaagttgtcaaactatgacctgatgggatttgttccctggtctagacagggactagtccagctggtctgcttttataaattaggttttattaaaacagccacgctcctttgtttacactctgtttgtggtagcttttgcacaacagtggcagggcttgtcgttgcaagggggacagagcccatggcctgcaaagcctcagtatttaatatctgaccctgttcattgcagtctggtcactcctggtgcagaccacagggaattgttgctttctggaatgggcgacacgtgcatgtgcttggtcctctgggatggcattggcaggagtcggcccagggaggacatctgtggaatgagaatgttgcccccatgaatgttttctctaagaaagaaacaggtgctggccgggcacgctggctcacacctgtaatatcagcattttggtaggccaaggcgggcggatgacctgaggtcaggagttcgagaccaaactggccaacatggtaaaaccccgtctctactaaaaatacaaaaaaacttagccggccgtggtggcgcatgcctgtaattccagctactcgggaggctgagtcaggagaatcgcttgaacccaggaggcggaggttgccatgagccaagatcacgccattgcactcccgcctgggcgacaagatcttaaaaaaaaaaaaaaaaaaaaaaagaagaagaaagaaaagaaaagaaagaaaccagtgcttttgctgcctccctggggctctgctgaggccatcatgattaacctttgttctctgtcctttgccagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggtaaatggacactgacctaccagctatgggccctcctggtgcaccatcctaaaacagtggggacagtgccaccaccggagggtcctcttcttgcaagccatcagagatgggggcgggtggtagggaggctggcttttgcagagaaactgtctctatggaatcatgaccctggaggccacaagtttccctttcatcaaataatgtccacttcttttttttttattattatactttaagttttagggtacatgtgcacaacgtgcaggttagttacatatgtatacatgtgccatgttggtgtgctgcacccattaactcgtcatttaacattaggtgtatctccacttcttacgggagttcttaggggaattctggcacattttgcctgggagttgaggttagtacgacttttaaatgtctttactcttcataactctcacagttacttcagagcaaccatagatagtgcaaacagggtatctaagtgtagagaaataggaaacaaaaggctaactcaagcacagttagcttagaaactatcctcgcgcccacctgctgttggtccctggagcctggaatctttgtccaagctgtaaaaatgacctcgtgtgttttcgtaccacgggccagacggtgcccactgtgggtgataaaacactcagctgtgggctgtgctcatgatcacttgccattttgtagtgtctccttagatttcaccagcactcttcttacatctgggttaatcctgcatcttttctcaagcaaaattctcaattacacagtgcaagggcaaggtccattgaattaaatctttagtgcttttaaaaattgaaggaagtcgggcgtagaggcccacgcctgtaatcccagcacttgggaggctgaggcatgaggattacttgaagctaggagttagagacgagcctgagcaacaaagcgagacccctctctccacaaaaactggaaatattagccaggcacagtggtatgagactgtggtcccagctattctactcagaggctgaggcaggaggattgcttgagcccaggagttcgaagctgcagtgaactatgatcataccactgcactccagcctggaggacagagtgagaccctgtctctgaaaaaaaaaaaaaaaaaaaagaaaaatcgaaggaaatcccagcatggctgctttgcttggaaacctctctcaggcaggaagaattaaagcccagactcacacttaggcgccagacatgatctgcctggactaacagcccttccttatctcatttgctgcctagtcaaaagatgaacattcgagaggctgaaatgtgtaagatgcatcagggacttaaaaccaacagcacgaccagcaacctcagggagtttgggggaggggtcaagaagtaaaaaacactatggtgggtgaacaaacagaatctgggatttacaagcatctgaggccagtgatgccctccaacaaaaccccagctaaagccggctctcagcttgctctctctttcgaaagccgacgtctgaaaatatttcagatgacagcccattactttttgcagattctttcccgtgctggagagcagctcgctgctcctctacttcagttggcttcaagacaaaaccatagcagccatatgttcagttagtcatgagtagccagtggcatcgagaagcaggaaaccaggaggttttcttacatttttcctccaaggaattctggaaagagaaaatgttgtgatgtggtggaaacaagtttcaaaactttgtgatttagaaaagttcacagctttttctagatgtgtttcctcttcatttaaaagaaatggcgaaggactgggttctttaacatctaagaattggagcattttataaacatttcattttcttttcttagattagaaaatgattcatttttggaatccctatctttgtaaaaggtgcttcccatgcactcttaatacaggctgcaagtaattgtaccctcttttggagggtccttttgaagttcagaaatgcagaaaccacttttgctatttgggaatggaaattcttgcgcttctagccttagtggtcctgcctggccccttgactaaccattattaagccttgatatctgtcttgtatgttaacctgcttactttgaaagttcaaatatatttgtgtagcctcccctcatgtctcccaatgacaacagtgatctgtatacatagagataaaaatgaggggaatctgcagctcaccaagttaagaacacagaatcccacatatgggagaaagtttcagatagatggtcttgaaagactcaacaggccatgaggatggatttgtcatcagcacctactaagggtgccctcctcttctgagggcatctggaaattgttatgttgatgcagagaggccagagggctgccacagttgatttcattatggctggttctctttagttttacagctgggccccgatagtggccacattctcagtggcagtagacttgactttggaagactcatcactggtctagagcttaattctcccaaaggagatgagactgcctatcctatccctagcatgcagaaaatgctcatctgggaagctatctttaaagtcactgaaaatgactacaactgtattgttttgtcattatcacatattaccttttattaatagtagcattaaacatcattgcactatattgatgaatatattgcaataacgagaggaagtggtaataaagaacatatttgtgaaagctgtatgaaatctggaatcaactgaagaaaccccataggtttgttcaaccaattttcaaaatataaaatgtggtaaatgttaaaaataatattgcttcagaaagaacctctctaactggagacctggaatcatccttttttctccccctaatcctacccaaccagtagagtcctgttcaggtgactctacttccccagtaccttgagtccatctctgtctgcctgcctggatgcagacttccccagccattccttcttatacccatctccatggcctccagaggaattgtttcaaactacaagtctaaccatttactttcctgcatgaaacctccaataattgctccctatgacctacaggaaaaattcaagttcctccacagagcacgtaacagccttcataagatgctcttcttaggtgcaaatttcatctctttcctgcatacacgcaatgctcccttctgtagaaccatcttatctgcatgtcccaaaacacatcctatctgtgcatacgatgatgtgtgcatgcctctctggcttgtgtccctctccctcctctgcctgctgcccctcctcgagaactctctgaacagacttttcattgcttaaactccagtgaagcatcccctgaatgtagccttccccggctcacccccagtgagctaagggtttttttctgggtgtctgccttttgggtacagaaagctagagcattgatggacttggaattctcaactcatgatgagctttgagctttataagggcagaaatatgtcatatttcatttttgcacttttatgacattgtaattaagtgaacacaggcgtgtcaaagttttaagtggtcattttggcctttaaaaggcttaaagttccctttggttaatactctaagcaaggatttaggaagctgcagtgcaacagttaaaaattcctcatcagtaaaagtgaggtggttgggaggattaaatgagttaagacatgttaagttctcaaacacatgctctgaagggaaccacgtaggaggcactcaataaatcgcagctgtcattgtcgttgtattgtccttgttattaacctgcctggaagtcagcagttgttcttcattgacttaaccatctgacaccccagaagagatagagatatcaccctaataatgagaggaagtggtaataaagagcatatttgtgaaagcggaatgaaatctgggattaactgaagaaacgccgcagatttattcaacctatgttgtctattccctactgaataatatttatataccttaccctagatgtcaaagcagtcccctgatctcatcccaaaagacaattcttgccttggttttgactaaatcctttcagacaccctaagtttcacctcatggataccctaaccctcccatggacttgccccttgctttcctttctctgggatgtgtctattatcttactacctggactccatatctattaatatatatgcaaattggttttcactccacatctatgcatccaaattatttctctctttcaagggcccctttggaaattatgccatggtggcttccaagtttccaaagacccctgggtgcccggtgtctgaatgttcacttcattttctactgtatatctcttgtgtaatttttcaactctatgatacatcatagtcacttcttaagtccctttctaaattgaagtcttggaatgaggagtcaagaaacttatctgtagtctggttgtacaagtcatataatctcactgagcctgcgatgcttcatcttgaaaaaaaatgatgtttattctggatgatttctaaggttctctccatgtctataatgtttgaatgtgtgaactaatcataaataatacctgctgagccatgaaccaatttactttcttttcatcccaaacctagcaaatctataagagtttgggcaaaacctaaaatctaaaattattgatctaaaataatacaagcctataaaatagtctctttaccaaaactgaactaaacaagtatttcattaaatttggaattcagtttcaaaagcaaagtatacattttcctggaccaaatatattatctttcctagagtgtagcagattttgctaattttgtttctaaagaaaggaaactagaaccaagagtttaagagcaaaggttatcatatgatcttgaaaaacaaagtgtctttataggcgtcacagatggccaatcactaccatagaaaaacaaattcagtgcaagcaggattacagtcagcctcaagaaagaaactcaaaacaaagggaaatttcaaagctaaaagggactaatcaccttttgcaaaaccacaaagcccactggaacagtgtgacctgcctctgacaagctgtttttgttctccatttttggagtgtgtgcttcactccttcctgaaattctttgacttagtagcacgtggtttttgaacctcattattcccagggcctgagtgtctaagagtttcctgggcagcctaccaggaggtgggaggaaggtcctcgttagcacttttgtgaggctgctgggaagccttggatattgcgtgaaacagccaaggtgcagaagtgtccgaagtgaggcgcctagctgtagaactgcccgagagatttgagaagagcagagagaaaatgaaaaatatatatacagcctcggtagtagaatgaaatacataaaaatatacatttatttataaaatattaggttggtgcaaaagtaattgcggtttttgtctttatttatctattttgagatcaagtcttgccctgtcacctaggctggagtgcagtggtgcgctccagattttctgcaacctccgcctcccaagttcaagcaattctcgtgcctcagcctcccaaatagctgggattacaggcatgcaccaccatacctggctaatttttgtgtttttagtagagacggggttttgccatgttgcccaggctagtcttgaactcctgggctcaagcaatccacccgcctgggcctcccaaagtgctgggattgcaggcgtgagccaacacacccagtcggtttttgccattttaattgcaaaaattacagttacttttgcactaacctaatatttatagactatggatattagttacattaatataccataagtatactgtacgtgtttttatagagtaatatatagagaacttaaatataccatgaaataagtgtttcctatatataaatatataaattatatagtgtgtatatatataacttatgcatacatattttttaggagattagaaacgatgtttagagaggcatctaaagataccttcctgagcattaatattgttctaacaatcaggtaagaaaatgtttataaaagccctttgtaaacttcgtgattcaacacaaataaaagacattatcattaactataaaacagacaactgtttttcaatgtaggtatacttcagccaaggtcctgaagactgttggaagttggatgatctcatctgatcctcttatggaagactcttttccctctataaaccgctcattcattcaacagatacttagcaccagctatgaaccagaaatgagacagcagtgaacagccccaagtcccttttctcaaaacttacattccagagtgaggagacagcaaataaataagtgaataaataaatatataatgccacccagggataaagactcctgaaaataaaggggaggaaagcaggggatgctagtttatacaagcatggttggggacaaatttttctataaacagattggctctgagacctgggaaagtctggagggctaagggaagccatttccagtgctcagaggctggagagcatttgtggtgtgcgggaaatgacaagcaggccagtggcgttggaggaatgaggtaaaagatgccgtcagagagccccggggtgcagatccttgggagccctgttagactctggattttacacttggagtgaacgggcgccatcccgaggctttgcacaggggcaagcttcgagttccgttttccaagacacctcgggcagataggggtgtggggaatcgactgtaggagctaagggcagggaagggagtctgattcaaggacacctggagtgaacgggcgtcatcccgaggctttgcacaggggcaagcttcgagttccgttttccaagacacctcgggcagataggggtgtggggaatcgactgtaggagctaagggcagggaagggagtctgattcaaggacacctggagtgaacgggcgtcatcccgaggctttgcacaggggcaagcttcgagttccgttttccaagacgcctctggcaaataggggtgtggggaatcgactgtaggagctaagggcagggaagggagtcttgttcaagggctacagcaacaatccagataacacagttgttcttcctcaactaaagagagttggattgactcagaaggtctgttcaattgacagaaggtcaccttgctagactaatatattcacttcccatagcgttttcagagcacatgcatatctgttctctcattgcatcctcattatatctgaagtgtcggctcaccacctattcattcccattgcataaaggacagttctgagaagcagcaacgttaagcctcctgcctgaaccaggtgtgactcctaacccagtgttctttctgctaaaccaaggtacatgcccgagctttgtctttcatatcttactttggaccagggagcttccaaaccagggcagctcaagaactcacttttactgagctcctggaactttccagggccaaggcaagatatttacacacatcctctcattactccatcccagctgcctcccagggaatgggatcctccctattttaagacaaaggaaatactcagaaggattgatttgctaaatgtcaggcaagtagggacagatgacagatcaggaattggaaccatggtttttctgatccaatcctcttaagcccagataatagaaataatgtagttaaataatcagataaatatggggaacccattcttgcatttcctctctatagagaccaagacaggaaagggtaacatcagcctcggacccagacttgggcgagggtcaggaatgccccagggcatccccaggcgtggctcccctgctggcaggttgctctgagcctgtgttctgtctctttgtgcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgt

SEQ ID NO: 37874 - DNA, 261381 bp, Homo sapiens
ccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtgagtacagcccccgccgaccctgctgggggtggcccgaggtcccgggagggccccggatggccccttgcccctcccagctgtgaggtcgcgaagctaagcgcccactgggcagccagcagccgtggagtttcttcgcagggctgtgatctccagggaagcctcttctgtccttcctccttcgcacccccgcccccccggtttctttttttggcattggaattggcaagtggctgcccttgtctgttacaacggtgaagtcatctgtccgcctttgatggatggtggggggagctttcgtcaacccctcacagagcagccccgtcgggaaagcgcatctcctcggccctccccaggggccctgggcgctcacgctcacacagcccgagatgctttcagagctcgccctggagaaggaagcctcgcgccctgcctcccacgccagctctgtctctgccttcctaggcctggggctgggggcagaaggaagccgccgcccccttgcccaacctccaccctccgcgctaagctttgatttccctcataaagccattgtgtccgtcggtgtgaggagaattgtggcttttccttttatccctcctctggacgtgacccttaaccgggttcatttcctcttaagtgatgctccatctccagacacgaggaggcgaatgtttgctgtggtctccgaggaaccgcccctcccccttcctcccccaaactttaatgagaaggggttaaggttgactggggcagctccagagcctatgtgacagttcccctttcatctcagccggtcctgtcttcccatccctcacaccttaggaagtaaacacggtgtccttgacccctctgagcgtctgtgctcctgtacttgagatagaagagacccaagcacagaggactgcatgttatttgcaaattgggtatttagaggagcagttccagtgctcaaagcattaatcttaacagttaaaacaggcgctggttgctgccctggattgtacattgatctctgaagtgccttttcttccactgttgcaaagggactggggtttgtggcaatgtcagcctcgggctactctttttgcctttgtcaccagtgtagctctgaactttgagtttctttacagctgagcaaatgcggctgggctcatatggggaggaggtaaatgtggaggcaggttgactaggcagggaggtgggtgcctgtcgggtccagtccctgacacccttagagagttgtttcttttgtgtcatctggtccagcaagcattttctgctgctgttacaagaaagctctttttggagggcttgggtcaccaggtggtcaacctgctctgtggacagatgtccctttgtatatcccagggtttatttttctcaaatgttgcaggctaagttttaagggttctcatttgtagtcctcagctgagcttggcactgcattcaacagatggcactctgctctgagacccaggcaggtgcgtttccaactctggattttaaatgaaacatcacatttcagctcccaccgatggtgcccaaggttgcagatgcaggacacactggtaacaaactagaaccggggcccactgcagacaggattgaaaggcaagattgcgtgctggggttctgaagttagacggtcttgctcaaagcctggcatgcagccagtaactagctgtgccaccttggcaagttatttaaacctcccccagcctcagtttactcaatttcaagtaaggataataatagtatgtacttgttgggagaattaaatgagatcatctatgtaaagcacttagcccagttcctggcacgcagtaagctcttattaaatggtagcttattattggtgagattctgactaagaaagtatttttgaaaagcagctattaatggtctggcaaaaaggaagaaagattttgggttttaagattgataataacttgttctatgtgaaaaacacaaaagaagtcctgtccagttccctcgaaatgatcatttccttcctttttacagacaaagtgtttcccgggacatctccgcttcccgagtaagaatcgatgacattatgtttgggggggcagggagtgatgtcactgaacagatggggccatgcagagttctgaactagagttctggaaaacactgagaggagaaagtgttacatgttgtggaattgtggaacgggcagagacccgaagactcatctggctcaactccttcattttacagatgaggaaatggagagccagattgggtaaagtaacttgcaacacagctgctcacagctgggtttttttcattgcatgtaccctaagtccagttgggtttggctaagaggacaaataactggtggtcaaaaagtttctacccatttggggcattgtatatattaatacataacataagcatatccaataattgaaagggggaaagaaagcaatagaaagggcctggtgggacagacaggggcaggaggagcgggtttggggaggctgcagcctcttcctctcctggcccttgcacggtgaataccacacaccaaaagctcaagtgttgtgagtaaggccctctggtgtggtcagctggcaggacgtgctgcacccattgcctgtgttctggaaaccctctacactggaggagcaagcctccttccagcctttcctctgctgatggtgaattctgagtctgtggtttggtaaattgcagagcagagaggttttacgggatgtgcgtgttagccagagctagccgatgagaggcctggggcccacgcaggaggagctctgctggctccagagtgctgggaacacactgcaaaggttctctcaggacattctgcaaagggtttgctcatccccacggggagggggagctgcctgaacacgaagggtcctgtgctttcggtcagttcatgaaggcacgcaagtagcttccatcatggggatggcactcagccctggcttccttcttctctgccaggcccctgcttggggtggggttgagaagggcaggcagctgctactaaggtcaggctccctggcatgaagctaggctcctttcctggctttctgagctgtgcctggggagaccctaggtaaactggctttggcctctgaccgcttgtcttgaaaatggtcctgatgatgctggatgcagaatgcagattccttcgtttgaaagtttttcagtaaagatttgaattcaggtccaccgggttctttgtgctcacaggcaggtataggtatatatcaattcatgtggtagagaaaagctcgtttatctaaaacaaacaagaaattgtatctatttggatttgggaggtattgcactttcacagttgttttatttcctgattgtttatttcagacaaataccaatcatgaatgttctgatcctctgcaggactctttggggaatgcaaataatagccagtttagcagttaccatcgatggtgaaacatacttaacactcgtgttttcgtgtgattcctgcaggtcattgaatgtaccctaatgtggggtaggtttttggattctgttttacagatgaattaactgcaacttggagcaattcaccaacttgcttagggtctcgcagctggcacagggcagagctagggcaatgcaggtcaggttagctccaaaggaggatgtggatataaggtggggcccttctcttcaattagaatccgggcaggaaggccaggctcagccctgttccatggtgacagagcagtacagggttgtctttaggactgcctcactgtagagacatctaccatgtgccctgcaggtgagttcatggtgggcaacgcaggcgggtcactgtgaggcaggaggagtagagcaacttcaggctggtatctggtccccagtaatgcttagggtaataaattaagggttgaccttgtggacataatatattcttcctctgtttagatcatcccagattttattcttggtcctgggagctacatgcttaggaattggccccaaactcattcatttctgtgcccttctttttttttttttttctcagcccttagattgtgactccagccccacaggaatgagaatgtgcagccacagcctgcaagggtctttttcagggccagttccattatggaatgagtatggtgttgggcagatcagtgcttgaatcctacctgtggcacttcctagttgtgcaaccttgggctgtcactctgagcctcagtctcctcacctgtaacttcacagggctcttgggaagttggcctgagataatttggggtagtgtctacccagtgcctgacctcaccatggacatgcaccatatactagttgccatctgctgttcctgatcaccaaggcactgcaggtgatttaggacccaatcggtcaatctgagagaaaaggaaagactgaggcaagaaggacggcccagcttttcacagtctgatggggaagtgggttacacgccccatggaaaacacccagcctccaagaggaacagataaacacagagcagctgttcagacctggaggggttcctggagctgagcattgggatctggtggtggctttctggtaagctgggaagaaacagaggttaggagagaaggaaagaggttgctctgggtaagggcaaggtcaaataggatcctagccccaaggtcagcaccacacatgggttaacactcttgcctgctctctctgtccctctgtctctcttacacatgcacaagcatgggaacggtttcttctctggggagggaagtgatcgaggggtgattcacgggtctgacaaggctccctgctcatggaacaaccaaccacacccttcaaggctgttggaacagggagcacagccagccatttatcgcaaccctgtgttgagctgagtgagggcttttggggggcaaaccagggtagaaattaccatgtgtggtggcaggcagaggggaagggaagagaagggaaaaataaacctatttgatgtcagaggagaccgattccagcccagaaatacaagccccagctgctgcattttccaaagagatattccggggccagcatgagttaactgaccgtggaggctatgaattagggaagtgttgttaggacttctgactttgggtttgcacagcagttccctgtaaattgccttctaattgcctcagcctgagtcactgaccagactatttcttggccagaaaaagtctaatgggcaactgtgttctcttttacctcttaattaaacaaaatgaaacaaataatagagttatacacatggtagtcccacttactcctctcgagttctgagaatccaggaaagggatagtagattaggatagggacccaggggacaggaaggacaaggggtgtgtgtgggaaatgaggtggagattctggctttggaaataggttctgagtgagggccagaggtgttctctgccatgacaattgccaaaaataatggaagcgcccaatagagtgatcagggcttccagaggcggattcccagagcagcgtgctacttcctgcctggcccgggcttctgctgcctgtagtgcagccagtcacaggtgggcaggtgaatggaaggtcaggagcctagctgtgaaggggatgggggtcacatgaggatccctcttgtgcctctgggtaacccccaggcaagtcaccatatcagccgcagagactgagcccctgctgtgtgcatggtgccggtcagagtccagcaaggctgtccagaccccataagaagggggagaactaacatacaagcacctactatgtgccaggcaatgcagaagatgcctttagaggcgattttacttgaacctcataacaaccccatgcggttaggtaggtgtttttattcccattttatagatggggaaattgaagctcggagggttcgtatcattctactcagagtaattctgtggcagggctgggattctcaccctggtctctgacacccacatctgtgagtgccacttcttccccatcagagctggcttggtgagagagaaaataaccagtgagtccaggcagcaccacctggggatgaggggtgcacctgggaggctgtgttgtcccagagcacctgtgtgccgtatcccttggctgagcattgggatatcctggccccaccactcgctgccgtgggatacagtgcaagttacttatgtctctgagcctcagtttcctcatcagtaaaaaaaaaaaaaaaaaaaaaaaaaaaaagaatatatggggaaagttggacctagctcttagggttatgatgaagatgaaatgagtttgtaattgtaaagagcttagaccggtacctggcgccttatggagctcagcataagtatttgctttcacaatcactaagtcctgaagctgttcagaggagggagagcactctgtgaactggagtttccagggaagaccgactggagaaggcagcttcatgatggaccttgaggtgtaattaggatttggctgggaaagagtaggatttagatgggaaaactggggaagggcattccaagaaagagaaaagcaaaggtgctggaggtggaacgtgcaaggaaaagctgggcaaagccgagggtggatgagggagagaaggatgacaggaaagctcagggccagctctgagaggctccgatggcagcagagggaattcagtttattctgtagacaccttggaaccttccttttctcccaagggcttggcagggagagggagctaaatagtcactttgaggtcctcccggtgggctccagcgctgtttttgcgactgtgcctggaacagagctaagtaaggactggaacctttttctagctctgcctgggggactctttagttggccagctgggtcccacccctcctgtttacagctctcactcctaggggtctggcttccccataaaaagttgattgcacccaggctcctggggaggaagggttgaggaggaggaggaggaggagagggagcagcaggaagtgaggtgtcagctgctttgggtcttaactagcttgggagggcctgatgcagcagcgtttcaggtggagtaatttccatccacactcccccagtggcaagagcgagaatgcgcccatcctcgtaggttctgggggccaatacctcacagtctgaggggagcccagcatgtctgtgtcttctgaaccatctacactaatgttgccttctacttcaggatctctctgaacttgttttagttggttttttttttttttgagttggggtctcgctctgtcacccaggctggagtgcagtggtgcgatctcggttcactgcagcctccgcctcccgggttcaagcgattctcgtgccttagcctcccaagtagctgggattacaggcatgcaccaccacacgcagctaatttttgtattcttagtagaggtggggttttgccatgttggccaggctggtctcgaactcctgacctcaggtgatccactcgcctcagcctcccaaagtgctgggattacaagtgtgacccgctgcgcctggcctgaacttgttttagttttaaatgcagtgcttcagctgggcatggtggctcatgactgtaatcccagtgcttcaaaaggccaaagtggggaggatcacctgaggccaggagctcagaccagcctggacaatgtagcaagaccccatctctacaaaaaaattaaaaaataagccagaataagccaggtgtggaggcatgcgcctgtagttccagttactcagtcggctgagatgggaggatggctggagcccaggaggttgagcctgcagtaaaccgtgatcacaccactgcactccagcctgggtgacagagtgagaccctgtctcaaaaaaaaaaaaaattctaaaaagctaggcatcgtgatgaacacctgtagtctagctacccgggaggctgaagtgggaagatcacttgagcccaggaattggaggctgcagtgagctatgattatgccactgcattccagcctcggcaacagcaagaccctgtctctaaaaacaaataagtaaatgcaatgcttcaaactacctcttcatttatttgacctctaccacactcccagatagtctagtaaaccttattcttagggaaaatgtaacaataaaaataacagctgacctttctaaatgttttctatgtgctaagcatctcatatggatgttctcagaacagccccacgcagcatgtagctcccaccagcatccatactgtacaggtgacagcacaaaggctcagagagctcaaatgaattgccagatgccacgcagctgatgagctgcatgtggagaggcctgcactgacccaggtctgctggctccaaagcctgccctgtccccacagagaccgcttaatgacacattacacacccaggatgcctgggctccatggttccaccttaggcctagttggttggctcctcaagccgtgagatcttccacatgtcacctcccccttctagaactacatttgcccatctagaaaatggtgcaactgtttcttttcaggcttgccttgcagagcggagggcaggtataacagctgctttggaaagcactgagcccagagatgatagctgtgtgaggaggtcccttgatcccccagtctgggttcttaattatctagggcagggatgctatacaaagtgagttgttcctgaccccagggaatttttaaacaaggttcacctgcccagccacctctcctgagaagcctcatagacagagtcgactcaggagtacttaggctcttagtgaagatctcttctagaaaacggcctctggttttccttctttccaaaccaatcatttttttgtgaacaggaaaagacagagttattcccagtcccatctctccctgctgttacctgagcggaggaagtgatatctaagtggctgagttagcaaaggggaaacagctgtggtttctgccactccactgggctgctttctctgtccctgtgctgtcatttccctttggctggcgaggaagccaccctccccaagcctgggcggaggcccatggctgggtcggggtagactctgtgtgtgtgtgtcaatgcagcataaattatgcagtggggcgggtgggacaatttagcctgtttctgggatccctggagcatgaactttagacctgttggaaactgatcactcttacctgatctgaccacaacttcagggagtcaggaatggaagtaatgccccatgttgagaatgaacttgcagggtgtaccaggtggggtagggattgatggagtgtgggctggtttgcacttttgcctatcactgtgtggtccctgatggagaacctacgttgttttccttttttgaggcgtactctcactaaaggagaccttggcacgtattgtatcaccatcatcatcatagagctgttacaggaaaggggtcccgatccagacccccagagagggttcttggatctccagcaagaaagaattcagggcaagtccatagagtaaagtgaaggcaagtttattaagaaagtaaaggaataaaagaatggctgctccatagacagagcagccccgagggccactggttacccatttttatggttatttcctgatgatatgctaaaccaggggtgtattattcatgcttcctcttgtgagaccatatagggtaacttcctgacattgccatggcatttgtaaactgtcatggtgctggtgggagtatagcagtcaggatgaccagaggtcactctcgttgccatcttggttttggtgggttttagccgtcttctttactgcatgctgttttccctttttttctttttctttttcttttttctttttttttttttttgagatgaagtctcgctctgtcgtccaggctggagtgcagaggcgcaatcttggctcactgcaacgtccacttcctgggttcaagtgattctcgtgcctcggcttcccgagtagctggtattacaggcgcacaccaccatgcccggctaattttttgtttttttttttttggtggagatggggtttcacagtgttggccaggctgatctcgaactcctgacctcaggtgatctgcctggctcagcctcccaaagttctgggattacaggtgtgagccaccacgcccagcctactgcatactattttatcagcaaggtctttatgacctgtatcttctgctgacctcctgtctcattctgtgacttagaatggctaaacatctgggaatgcagcccagtaggtttcagccttgttttacccagcccttattcaagatggagttgctctggttcacatgcctctgacacagctaccacatattgaattcccattttgtgccaggcattgcatggcctttgatttataacctctggccccagggtggccatgaaggtatgcatttttaaccccatttgactcatatggaacctgaggtttggagagtgcaggtagcattgttaagaaagcacaaacccaggcagatgtgacctccctccccttccccagcctgcgcctggttctacaccatcactgtgtcttacacacttggtcccttttcagggcacccagggctacaggggcttctgtgagaaggtgctcctcatggggaacttgccctggttgcttttgcccatctaagtgttcagagcatatagggattgtccctgtcctttgaagtgactgctttgtaaactctttcatgataggcccaattctgacccagcgttatcccatttcctgatggcccagacccaaaaggctattttaagggacttgcctgtgtgggagaatttctctctgtaacaacagaggaggaggcctggccggcctggcatggggctggcagtggagctccgagagggtgaaactctgtcctgaattctgcctcctgggctggaacagattagttgagccctcagcgcagtgcctggcacccagaagggatagaatcacttcttgatgagtgtgagattcccagaggtggcagcccagggatttctgctggtcagagcctcagtgggctggcaaactgatgcttctcttgcagagttaaggtccgtaatagaacaatgtctgcactttggtctcaagctgggattaattactgactttagtcatcactcattggcaacttgaagcaagcagcctcatgttttttgttatttctgaacgtggcagctcccaggcaggggaagtggggatgtcaggttagagaatgtatgggtggagtccattttagatgcaggcacttgtctcatttaatccccacagcaaaccctggtcatcatctgtgttttataggggaggaaactgaggctcagggaggtgcagcatcttgccccatcactggcagcaacagtgggagccagggttgcatcccagatctcttcaggaacaaagcccgacggctttatctgacagcttccctaggggatggggagctagggagctcgtcacataggtcctggataaaaccccaaagggctgaattaaaccccaggtcacctgcccatgtgaccctccctctgagcccctccctgaaaacatgatgtggttggagcggatgttaagatatgataacaagcttgctataggaacagatctgtgccaaggtctggcctctatttgcaggttcaaatttgtattccccttgaactcttgcccagggccacttttgaaggcctggcccttcagagggttcagctgccagtctccacatcctcctcttggggatggtggatagcatggcactgtggtagggagcatggaggagtttaagttcctggtattttcagccccatgcttgcttaggcaaaaccaggctctggaaaccagagtaagcactaagagagggacttgggtgccagcagttggaagttgagggcaagaggataggggcagagcatcggcagctgctgtcatgggctgtggctctgaagctggctatgaatcacagccctgccactcattagcttgtttcacttggccaagtttcttcacctcctgggcctcagtttcctaagtaaaatgggtataataatactactacctaacccatatggttgttactcatatgataactgttccataaacggcactattgctatcaccagcgttatcatccttcttgattttgctcagtttctgccatctcctggaagcttccctgacctctcatcttaaaatgacatttccagtctacgaatttttataatgttaactgttttacctctcatttaacacttaccaagaatgaccttggattgttcagcctttggcaagctgatacttactcatattcattcattcattgtttcattcagtcaatatttgaatgtttactatgtgtcaagcgctgggaacacagcagggcagataaaaatccctgcccgtttagagcttacattctggtgtgggaaaggaaacaataaacaaacaaatgacaccctgtcatttgcagcaacgtggatggaactggaggtcattatgttaagtgaaataagccaggtgcggaaagacggaaagacgaatattgctgtcctcactcataggtgagagctaaaaagagtagatctcacagaggtagtgaagagtagaatggcggctaccagaggccaggtgggaggaataaagagaggttgattaatgaatacaaaaatacagttgggtagaaataatacgttttagtatttgatagtacagtaaggaaattgtagttaacaataatctattgcatattttacagtaactagaagaactggaatgttcccagtacaaataaaagataagtgtttgaggtgatggatatccccatgaccccgatttgattattacacattgtatacaggtatcaaattatcacaggtacccccaaaatttgtataactattatatatcatttaaaaataagaatacaataacaaaataggtcaaaaacatagtgtatgagatgggggttgaatggcgtagggaaaactaaagccaggtgagggagacaggcatgttggtgatggtgggagttgctgtgctttttttttttttttttttgagacggagtctcgctctgtcgcccaggctgcagtgtagtggtgcgatctcggctcactgcaagctccacctcccgggttcacgccattctcctgcctcagcctcccgagtagctgggactacaggcacccgccaccacacccagctaatttttttgtatttttagtggagacaggatttcaccatgttggccaggatggtcttgatctcctgacctcgtgatccacccgtctcggcctcccagagtgctgggattacaggcgtgagccactgcacccggccttgctgtgctattttatagagggtggccaaggacagccccactgtagaggtggcttttgagtaagacttgagggaggtgaggaagtgagccctgtggctatctgggggaaagtggttgagggagagggaacaacaggtgccaaggccccgaggtggctggtgtggcctgagtggagtgagagaggggagagcagcaggtcatggggtcagatagggaaaagggtcacgttgagccttgtatccctccccaccctgcacagcatgctctgctcagcagtgaggcctcatgatgacctaatggagactgaaactggccaaaacactgccagagaggtggcttcaaggactgcttggggtttgaccctgaccccctttaaaagagacctcctggggaaacacagtctccatcagcagcgtcatgggtaggaactccagggccccaaaggcagggtacacaccaggaagcttcactggctgaacattatttttgtgcctactgtgtgcaaggtgctgtgttgaaagcagtgctccagctgggagccaggaggcaggtaggggcgtgaattcctgcaaaagcagcgaccacatcctttcatctttaacgccccctcctcatgctagcagagggtctggatcatggtgcgtcctggatcagtgtgataaatccctggacaaaggcttcattctactaaagccccttcccctccgacctcatactcctatttttactgaagcttctaacttacagttgctgaagttagttgttagaaactcaaaacacatgttcctatcagtattgtatcgtaaatggtgttaagattctcaagtcagcccaccaaaacttttctcatcctcagagtagatttgtatccctgacaaccagatatctctagttcacctacagcataggctaacctgggagcctaaatgctgtgtgtaacatccagggaaactgtcttccattgttcacagtgagaaggaaaccctaaggctacataacaataacaaccgtaacaacagcagcatgaacgatgtgcccgccactaagcacatcactcatttaatccttgcaacagactatgagaaaagcactattatggtccttccattactcagagagaacagaggcagagagagatgcatgagatgcatttaccaatggtcacaagctaggaaggggcagagccgggttcagagccaggcagcgggactccagagtccttcgcgaaacctcttgtttcctggccttccgggaatcccgccagccagccttgctgcagcccagggtggctgtctgtagaccttacgttcaggacacttgtcattaggtgttaacaagtgtcagggtgagggaacaaaagccacgggtggccagtatgagcagtttctctttcttctcccagacaggaaaaaccatttgtttctggaacctgacactgcagggggtgggcttggtgtatgtggccgccttcctgggccatttacaagtgcagcacatgggtctggggagggggctgggccggggtggcgatgtgtttattggtggaagctagattagggtgtctggcaagatgtttttgacacctagaccattccactcagtgaaacccaacaggtggccaggctgttgctttagctggaagcggggcaacctccccgccctgccctgttcagtttattgttggaatgagatgggtcctaaccagtccttcctctcttccctggccccaaaataaacagcagctgttgttggcgccatcatttctgcctctgccagtctgtcagcagcgctgggctcttgcctggccttgccctttttgatttgatggcactgggcgttgggagccctttacctttgccctacggagcctgccctgctgaccagctggtgtgccctaacatgccctctcccaggcctggtggctgcccactggcactgtcctctccggccctgtagtgaggcatgtgtgcatggcggttgcaaactcggactccagaatctgacatccatttgccccctggttcggctgcttagttggtgactttggggaggtagtttaatgctgagcctcaatttccttctctgtaagggcagctgttagtatctgtatcatgggatgttgtggagattatgttgaggcagccagtgggaggccgactgcctgacgggaatcccagccttgccactcaggggctgcgtggcctctggggaggggctgcgtggccttgggggtggggctgtgtgggcttgggggaggggctgtgtggccttgggggaggggctgcagctttctgcacctcggttttctcatctgtaaaacgttgataataaaagcatctctcaggctggtgatgaggatggcacgggttaattaacgtaaaacagaaaacactcaaaacactgccaggcacagagcaagagctcagtgactggaatagcatatgctctccgtcagagaaggcggagcatcccctgaaagaatccttcgcatgtgcatgttcagagctgacacaattgctgttctcctgacctgacttttgggtctgtactaccgagctaatttgcttggcctcgtgtcgaacctgtgattagaacttccacttcagggtgtaggggtgttggtggaactagtgatgaaggaggctggaggcatgaaaaaagagagttgggatttctattctacttgctagtggttctgctgatgtaatgtaagaaatggaaagaagattatgtccacagccaagggccgccttcagagctggtgagcagatcccacgcggggttgaccatttatctgtgctgatgtgcacgccccaagacgttcttctaggtctgtatgtatgttgatgttctggacaccctccctgtgggctggcagctggggccagctcattttggcctcttcctggctctgtgctctgggaaactcttgctgtctttggcttttccttgctttttctctccattttggaaagattgtactgggaacccccattagaacatccaaatggaaaaatctttattctcaaaaagaaaaaaaagtcattggccctgattgtgttgggccacagtgccagatgccgccgtgggcacaccgatgcctggtaaagatcccccacttaggaccgagctgttacacggtctccccaggagcctggtcctgtaggagaggtggctgcctgtgctgttttgcctccctggcctttggcagtccttgtccaaggagagagggcaatggtagctccattcccaacatttggggtgctgccttctgacacattagtgaagagaatggtctgaaccttagagaggaaagcagcaaagtagttcagagagggggttctgaaaccagactgcctgagttcaaatttcagctgtgccatttattgctgtgtggccttgggtgagtcacttaccccctcagtgcttggatttcctcttccgttaatatgaggataatagtaccttccccatagggtcgttaggaggattaaatgccgatgatggcaaaagccctgctaaggtgcctggtgcagagttagtgctccatgttgctgccatgatttgcacccacaccgcaggtgagtctgcttcccatcagcccagagcccctggggcctgacaggtatatatttagagcccttgagagggccacatggtgtttgtgacagaggtgtcttggatggaacctgtggcatgttctagaggaagggcgagtgtaaagattcaggccagcaggggatttcctagctgagttctgtgaggagtccttcaccctgggggctcagtttccgcagctaaccatgcccatgcctcccttgttggttggctgcagaatcagagacaccatgaggcatccggtagtcactttccttcacggtggctgttcaaacagctgtgaggcttggcgagggccccaagaggcggctcagtgggctctggcctttcccactctttcctgcactctcctctcgagagcagccctgagttgtgcagggctgtgggtgcagcaggtgacggtgtcttctgcaggtactgtgtgtgtcctagtttgcagagctcctcacatccacaacttctctgaggggtgctgctgggaagtgctacagttctcctgcctatttcacagacaaggaaaggctcagagagggtccgtgactcctggaaatatggtgggcactgttgatgcctgccccacgtcccctgggctcacctgagttcacctgcagtgccccagctgtggcatccagcacactgacagctccccacctcacctgtctgtgtgagcactccctcctgggccatggccccagggaagcttgctctgcccaagtgggtgcacctgagaaagacttggggaaggtagggggctaattgtcatccctggaacccaccctcaagtggtggggaatgggagttatcagcctggatccaaggccttgtcttagggtcggcttcaggaagaacccaactaggatagcaaacttctcctgctagcaagtggtagagctaggactgaaaacctctgtctgggactcccaggtccccacaccaggctgcctgtccggtggtgcctgtctggaggtttatgggtttctcgttagagaggagtcagataagaaacttgtttgatgaggtcttcttgataataagagggcaatttcctgagtaggtaaaagaatagagggctgaagaatacttgataagtacaacagcttctaggggcccaccagggaggagctcagtcagtgcaaacacgataggcgggccttggaaacaagggaacccggccttatgtagacttgcctcaggaaacaaacgagagacttagggataatagaaatctaatatcttcatccgtcactcatcaggctgggaggagcagcatcagtaagtgtctaaggaaacggagaggggctgccggctcctgtgcccaggtgcaaggtgacatatatgagcaagacgctctgcttgtttgtagtaaaattccctctgtaaaatcgggctagttggcagagcattggacattatgaacatgaaagcttcttgtgatggtgtttcaaattgtggagacactagtgtgtttttagagatggtgagaacatctttaagaaaacaaagggagaaaagaaggggtgtgtgtgtgtgtgtgtgtgtgtacatgtctgtgagtgtggagtgtgtgtgcactcgtgtgttggggaatgttgcatgtgtatggacatgtctgtgtgggggtttgagtgtggactgtgtgtgttggatgtgttgtgtgtgtatggatgtgtctgtatatgagtttgaaggtggaatgtgtgtattgggggatgtgctgtgtgtgtatggatgtgtctgtgtgtgagtttgtggagtgtgtgtgttaggggatgtgttatgtgtgtatggatgtgtctgtgtgtgggtttgagtgtggaatgtgtgtgttggggatgtattgtgtgtgtatggacatgtctgtgtgtagctgtgagtgcagtgtgtgtgtgcatgtgtgtgctggaggatgtgtgtgtgtgtaataaaagctgttggcatattcctggggcaatcttttatccttgagagccccctatgatcaggctagggggtccaagaatacttagattttagtataaaagggtctcatagatctttgcatatacttacaataaccacctttgatcttttcctccattgcctctttggtgccaggcaggtgcccatagacctcatttcatgctctcaaaagagactgtgtttctcccctttatagataaggggcctgagaatcagaaaggctgagtcactcactcaaggtaacacaactaggaagacgcggtactgggatttgaccagcctttagtccatcctttgctggttcctcgtccagtgaagggggagcttggtgagattcagccaagcctttgctcatgctgaaaggggcctccctctccacttggggcacttgctctagaaacgtgatttctggcttcagtgaaggccaaggaggaagtatagggagcagaaggctctgaggcctggctgcatgaactatagagtggtgcaggtgtgctgtgaggacctgcttcagggaaaagttgttgtgacccagaggagggtagagctgcacgggagactggaaaatcagcgaagacttggtgaggggttgggggggcggccaaaagaccaggacgtccttgagttcacccccctgggcctccaggagaagagactgtagaaaattctagctgggtaaagaactttatgtctagttttcataccctgtgagcatctgtcaacctgtttgtttacatggtctgatttctccaccgtgtggagattccatatccaggtgtgtgaggatggggcaatgcagatccatcgttgtctgctaagcgatttcacttcgaataagggaatggcagagaaacagaccttcccagtctggattcctggaagggatcgcgggtggacatttcgtcattgtgagttcttggcagacagaggcaatggggccacccgagttgcctggctgctcccacccctgcgagctcacgtcagagcagtgggaaatcccacggaagctgcaatcccagatgcaagtctgcatggggcatttgggatttactcccagcctgggcctttcgtaccctttggtttccagagctgctgggagagggcttcctggtacctagccagcttgtgactccaaacaactgcttgaaagcagacagcttctgccagtgtccccaagaaccttaaagggccacctctgccccacctgtgtgctccaacatcagccaagtctgggaggcaggcagactcattcaaggcagcctgagcagcacaaatgttgaaaaattatcctgcaataaattcccaggcccagaactattaagataagtgtgaacctactacagcattaacttgcatgttggttcagctgtctactgacttagattaggttgtagcggcccacatagtggttacaggccgcagggctgcttgagagagttggagttcaccaccggccatgtgactttgggcaaattacttaatctgcctgggcctcagtttcttcatctttaaaatgaggatgataaagtagcaccaactcctagagttggtggctggcataaaagcaacgttaatggtaaaaataccagagacagcaggtgcttggcatccccactgtgctccctgagtggtggcccatgccgaagcagttggctccctccctttttggaacagctttattgagatataattcccataccataggaccaattcacttaaagagtatgattccagagtttttagtatattcagagttgcacagccaccacagtcaatttcagaacattttcatgtccaccaaagaaaccctgtaccctttagccatcacctgtgaccaccaccctaggcagctatgaacctgctttctgtccctgtggactggcttgttctggacatttcatataatggagtcatacactacctggtctcttgtgactggcttctttcaccagcataacattttcatctaccatcagccccttcattggctcgtagggtgagctggattccttccatgtggtggccgaggggtcctggacacagccactccccatggcccttgcagggctggcctctgctcctgagttcaggttccatgagagcatttcctcttgccaccttgcagagtgtgtggattttctcccctgccccagcaccttaaagctggccagagctgggtctttcaggaagtgttgaactctcctgcagtttattcccattgcttcctctggcctggttagagacgtgggggaggggtggaaactgggcagagcctttactgatctgttccccagggactctctttccgggagggggaggggagagacagacaaaaaagcatctttatttgtttttaatgttgactaactccccagccctcttaccaagttctggtgaaagttgctgggttcctggtcacgctgtcctccctcaaaacacagggtcataggacttctctcttgggggcagctaatagggaagtggccaagtgttccacacacaagagtcaggctgcatttcttttcctctagcaaaggagatccagtgcaaaaccagtgaatcgttaggaggcgttcagttgcaagcaacaaaatcccagctgaaacaatctcaagccatgtggaaatttatcatctcactttcaagaaagttcgggtagataataaggaattataacttttaaaaaaagattcctctgttaatgaacatttagactgtctctaactttttcgccacttcaaacaatgctgctctaaacatccatatataaatataaatatatagatataaatatatatatatatgtctttgggaacttgagctactatttttgtaggataaattattgaagtgacattaataaataagacaggttaggatttatgtcagatgggtcagttcacatttaatctgttgtcctataccatctgtatctaaatccatcaaatgagaagtgatgtttacagtgaagaccattgtggatccctcatacctatggaatcacttcatggacattgtattattttgcattttttcccacttatggctgggcagcaggctaaaataatgcttagatggaaaagacgtaacataaagggcttcctggttaaccaccagatatttagaatattctatacccttgagtgccatagttagcaattttgttcaagagagtttgtgattctctgttagaaagtacaggatgaaaagcctaataatgctaagtgttggtgagaatatggggaagtgggaacacttacgtagaattttaagtggtgtaaccactttggaaaacaatgtggcaatatctagtaatttgaaggtgtgcttatcatgtgacctggtggttctacttctatttttttttctttttattatacttgaagttctagggtacatgtgcacaatgtgcaggtttgttacacatgtatacatgtaccatgttggtgtgctgcacccattaactcgtcatttacattaggtatatctcctaatgctttccctcccccaccctgccccagtgtgtgtgtgatgttccccttcctgtgtccaagtgttctcattgttcaattcccacctatgagtaagaacatgcgatgtttggttttttgtccttgcgatagtttgctgagaatgatggtttctagcttcatccatgtccctacaaaggacatgaactcatccttttttatggctgcatagtattccatggtgtatacgtgccacatcttcttaatccagtctatcattgatggacatttgggttggttccaagtctttgctattgtgaatagtgtgtagtattttagatattatttagagagtagatagaaatttattatttcctccagatcagctggttgaaccttgttttcttttcttttttttttttttctttttaggttctacttctaagtgtataccttagattctagggtgtagagactatctcccaagtgcacatgagaagacacgtgcaatgatttttattgctatgtatttgtaagacagacaaattggtttatcagtcagaatgggataggttaagttacaggaacaaacagcccccaaattctatttcttgctcatactgcctgtccattggagtcattaggggctgctgctcgttgtaggcacttgaaaactgagacttgcaaaggcctagagtgcttccatggtccctggggcatggggagagagtgtagcagtgtccggcagtggcaattaaatgcttctgtccatgaaatataattctgccataaaaatggaatgaagtgctgattcatcctgcaacctggatgaactttgaaaacattatgctaagtgaaagaagtcagacacaaaaggccacaggttgtatgattatattcatatgaaatgcccagaacagttaaatgcatagaaacagaaagttggttagttgtttccgggagctggaagtattgaggaatggagaataactactaactgccatgaggtttctttttggggtgttgaaaatgttctggaattagatagtggtgatgtattagttgcataattctgtgaatatactaaaaaaacactgaattgcacactttaattagttaattaattaaatttatttttgtagagactgagtcttatgatgttgcccaggctggtcttgaattcctgggctcaagcaatcctcccacactggccttccaaaatgctgggattattgagccaccctgcccagccaaattgtacacgttaaaatggtgaccttaatagtatatgagttatgcctcaatttaaaaaaaatgcttctgtccaaaaataacacatcccttggccaaagaggtcacctggccacacataccttcaggttgttgaggaagcacaattctaccatgtgcctgggaaggaaaagaattggtatattcagtgaacagccctaatggctaccacttggaacagtacaaatgccaatggttggataaataaggtataggatattcactgatggaattctgtacagttaatatgaataagatctgtaagtgtcaacatgaaaagatctccaaaacagtattgaatgaaaaaacaagaagtagaatattatctctgataccatttatgtaaatattatttatggaaatatcgatccatttatgtaaattaaaaattattcacaaaacaatagtgtgtaatgtatggttacatatgtttgtagtaaaagcatgcaaacacagactggaaggatgcttcgcacctgtcttgtattatgactgttcccacctaaaaatgtagatcatgtgttggttcttctgaccaactggggaaattcatcctatttttcaatttattgcgtattctcaccattgcaaaccctcatcctgacttatttttattttttcttttagccctaatcctcaatcctatcccttttcctcttagccatcctctctaatttgtttaacctaagcctgtgtgtcctcagaaaataggttatgctgttggtgtgtgtggttggtaatctatatacatggtgttatgctattgattttgtttggtaatctccctttttactcaatactatatttataagatccatttaagtggttgtatgcctctactttattgcttctgactgctgcatggtattccatactcatgtccaccacacttactcattctccctcttgatggacgctgaagttgcttgcctccaacaccctctactgcaaacattgcagcagcagacatccttatatattgcagccctaaaacctccacaaagatttctccaggagtgggattgctactgaaaagccatatgacagtatttacttaaatgcagtctgtgtgcatgagggttcccagctctcctacatcctcatcaacacttggtaatacccggaagaccttccagcctattggcacttctccctaaggaccgattcagcctacattggaagacatagtgagttttaatctcttcctatcattccttcctggcctgtctcccttgtctggaatgaaagttctttttataatttcctacccagttctcactgataggaccagaaacccgaaaccttcctccattatcttaagaactcagccagtttttcaaaactaagcctcctttgtttttttacttaatccgaaataaacctctcttatcttgttttcccctctttgctcagggcctggaagcctcactggccattcttgtggattgctccagaaatggcccctgagaggtattgcttcacctgagtctacctggggtgggggtggagctgcagaccttccccagatgtcacccattcacagaagccagttttgggatttagctctgtttaaattgggacctgtagctttgcttgcaagtggaaataagttggtcttatttgctggggataattatatgtaaaagaatcctacctaatgcaacccgacttttggcctgagccattcaatggataattagtcctaactgtattgctggagtggaccattactgaagtcttaccttttttgtccttgcttttaccttgccttgttccagcaaggcttaagcatagctttaggtcctatgttatgcgcatgttatgtgattgtctgattgattacattataaactctgcacaggcggcatcacggtctttctgccctttcctgcctccctccgtccttgcactgccttgcttcatggagctttgcacttagcaggtgctcagtaaatacttgctgggtggttgacacaggattacatgttaatccatcatcttcaaaggctagaaccagacctatttaaaaaaacaaacaaaatccttccttttaaaagtggcattaccttcttaccctcacaaatgttcattttagtcgcctttattgctttctggggtagggggtcttaagggagtaactcagagagcctctttaacttaaaagaggcataataaattacagtctttaagagaagatcggatgcctgcgtgcctcccagaagtgggttaggagcacagaattctagatggctcctttgtttgcaccccaccctgtctgcagggctggcctcccacagcagtgtgtggtatcctacagatcactattaaataaacagtcccttgaaatcacaacattaaaaagtgctgtctatgtattgtaccaggagagccaaatattatggaaaaggccaaatatttccactgtgttaagaaaataagaacccagcagcatggaacttcccactcagtaggcaaaagatgtggtggagacttcaaaagggtggaagaaccatcaagacagcttgagctgcaacgggtgactgccccattaaaaaaagcaagtgtgtgtgtattccagatgcagctgcagaaatcgcaacaccacctttcaactgggaaataaatgaatgcaccaacgtatgtatcgtggctcacccaagcaatcgtccaactgtgactagggctgggggagaggttaggaggagagaggacgaagtacagaacacaaacagtctttgttctccaaagacccaaaaggcagattcacaggaagagattcctcatcctggtctgaaatgaagatagacacttggccatagggctgatggctctagcagaggccctgcccttgggatctcggcagcatctcagccaggagggctccctgactctggaagtggaatattgagtgataagaagtttggcttctcccacccactttccaccaccaggtagagcttgtgaagcctgaaaagtctgtagggccaagcagcctgactttcatggaaggagacccaggagtcaacttgttttaattaaaaagttaggttgggttatctcagggccacccccagggagggtgatgcttccaagctgaccaaattctgagctgctgagctgcttactttaatgagcttggggaagctcatttgaggagtggtggtaaaatcgctcactggacttgcaacatgagaatgttgttcatgaatcatcaggaagaactcccaggtgtggagaatggactcttgttccttcagctgatttgggacctggcactcacactcgcttactaactttctctccctagcgtaagcattcgcttcctgcctagagtctggctacctacccatcatccccattacccaaaatacaaaaacagagaactgtagcatcttattacgtagactttcctctctcccaaaagatgtgccagtgcccctgcctgccgtgccaggccctgcagggatgatgatcatggtctccagcatttaccgagctgtaattctgcacagggaaccaggccaggctctgtgcaccttcctagagcctcacagcagtcctctgcggggcacgactgttctcatccactcttgtcatccccgttttacagctgaggaaccagtggctctggcaggtgttgggacgtctgcccatggtcacgtagactgtgtggcagagccggaattcaaatctaggccccatgacttcagtactgctctatctgaggactatgcagagatggcatagcccctccttcaaaagctcatagtctagttgtagagagcagagctccttgcatggacaaataatccaccaggcccagcagaactgggtaccacaaaccgcatgggatgtctaggaaggggctggaaggaagtcacggtgcactgagaatgtggtgtgccaggcggtgtgctatgtacctatgtgtccatgacctctttaattctcaaagcactcctgtgaggttcactttacaaatacaggactgaggctcagagagtcatgtagcttgcccaacaccacacagctcatgggtggtggagctgggcctgaacccacatgtctttctaactccaaaccacattctctttgcatgataccatgatagacactccatttccgtagtgttaccgggagtgaaggccttgaaggatgggtgagaggtgagaagggagaaaggagggagtgggcattccaggctgagggaaaggaagaggagtgggcctgaggagcagcaggaattccaccagccccgcccagaagtggcccagtttttatcaccatcccaaatacatcgccttggtgtacatgaacttgctgagggcctagtttccatggctccgaagaggtgacatctccctcccacccctcatccaccctgagctccctggctgatttattcaatgtggtcatctgcaatggttgtggacctgtcaggatgacagattcgcctggggacatcctcctgtggaaggaactggattcatcccttgatcacttccatgccctgtgggtctctccctacctcttgctcattctacgagttatccctccattagccgggccgaagcatcctccaggcagggtttcctaattacctaatggtgaccatgctaccctttgccaaccttatgaaaagcatggccatgtccgttatctcatctgatcttttgctcttccaaccagcatttattaagtgcctactgtgtgccacacaccatatcaggtgctgaagattcacgggtgaaccaaaacaatttcatgcctggagagaagggatgttacagagtagctgagatgactgacattaaccagaattacaaagtgcccggctctaaaatgtgctccgggacctggaaggaattacactcactagggggaaaattctagcatggacagccagttccatcagaatcctgggatcctctgtctcctaggatctgcatgtttctcagtagatctgaagctgtttgatcacctgcaggagctggggagtctgctggaggcctgggatggagttctgggcttagtctggagagaatatgtaaacaggtgcagcctccttaaggaaacctgagaggcagcaccacacagtggaaagaacagttttggagtccaacagacctggacatgcatctgggtttatatctgtgtgaccttaggcaagtcaccgaacctctctgagcccaagtatcctcacttggagaatagggatgatgatagcatggatgtgcctgaaatgcccagccaggagcccaacacatggtgacctgagcaaacatgggcatctttattagctagaggtcatgaaactctggatgtgcaaagcaggccaatttgtgatttgtttaatttacaagatttctcattttatgagaaaacttgctgacaatactttcatattgggagctcctcttaggtttgaaaaataaaataattggccgtgcacggtggctcacgcctgtaatcccagcactttgggaggccgaggtgggccgatcacgaggtcaggagattgagaccatcctggctaacatggtgaaaccctatctctactaaaaatacaaaaaattagccgggcgtggtggcgggagcctgtagtcccagctactcaggaggctgaggcaggagaatggcgagaacccgggaggtggagcttgcggtgagctgagattgcgccactgcaccccagcctgggtgacagagcgagactccgtctcaaaaaaaaaaaaaaaaaaatttgttacggatgctgtgttttacccaggagcaccctgttctcagcttcatacagaactaagccaagtgtgtcagtgctgtccggaaggagagtctctaggggcatgccacaggactctatgctctgtctctgacctggaatgttggtcagtgacttggatgatattttgatggcatcctgttcacatttacaggtgaccagggaggaaggagagagagtgcttagaactgaacagatgtaaatgtaatgagtttcgaatgaacaattcaaagaggaaattaagaaaacaattccatttttattagcatcaaaaagaataaaacacccacctcttgcaaaattgaaactgtatcaattaaataataactcccctttccctcctccctgcaacgcctgttaacagccattataccttgagtaaattctcaacaaatgatactgtcctaggaaaagaaaatgtaatgggcgctgatgaaatcagcggcccaagtgtaggcagcaggaggtttggttttcatggaagcaggtgtgtgaggtgtcagggttggggttgtttgggagccagcagaagccagcagtataaatgcctctccaaatcctagggatgcattcacagaattcacatttcttggaatgcatttgtagaggtttaggatttagaaagtttagagagaggctgggcacaatggctcagcactttgggaggcctaagccggtggattacttgagcccaggagttcaagaccagccaggataacttggcgaaaccctatctctacaaaaatacaaaaattagccaagcttggtggtgcacttctgtaactccagctactcagggggctgaggcacgagaattgcttgaatccgggaggtggaggttgcagtgagcagaaatcgtgccactgcactccagccagggtgatggagtgagactgtatctcaaaaaatagagagatgacatggcaagagttgcttccattctgccctctctgcctgtctacacctggtctacacaggtgaaggttggattcaggtcctggtgtacattttatgagagcagggtaggagggcagcctggatggtggagacacaggactggtcaccagaagccacaggaagtagggctggttatcctcaagccgaggggatgccgggagaggggctatgtgaaatgtcctctttcaggagaggattttgatatgttctctgtggccccagaggcagaactagtgggtatgggcgggcattagcaggaagtagattcagatcaggataaggaaaatgttctcagaggctcggtggatgctgtgtggcttcccctccgggttgacccagcctctgtgctggaagctggacttgcctgggcaagggctgagttcgggactgcttcagcattcctccaaataaacctcccctggccacagaaaagcccagagaacagagaatattagaagctaagggagagcttgcagttatttcccaactctgcccttcctcatgccttcccattttaaagacgaggaaatcaaagctccaagccaccgaaagaaacaaactccatgcctgcccaccctccccttggggccacctggaggtttctgcagaaggagggtgcttggtctgagccagtcagtggatgaggggtttcccaggggagtgccaggtcaggcacattcctcagagcttcaaaatagccccgcaagccaatacatttcctcccaggggttggggagtggccgtcagctggcaagggacaatatgagggacacatctcaggggacactctcgagtgaggcattagggtgtgggtgctgagatgtctcttttcattgttctgcaggagtgagtgcggccttgacacgctgactggcctggcatggctgtcccagctgaagcctgtcccctgcccgctgcccttctttccctcatctcagccatgtctgcaggcacctccctgcctcccactccctaggctcaccaagctccctcagctttccaaagtctgtgagttgtagtgtgaggccacgccatgaggcagggacaaaacacagggtttggaatcagtcccaccgggactggaatccaagctctactgttaatacatcccagctgtgtgaccttgggcaagtcactgatccttttggaccctcagcatcttcttctgttagatgggcttgtacccatcccaaggatttgtatatgggttacatgggcttaatgatgtatggctgtctccagtgcagagcctagcacatggaacttgctagggtggcctccctctgtgcctcagttgccatgaaatggtggagcccagtgatgaggccagccagaataatgctcccaaccctgtaagggcagtggttaaagccagtctcaatcaaggtgggtgttaagggtcaactctggcctgaatcaggaatgccaccttcttacacaaagccagcattgccttcaaggtgacttctgcaaaagagacggatttttctgcacgctgcttttctcatggcatccgtggcacatcctctctccctgtcagcaaacctaggctacctagattttgagacagttgcaaagtatttattctgaggattcccaggacaacttgatggatcctgccaaaaacatctttgaacatataacttgacacacttttgtgaatttattccccaagataaattcctagcaggggaattggtgggtcagtttgcatttctcattttgatatatgttggcaaatggccctcctgaaagaattcagctccctcccacgaagtctgagacctatctatttcctcataacttcagcacctatctgaccaaacgtgattgtttctgtcagccagatagaaaagaaataacatcttgtcgttctgatttggcttttttcagttacacatgagatgatggagtgtcttagcatgtatgggttagccatatgtatttcttctttggtaaatgcttatttatattcttggtccatttaaaaatttttttgggtggttcagcttattactttgggtttagaggattgttccttggagagagggggtattctctaagggggcttggtggtggtattcagatcagtttcctttgaggctgtgagttagttagaagtaagcttcttcaccctccctgggaagaggctgccctgagcttgctccaggcttcctggggtcctcgttaacaggcatgaaagtgctgctccccccccaccatgccctcatggctgagtgctgcatcagggcagagcttgtgtgaggctgaatgagaagtttggtgttagatttagggaatggggggccatggcaggatgccagggaagaacctgtgtatgtgtgcagctgtgtgagagctccagaatttctgcagggaacttggacagctaggggttacatctgcataggaagcaccctgtctttgcttagagtgtgtattccaaataacaaaaaatagcaagtttaataaagttgcttttgtgcacagtatgtataacatccagaaaaggtcaatggcctattactcaagagaaataattacacaaataagtcaaatgagaaggatgaaataaggccaggcgcagtggctcatgcctgtaatctcggcacttcgggaggccgaggcaggcagatcacctaaggttaggagtttgagacctggtgaaaccctgtctttaccaaaaatacaaaaattagctggggatggtggtgcatgcctgtaatcccagctactcaggaggctgaggctggagaattacttgaacccaggaggcagaggttgcagtgagccaagatcgtgccactgcactccagcctgggtgacagagcaagactttgtctcaaaaaaaaaaaagaaaaagaagaaggatgaagtaagaataaaataataacaacagggccaggtggagtggcttatgcctgtaatcctagctctttgggaggccgaggcaagaggatcacttgactccaggaatttgagaccagcctgggcaacaggatgaaaccccatctctacaaaaaatacaaaaaattaacccagcatggtgatgcgcccctgtagtcccagctactggtggtggggggcaggggagctgaggcaggaggatggcttgagcccaggaggtcgaggctgcagtgagcagagatcatgctattgcactccagcctgggtgacagagtaagaccctgcctcaaataataataacaagaacaacagatctcccacttgtgtctggagctggctgatggagattgtcaaggtggggattaagcctcccttggcactgccactggtgttagaattcccaggaaatctaggaaataaaaagaatgaacgccaggtgtggtggctcacgcctgtaatcgcagcactttggaaggctgaggcagacggatcacttgaggtctggagttcgagactagcctggctgacatggtgaaaccctgtctctactaaaaatacgaaaattagctgggtatgtaaaattagctacttgggaggctgaggcaggagaatcgcttgaacccaggaggtggaggttgcagtaagccgagaccgcaccactgcactccagcctgggtgacagagcaagactgtctcaaaaaaaaaaaaaaaaaaaagaatgaacgaccatacattaaatgttttctgtgggccaggcacgtgctaagtgctttggatgcattatcccatttaatcctcactgaaaccatcagaggcataccctcttattaccctcattgtctaggcgaggaaatgcagggtcagagaaactcgttgatttgtccaagatcttacaccagttaagaggcaaagctaggattgaatccctgaattggttttggctgtacacattgggcttccctgtgtttctccccggccctgaccccttggttaaagctgggggagatgccacttagagggtagaagacaagggaagttctggccatgtgcgccagcccctagccaccctctggagcccagttggcatctcagaagacatggctgggaggggcgcccaacccccccgccccttatctgggggctttggtgtgcagcctgggagggctggaatctatagctcacgcctttccctgcatgggcctgggtgtgagcaagggtgtggggaggggacaggctcactgggggtgggctctggccaagcaaaacaggctgaggtcagagggagggggccgccctccccagggaatgcttggatgacgtgactttgagggggcactgggggaggagggctggctgtgtgtttctcctctcacctcaacctcagcctgatgaggaaccggggaattggggcgggaagcccgaccagatgcagcccctggcaggctgccctggccgctgcgcaggactcttctccagccagcttggcaggtcccttcttcccctcctgaggggacctgggagcaaatgacgtcctggagttggctgtggcagagaggagggtcccctctggccacacggaaggaaggggcagggagaagcagcttgggggctcaaaagaatcccctttcctcattccagttgctccacattttgagccaagtttgggagcaggaggggagatttaaaaggtttgctctcagatccggtgcctgggagcgaattgagcgtgaaacaaagtcattgacttctggcacttagtttctctcatttttcaaaagtcgctaacgctccctgcattgaatgcctcagggtcttagtcactctgaactgtccaaaaatgagcaggtgaagcaccctgtgcccctccaggaactagggtctccctggggaacccactcccactctgagatctattctagtcactccactgcatcctgagtgtggaccatctgggggcccagagcctttggggtgagatttcttgatctctaagcagcccctcctgggctcccatctccccccctcctctagggaccccacgcatttcactgcccacactctctctcattgccaagcctgcttcatcgtcctgcctgccccctgctccagggccctttgctccttctgggctccctcacatgctcatctattcctccttcagcccttagatctccccgacacctgttctcgcctctctctccaatcccaaactatgccaagttctccaccgaagaaacacttcagctggctttgaccttgtgcttcttcgcccccttgccctcctccctcttctgcccccatcattccctcgagcctcagagctgggactcagtttacctcctgcctctcactgccttgggctccaggctccagtcaccccagctggccctggctctcccagggaactcaggctgtgtcatgccccctcccctagccctcagcctttgcttatgctgtttcttttgcctagggtacccttccaccaccacaaccctcacctcttcacccagcctaccttccttatctgtcactctggcatcacctctgctaggaagccttccagagtggtgcctctcctggggttccctgggaacaggcacagctcttgacctagccttacagcacattgtcccttagtactgctctttctcaccacaccagagctccctgggactggagctgtgttttatttgactttgtgttgccagtgtctagcacagagcccagcacgtaataagcgcccaatccttcttgacgggactggactgaattttatcagacaagtaacatggctttactgaggatctaccaagtcattagacgttgtagagaaaacaaaggaagcccggatcaaatatttgctttcaaggactttgtaatccagtcaagaatgattctgggaatgggttgggggaacggtcaggcatgaaattggccatctgagtctccagtgctgcagtgggcactatggttgcaggtgccttgtaaaggtttcagagaaggggagaactgtgagtagagggggacccagtgaggtctggagaaggggtggagggtgggtgagatcacatgggagaaggctggcccaaacccacagtcaggactgggaactaggggagaaatgtgtttccagagaaggtgagccgatttcacctagccataggatcttccagtgtcagaacagggttagtggattttaagtgcagtttctctatcctggaggccaaacaggagctgatggcattccccgttttgccgcatgattgggaaatttttcctgcacatcagggtctaccggggccagtgatctctccaggcaaagagagcaggatattttaggaatcagttctttccaattctcagtgttaaagagccggtttctttgttgctgagcctggggaaccaggtgtgttctcttaaagtcagcctttctccttaaccagccaggcacagctgctgctgtgtgccagagttggtgatgggcaatgtgatcactgcagagatgattgcagaggtccagcatacatttccccaagattaatggacatagcatggcgtctacccacacaagcatgctgtgcaccggaggagggggcagagggagcaccagggctgaggcagcccagggagatttctaggaggtggtgggtcttgattggctcttgcaggaattagacaggctgagaagatggagaaatagagttctttctgacaagaaccccttaaccaagaggtacattgtctcccttctaactttttaaacaatagctttgctgaaatggaattcatatcatacaatgcaaccatttgaagtgtacaattaaatggtttttagttcattcacagatagtgcaactctcaaccacagtcatttttaaacattttcatcatcccagaaagaggccccattagcagtctccttatccctgacagccacccacccaccccacagctctcggcaaccacaaatctactttctccctatatatgtttgccttttctggacatttcatataaatggaatcatataatgtgtggttgcttgtgtctggcttctttcactcagcataatgttttcgagattcatccatgttgtagcatgtatcagaacttcattcttttttataactgaataatattccataacacaggaacagaaaaccaaataccatgtgttctcacttgtaagtggaagctaaataagaacctatgaacacaggtaaggcatggtggctcacgcctgtaatcccagcactttgggaggccaaggcaggcagatcacatgaggccaggagttcaagaccagcctggctaacatggcaaaaccatgtctctactaaaaatacaaaaattagccaggtgtggtggtgcacatctgtgatcccagctacttgggaggctgaggcaggagaattgcttgaacctgggaggcagaggttgcagtgcgccgagatggcaccactgcactccagcctgggtgacagagcacaagaacttatgaacacaaagatagaaacaacagacactggggcctacttgagggtggagggtggaggagggagaggagcagaaaagacaactgtcgggtactgggctttatacctgggtgatgaaataatctatacaacaaagccccacgacgtaagtttacctgtataacaaaccttcacatatacccctgaacctaaaataaaagttaaaaaaaaaaaagaatagaccgggcatggtggctcacacctgtaatccgaacactttgggaggtgggcagattgtctgaggtcaagagttcaagatcagtctggccaacatggtgaaaccccatctctactaaaaatacagaaaaaaaaaaaaaaaaaaaaaattagccgggtgtgttggcacacacctgtaatcccagctagtcaggaggctgaggcagaggaattgcttgaaccagggaggtggaggttgcagtaatggcaccactgtactccagcctggacgacagagcaagactctgtctcaaaaaaaagaataatattctattgtatagataagtcacattttatttgttcattcctcatgtagtggacatttgagttattttcatgttttagttattacataacattacataatgtatatattttataatataatgctgctacgaacatttgcatacaagtttttgtgtggatgtaagttttcatttctcttaggtagatgcctcagaatagaattgctgagtcatccggtgacgctacgtttaaccatctgaggagctgatagactgttttccaaggtggctgcactattttacattcctacccacggtgtatgcaggtgtgaatttctctacatcctcaccatcacttattatctgcgagtttgattatagccatcccagtgcatgtgaaatgatatttcactgtgatttgatttacatttccctaattgctaatgactttgagcatcttttcatgtgcttattggccatttgtacctcctctttggagaaaaatctattcagatcctttgcccattttaaaattggattacatatttttattattgagttgtaagagttctttttcaataaaagttgcatgtatttcaagtctacgacatgatgttttaatacacaatacataatgaaatgatgactacagtcaagcaagtgaccacatccatcaccttacgtagttctttattttgtgtgtgtgtggtgtgagcactaaaatctactctctgggcatacctcttgcatgcaatacggtattagtgatggtagtcctcaggctgtaccttagatgtccagacatattcactctacatactggaaatttgtatcctttgaccaacatctgccattttccctacctcctcacccctgtcaccacccttctcttctctgcttctatatatttggctctagaatccatatatgagattatacagtatttttctttttctttttctttttttttttttgagatggagtctcgctgtgttgcccaggctggagtgcaatggcatgatctcagctcaccacaacctctgtctcccaggttcaagcgattgtcctgcctcagcctcctgagtagctgggattacaggcgtgtgccaccacacccagctacttcttgtatttttagtagagacggggtttcaccatgttggtcaggctggtctcgaactcctgactccgtgatccgcctgcctcggcctccccgagtgctgggattagaggcatgagccaccgcacctggcccagtatttttctttctgtatctggcttagttcacttagcataatgtcctccaggttcattcatgttgtcaaatggcaggatatcttttgttaaagttgaataatattccactgtgtgtgtgtgtatattatatatataatatatatagtatatatattatacactgtatatgtgtgtgtgtatattgtatataaatacatatagtgtataatatatacactgtatatattatacatatatataccacaatttctaagagttctttatatgttccagatataagtcctttgtctagaatatttgcaaatgacttgaaaatattttcccccattctggggattctccttttactttcttgctgatgtcttttgaaacacaaaagttttttattttgatgaagtccagtttgtttatttgtctttgagctgtggttttggtgtcatgtctcagaaacccttgactaattcaaggtcatggagatttgtgctatgttttcttctaagactttaatagttttctctctcgcatttaggtctctcatctatttcaagttaatttttgtgtgtgatctgaggtccttctcattttgtactgagtcaaactgaagagccccccacctccccagttggcctgccacactttgccttctgcatttgggtctcagctcaaacatcctcactccagggaggcctcccctgtcaatctaaagcagctgcctccctgcagtttcagtcaccaccccattttattggggccgtcagaaatggtctgacatgttgtctgttgcctcccatataagctccatgacaacagaccctgtctagcttactgccttcgtttctagcacctagcgcagtgcctgacacttagccagagctcagactattatttgaaagcttcttttggttaaaagaaacattcccagtggattttgcttaagactttgtaagtgtctctggcctcatggagttggagggctgagtgggaggggatctaccagcatcacagtcacaggtggtcactcgtcccttgccccagccatcccattacttcacaagacagccccttccatccttggacaactctgatgattagaaaattcttcctgatgttggacagagacctgcttccccatcgctggcactcgttatccactgccttcctttagggacaactggagttgaacttcacattttgacagtcctttaaatatttgaaaccagctatcgtatgtctcttaaatacctcctctgggctgagtgcttctaattctctcagctgttcctcctggagccgagaagggctggactctgaccccttagtcgctgatgaaggcctgcagacatggggtgggcacaggctgccaaagaaagccccagcacagccacagctcagaacgaaggaactcgagtctccttgtttgctttccccactttgagctgatgaattccaaaactggaagcagaactttgagaaaaagcacccagtacaaactccctaactagatatcttaaaggcagagctgactcttagtagtacaaattactctgtaatattgctttctattaaaagggtgtggttttttttttgttgttttttttttttttttagctagtccagtggtctttttgatgttggttcagcttagtggttctcaaccctggaacaacccgtagacccacctggggagctcttaaaattatcagtgcctaccccaccttccaagattctgatttaaatcctgtagtgtttttaaggcaccccaggtgattgtaatgtacagccagggttgtagaccttggcttcaagagctcagcattgaacctgaaattccctacagccccacaagaatgagcaaatgctggatgtcagcacaacatccaggagctggcatgagccagaggactggctaagaggactcaattattttctaagatggagattatgaaagctatacatgttcaaaagaaatgaaataatatagaaatgttggccaggcacggtggcccacacctgtaatcccagtactttgggaggctgaggcaggaggattgcttgaggcctagagtttgagaccagcctgggcaacatagcaagaccccatctctacaaaaaaattaaaaaattatccaagcatggtggcacatgccgatagtcccagctactggggaggctgagcggggaggacttcttgagcccaggaggtcagggctgcattgagctatgattgtgccactgcactccagcctgggcaagagagcgagactctgtctctaaaaagaaaaagaaaaaaagaaatctataaagtagaaagcaaaactgttcccatttctcctctctctcattccatgcaaataaccatgattatcaatttgttgtatttttttctttttaatgtgcatagacacacacatatgcaaacttccccccatacaatccatcccccagatagatttaatcatatggtatacatagcattataatcttttttttcttttctcaagatactataaaccttttcccataatgatatagaaaagtccaccttatctttagtaggtatatgaaccataatttatttgacctttttttatcaatagacattcaatattccttatctttatatacatacacacacacatatatacacacacatacatgcatacacacaattgtgtggataaattcttagcggtcaaattgctgagtcaaagggaatgcaagtttggcgacagaaattgccgaaaagctctccaaaatgattgttcttgtctctctcaagcaacgaaatttctaatgacagctatttgccttgtgtcaaaagttgagctttgctgagcacagcagagaggaaggtgtgagtgtgtcagatggtggggaggaagcccaggggtcatttcccctgcaggctgtgtgtggaggcggctgctggcctctgactgctgtgtttcccaggaaaaggaaaccaagctgtgtgtgttaacctttgccattctctccagggtgtgacgatggagtggggcacattttcaggatgtgtgtgtcggggtcagtaggcctgggtcagtcattgatttgggagtgtgtggaatgagaatcccattttctgaccctttcctagacccactgggttgtttccaagccccttggaagcccaggagtgtaatttttttgatggctcaggagaggatatatttgtttaatttctaggactctggctcctgaatgtctgggagcattgagcttttccccctgatttccattgcaaggttagccttatcacctcagcctaggcacaccatcgccctctctgggctcctgggcattacccaagatgtccactgcccactgctgggcctctccattggagtgcctgctggctcgaggtgatcagacttgtttgctctgccaagctgacttgggaccagagggtggtggcaggattggaaggaggaaggtacaaaggtccaaccgcatgctctcaggtactctggagaatgtcccagtggtgacatgcccagaactctgtgattgcaaagtgggctcttgccaggcccagcacttattggtgccccagaatcttctaggggaagagactaaaattcataagtgcaaaagactgtgctaggcactttgcaggggaagggaagtcacatttattaagcgcctacagtgtccaaggcactgtggttgttcttgcgttctcattaatcttcactgtgaggcaggtattcttaacactattttatgtgtttattttatggggtatggaggctcagagagaataataacttttcatgaaattgatccgattgattttaaactatgcaaaatagagtgctgatccccgcaaggatccctagccacctgcctcatgggcggcctcagtattgacagatagatcattgtctctgtcaccaactgacagagctaattgagccaccaaggcaaatcttgtggcagggactctgtcttgctccaggcagtctgctgtcgttattaaagaagacaaagagttcaggatatagagtgaatggctgcatttgaatctgagcttcattacttgttacaaatatgatgacctcgggtagaccagttacctctctgggccctagtctcttcacttatgaactggagacgataacaacacttttctcataggactattgtaaagagtaagtgagataattcaaacaaagtgcttagcaatgcctggaacatagtcagtactcaatacattggcatggccattagtgtttcttttactcctgatcaatcaatcccattgtgcgtgtaagaaggtttggcggagctgactctttggactgtttttcttctcgttctgggggctgtaaggacagagctgtgactgcctaacttttgaaaggtccatgtaggattgtgaatcctgggagttcctagtttatacactcatttcccctccaggaaacatgaagaaaagaaaaagtgtccagccccagaggggccaaccgcagcacgttcatcctttcagcggacgctcctggggaccgtcattgttttcccagccctgggcagcagagctattttttgctcctctgctctcccaggctggccttggtattagtagtggttccaccactgccgtgtgtgtgtgtgtgtgtgtgtgtgtgtgtgcgcgcgcgcgcctgtgtccatgtgtgtgtctccgtgtgtgtgtgtccatgtttctgtgtgtatgtgtccctgtgtatgtctgtgtccctgtatgtgtgtgtctgtgtgtgtgtgttgtgtgtgttgtgtgtatgtctgtgtccctgtgccctacttcctgctcccctcctatttctagtcatagcctcatgatccaagtctcacggcaaatgggaagaagtcagttcacttcctgagtgtctaaatagcccacattcattgggccactttgcacattgctaggccctgtgctcggtgccccatgggtatcaccacatttaacgagacactcccgttagaaaccacacttcgcagcaaaggaaaccctcactcagagggtctaagacacttgcctaagcccacgtagcagggacatgtatggattgaaattcaaatccatcaagtggatagatttgaatttgaagtcatcttcctcctgtgtgaagccaagacggcctctggtcccttctgaggctcacttctcggcactccattactcatcttgcactgtccctccgtgatttgtcagtgtgcgtcccactgcccctgctgggctgtgagggcctggaggttggatgctttgcctcatcttctctttagcttgtctctaaaccaggcgcgaggtcagcactcactggatatttgttggttgctttgttctttcactgatgaagggaacagtaagtgagcatctcttaggtgtcaagtgtggtgctgggcactagcatgccaccaaccaccttcaggaggcttccattctaacaaggagacacagagtcagctccctgaatcctcacaagagcctccaaaaggtaactactgtgatcttcattctgcagggtaataagtagaggctccagcagtagggaggcttcctccagaccctctcacctactcattaccctcccatttaaataaatagtggggccggatgaggtggctcatgcctgtaatcccagcactttgggaggctgaggcgggtggatcacctgagatcaggagttcaagaccagcctggccacccatggtaaaactcatctctactaaaatactaaaaaaaaaaaagcctagtgtggtgacacacgcctgtaatcccagctactcaggaggctgaggctggagaatcacttgaacctgggaggtggaggttgtagtgatctgagatggcgccactgcactccagcctggatgacagagcgagactctctctcaaaagaaggaagggagggagggagggagggagggagggagggagagggaaggaggaaaggagacccatgattcctgcaaacaaaggcaggcactgagtgtgatgggtacctgctacacactcttgaaggatgctccctactgtagaggcatttgccattgtcccctcctctgagtctcttttaaaaacccttttccccagagaaggtccatctggcccaggtctgcagtagaagcgtctgtgttttggaggcgactggtggatgtgtggttctgggaggaaccttctcctagcacattataccccctccaactcccagagcccttctggggttcgcttctgctgcatttactatgactgattctgaatacaaagtcctgttgtcagatggtctcaggactagaaaagtcctgctgcctggtcattagccttatagtcaacccgtgagtgtgtactaccatggaggtcaccctccactacatccaggcttctaagtggtggttgttccccaaatctgcagcgtcacctctctccccaccctaagaatgaacacccactctagaggaggggttggaattttaatagggccctaccctgagggtcctcatcgttctcaggctgagctcagaaaccttagccaagtggccacaggctgttgaacttgattttgctggcagggttttaggttggcaaagatgtgtttgtattctgctcctaggccaccagggatttgcttctgggaatggggacagtctccaagtgttgctactagccacctctttggcatttcagagccagtgaatttgattggcattagatcagccagtcattatctcagtgtgtccagcagactggcaggcctagtgagcctcgggggagaagaggaagatagtttgcatggatagggagacctgggaggaagacagactcacctgtgttgaatagagaccaacacagcctgtgtcaagctgggtgttctgagccaacaattagcaaacgaaggcagatataataattgactaatcatggaaagcatactatgagcaccacaagggatggtcacagactcgccaggctagtgggggtccagatcagatgtcggaagtctggggaaatttttatctgggtgcagccatgtcaagaggggtctttaggccaggcatggtagctcgcatctgtaatgccagcactttgggaggctgaggtgggcggatcacttgaggccaggagttacaaaccagcctgccaacatggtgaaaccctgtctctactaaaaatacaaaaattagccaggtgtgatggcaggcacctgcaatgccagctagtcaggaggctgaagcaggagaatctcttgaacccaggaggcggaggttgcagtgagctgagatcacgccactgcactccaccccgggtgacagagccagaccctgtctcaaaaaaaaaaagaaaaaaaaagaggggtctttaacaccagggcctttactgcttcccggtggtgtgcagtgggccacagcagggaggagatggggctctgggccggcgtttgatgtaggcactctcatggggagctgcagccctggagtcctctgctctgctgggtgggctgcatctaggggaccagcctgtactaatttggagtatatgtgcctccttcttaccaacccccccatgatagaaccttgtacatgggggcactttgaacagaaggttagagcctattagtaccttagacgggctggcagcatcttcttgggtaagagcctgacaatgatgaactccaccaggaagccagagcggtgatcgtgtccccacacgtgaactccctttttctggctgctcaatcgtgttcattttgatttctgggaccatatgctttagcagtcagtcccaaatgttagctatccctgcatccccagactccgaagatttgggtaagttaaagagctgagggtcttgaagagatcgtatgacctcaaggaccctagagagcattgacagcccacccaggggaacaaggagcatgtacattagaataaggcacacttttctcagcgtggctgcagtcctgagccagggtgcacagtttgggatgtaaagtataggttagatttcacacctacatgtccacttgaccaggcaaccactgggcagtgaacaacttgcccaactgtatacaatggccctagtgcagccagctgatcccagccccatggtcatgtgagcaagtgaaggaagattgccattgagtttctgtttggcctggggcctggggccaggggcagctggtaggagtccagggaaagtaaggccttcctcagtaaatgggaccacagtaccatggagatatgcaatttcctccatagctcctaactccttgcctctcattgtacattttgtagccaagggggcaacaggtacttaccagcactttctaattaaacacaaggcgggtcctaggccttctaggaatggttgggctgtgtatttgcagtttctaattggtcccagaccagatcaaatcatggacatccctccacagaaatgggctaggcttcattctcagtgctctggagctgcgctgtaagtctggtttgcatcaaggccattttcttgttgaaaggagcaaggctaatagaggacagaagcacccactgggaaggcgattttggaaacctcagacattggtgggccttgtgagctgagcagacagaaggcagcccaagatgacctctggatgggtgggactggttgggccagagcgttgcgctgggtgtgtagcgagagttcccacgcagtgtctgtggtgatgattccactcctccatcaagagtgagcatggtgggagggcctgagcccctgggtcccctcagtctggactgacccaggggaagctggaagcagttgctagcctctagcgagccttcatagacgcctaccatctgcctgaaatggctggagacaggggaaatagaatccatgggtttttaaaatccagaaggaagagaaactccacccgtgaaacataaccccaagtaaagcgtttggaagcaggatatttaattgccaaacttttcttgagacccagctgccgggtaatgttatcttgactgctcctgaggctggaggagagtctatctgggcccccgatgcaggcttgtaaacagagctggctttcttggatgacctctgccctgtcccccttccctgtcacctgttctttctctgtggtttctctctgaagtttccagtgctggcaaggccagctcagggagacttaagaagctctggtgttgaggttgggagctaggcatgggctggggtggaattttgtgtgtccatcacccgcctggagtgataatctaggatgtccaaggtttggaagaaagcagacgagagagaggggtctggagattgtcctcgtatctctgggcttatctccagggaggtctcttgctatttcctcaacccaagatttagactctgtccaggggggtaggctggggggcctctggcaaatccccgaagtttgggagaacctgggaatgggggctcgcttccccatccttcacactgagtcacattcatggctgctcagggcatagaaagtagggtgcaagatgttagcaggaacaatcctttgccaaacaaggaaagaactgctttttagggggaagtgtggctgtatcctagccgggtggctgtggccggcaagggccacaaggacagctctctgtcagctcttccctctggctggctctccagcggggtgtatctttagtatggttttaggccaagggttaaacagagatgacttcgtgtgaattttcaatttttgtttttaaaatagagacagagcctcactatgttgtccaggccagtctcaaactcctgggctcaagcgatcctcctgccttggcttcccaaagtgctgggattacaggcatgagccactgcgccctgcccttttatttttaaaatagagacagagcctcactgtgttgtccaggccagtctcaaactcccgggctcaagtggtcctcttgccttggcctcccaaagtgctgggattacaggcatgagccaccatgccctgccagttttcaacatttctgaagagtagagggcaaagaacttttccgaggggggatgctctggtcatgtgcagagtagtcctaggctaggctgggaagtgggacatctgggttcctgtcccagctctgccaccaatggatgtgagcacactccagtgataaccatgttttcatcagtactggcagccctgaaggttgtgtcctttgtatagagaaggagtctgaaggcctgagcggctgggctggggtcttgcagccaataaggagggtgctgcacccacatgtggctaactccagagtctgctgcttcctacctggccatgccctttcctcggcaaatcaccaccctggcccctgggtttctcctctgctaaaggagaggtctccctgtatcctcccagctgccaggggctgtgagcctgtgattgattctctctgggaggtgaagggaagcctaattgctagtgggatggaggatgtgtgttaagcctcagttaagcccttcccctgggctccgcttggttggttccggagaaaggctgatgtctaatgtcctgcaggcgaatgcagccctctctccaggggcggattggcctcttgggccctcctcacatttagctcctggggtggaggtcagagaaacagcacctggtgtgggctcagcctctgctcctgccccagggcctgtgggaagcagagatgcaggtgggaggggagatggagctaggagtcagcagggggaccagggtaggtaataacccccaggaaaatcccacagcattgagtttgagggggtcctcaccgtcagtcggttttgtagcattcctaaccatttgcttctgtctgggcccccagttctgtgtcttcttggtctcaggctcttagaaggcgcctttgttcctgcatgttcctctaaggtgcactccctcagcaagagcaccgcaggcttctcagaccacccacacctttatttaaaaagatggtgtcaaccggtcagatgaggtggttcatgcctataatcccaggactttgggaggctgaggcaagcagatcacgaggtgagaagatcgagaccatcctggctaacatggtgaaaccctgtctctactaaaacatacaaaaaattagccgggcgtggtggcgggtgcctgcagtcccagctacttgggaggctgaggcaggagaatggcgtgaacccgggaggcggaggtcacaatgagccgagatcacgccactgcactccaacctggtcgacagagacagactccgtctcaaaaaaaaaaaaaaaaaaaaaaaaagatgatgtcaaccaaaaataaaatttgaaggccccctgcaaccatctgaatgtactccctcctcagcccgggcaccctaacattgaacctgaaagactggttcaggccatgacaggaagtggggatcagacatgattcattatactcctgcagcatcaatatcaatgcagacctaagatctgataagaaacatttacaatctgttctctctgaagcctgctgcctggaggcttcatttgcatgataaaaccttgatctccacaaacccttatcttaatccagacactcctttctaatggtagtaactctttcaaccaattgccaatcagagtatgtttaaatccacctatgacctggaagcccctcgtccccgacttagagttgtctcacccttccagatggaaccaatgtaaatcttatatgtattgattgatgtattgtatttccctaaaatgtataacgcaggctgtaccccatccaccttgggcacatgtcatcaggacctcccgaagctgtgtcgcaggtgtgtccttcaccttggcaaaatacactttctaaactgattgagacttgtttcagatactttttggtagacaatgtcattcagtcctgatcaaagtagttcagtttagataaatttatgtacagggagatagtccagttcagttaagagcataggtattagaactcagctagacctgggttcaaatcttttgctctgtaatttattagctgtgtaacttcaggcaagttacttagcttctctgagcctcaccttcttcttgtacaatatgggaataacagtggtagctaccttattgggctgaagattaaatgagctaatgcatatacatgctttatgctgtactggtaactagttacatttagttgcttaaacattaggtaacattaagttatcaaaatggttttacaatgtatcatgtgatacctatttacatatgatgtaaagcaaagcatacccccatttattataataatagccaatagtctattttgagctgatgaagataggggtggccttttaccttatgttctgtatcagggccacatgtcataaatgccccatctctgggtggcagcactcagacctgtttgctttggctttatggccctctccttggttgcgtttcagaaaaaactcgccatggcatgagtctgcctctgtgtcatagagataggaagggagaagagactggattcagctcattttcctgtgtatcaccggagcagccaagcacaaagcctcaccacgcctgtggcaaaccctgttccaggcacctgggaggtgggccagtctgatggcaaggtgtctaaatgccacttctctttgctaacgttcctcctcatcttggcccagatccctggcctcactggctattttattcttagggtagagtccccccagccccacccctacagacctacaggacacagtgactaggcagagaccccggaatctgaatttttatgaagcctgcccccggccccaggtgatcctaaagggcaccctggcctgggaaccaccattgaggacctacagccattgcctctctcctgagggaggaaagggggcagaggtcttacctgtgtcttatcagtgccctcccttaactgtcctcctggagacacccctgcaggtgtccttcccagggagaagttcaacagaaaagccctgaggctgtgggagggcacccattcctctaactcaggcctttcccaggaaggacagaaatagtgggaagagcaggccagattgtgtggactgggggctttctctccttctccaaggattcctaagtcaattcagccttccagagtggcatgagctctggcagagcctgatggagacttgggaaccggggtgacagcctggccctgaaatgccttcattgtgaggctcccaaagagaaaagtttttccagtctcccacgtgctaacgcctcttcttcaaatccgtttctcatccagaagaccagtgtgtttgttcaacatagcaaagtgttttctgagcacctgctctgtgccaggcactgagcaaagacagggatgctgagatgaatcacacatctctgagcacttctggtctcctgaaaggcatttcagagtgagttctgaggatccacagtagcaaaacaagctggggtttgttaaaagtgtaaacatccgagccctcaaaacccaggtctgcagaatttcagagagcggggtccacctgcaatttcggagggcctcttatagagtctcattcactctaaagtttgtgaaccagtggaaattagctatctaaaaaggccaggcgtggtggctcatgcctgtaatcccagcactttggaaggccaaggcaggtggatcatctgaggtcaggagttcgagaccagcctggccaacatggcgaaaccccgtctctactaaaaataccaaaattagccaggcatggtggcaggcacctgtattcccagctactcgggaggctgagccaggagaattgcttgaaccagggaggcagaggttgcggtaaaccgagatcacaccactgcactctagcctggacaacagaatgagactctgtctcaaaaacaaacaaacaaaaatgtagtgacctcaattttatgtttattgtatgaaatatatacaaataaaaagaaggaaattaaaaccactcattctgatcctactttcctaagataatcattgttggcatttgatgaaatatccctctaggggtatgtgtgtgtgtgtgtgtgtgtgtgtatttagacatatattgtagcatctacatggtagctgatactgtgctagcccctagggacagatgagatgagtaaaagagtggtcctgccatatggaacacctgcagtcatgttacatgatgcctggcacagacagcttgaaatccagccttgctcacctgctcttacctttttcccacaggtatacataatcaatgtgacctggtctgactccacctcccagactatctaccggaggtacagcaagttctttgacctgcaggtgagtttgtcagagctcggacagtggcccaagtctctctggtgggctggcctctctcataccctcgcttatccagggagcccccaagagagctgtcagggtcagagtccaggtgggagcagagggacagaggagggaagctggaaggtggagctgggctcgtctcaatcttgcatactgcaggcagacactcaggactttgttggcctcctctgatggtcttaacagtaacgctttgtcaccctcccttgcctgcagggtaggaaactgtggtgaagaggcgggaggatggtgggaggtgctgtgtgcctgaccagacgtgtgtctataaacatccagggtgagacagaagccactgcatcattgcaggcaaagaaaagcaaacactcagggaagaccgaaacagaaaataagcaattttttcaactacaggcacaaactaggcatacataccacggtgtctgtctgaccgaatgaggcacttgccacccagtttgtacatgtacgtggtaggtgtgtgtctctaagacacaaaggcatgttcacaagggaatggtagtatgggtcccacagctacccctgcagacaccccccttgatgccagctaagttagtcaggcctctttgggttgcaagtgatagttttacaattgcactggcttagacacaaaggagatgtgattggaaggagggaccagggaagcttgtgcagccgaccacatggtgagaagggcagtgaggcagaggcttcaggaatgcctgaaaccaggatctgctctccctctgtcttgtctctgcttccctctggcactgccctcagcttctgttacctcacaccctgaggaatatggctgtcagcagctctagaattttatatcttttggctcccaacagaggggaaattgactcccagttccaagttgaaaaatcccagggacgattttgattggtctggcttgggtcagatgccctctctggaccaatcagtatggctgggagttgagggtcttttagcacagacatggccactagggagcccacctctgcggatcacaggcaagtactagagaagggagaatcagtgtgagttgagcagcagccctttcaggtagagccaagatgttctagattcctctcggggttgtgagcctggtttaggccaataaaaacacaaagagacactcacttctaccctcacagccagggtccactcctttcttggcaggcctttggttgtcagtcatcttggagaggtcatcttgggtaccgtgtgcttgcccccaatacctaattctatctcattgtcctcattgccctacctatgagacaagccaagggtgacctagcttcctgtattacaaatcctttcttaatccaacaatgtgggattgaatatcccattgaatatgggattgaaagccactccctactctccagccttcttcctcttccctcctcaattcatgtccagtctccttaattccagtgtaatctggtggggtttgctgataccccatcaatgggtgcagtgtgctggacaggaagtgataactcagttggggagagggaaccctgaaaggactcattgatgagctggagggggcctgaaagccagtggaaacttccaaatcagaacttttcttccccctcttcccttatggtcccccacccactcctgcattgcagaatctcaggagaaaggaatgctgctcccccaccaccacctcccttgcctggagggctcattccctgtgtgtggaaaggggatacgcaagcagggagcagctagtgcagtgtgctggccctagcttggcaatggccatgagcttggccaggcttgtccacgtgggtcattgctgacctgtagatgcagtttgggaaggggttggaatcgttctttggaaattaacttatgagccaagcatagcatctttacgaacccattttacctgccatgatgagttttagtggcgttcattttgaaaagccttgcttatttatcaggtcgctgattttggtatggcggatcctatagaggaagaacaaagggagttgctaactccatctctggtcattggtgcacctcagaactcatgtccctgagagattgtgtaagagagcagcttagagtttaggcactgggggcacattccctgggaccggttactggctgtcaccacgtaactccggacaggctccttcacttctctaggcttgcttttctcatctgtagtgtgaaggttcaaattgcctgcccggtagggttgttaggaggaatgaatgagtgaatccacgtttctcccaacacttagttgcctagtgagttgcctggtgttagcaggttgcagggatgttgggctgcatggctggggggcgtctaggggctggagacccactcactgatgttgctttgtggcttccctcacttggcgtcactctgtggtgagctccctgtgcccagtccctgccggcgtattcagagccaggtaggcctcaggctcctctctgaagctgtcctctggggcagggtgggagcccgctgggagctggggtgtggcccaggggcagctctcagaaatgttttgctcctttcctttttggctgactctgagagtcccaggctcaccaggcccacctccaaggagctgctccccgggtttcaccaactcgtggttctaagcctcctgggggccacagacccctctgtgaatctgatggaagccctctccccaggaaaagagtggatacatacaattttacttgcagtggcaagtgttcacagaccccctgtggacccccagtgaagaactagcgaggtgcgatggtgtgcctgtagttccagctattcaggaggctgaggtgggacgatcacttgagcctagcaggtcgtggctgcagtgagctatgattgcaccactgcactccagcctgggtgacagagtgagaccctgtctcaaaaaaacaaaaagaactgctgagctaaaccagtttaggtcgtgaagcatacattcacacccggtactacttgggcagcacttgggggtctattcagataacaacaggaggcctggacacccctttgacccctttgatagacccttggttcccccctgtacaagttggttccctgcaccccagcgtgggtctccccgtacttcccctcccttatgtctccctcttcagatgttttcctttgttcccgaaggccaggcacccacgaggcggcctcgggttcccacctgtgtcacacagcccgggaaccacgtgcaaagcgatcccaagcggtcgctgaccctctctggtcatgagttgagggccatacagatccagtttcattcggaacagcacatggaccctctgtttctccctctgggagcacacagggagatggacacttgcaccctgcccttcacactctgcagccatgaggccaggaagcacttgaagggtgctctgtcatctgaacagaaaccccacactctttggtttttccatttctctccacagtagcttccacatcagcacagcccttccccaccccctcacccccacactccccaccccctcccagattctaagatctgaagcagaacatttctctggttattatcttcaaagctcctgcctggacctaactgccctgcatgtgaagccctgcatgtagatccttggaaatgaacagtctcaggcacacaccagccctgagaacagcaagcaggagggagccaagagcctgaggcttgtccttggagaaggttccttgtccctttggggtgactcatggcattaaggacagggtacttagaactctgatggtgcattgaggagctgttcaccggaaatggggaaagtcagagggttgggagagatggagagaacctccccccgccaccgatcacctggtaactgctcattccacgctttctgaagccttaggaccgtgcagagcagagccatttatctcagcgtccccttcccatcccaccacccaccttcttctctcacagcttacctgctacctgtgaggtcttggattagggttgccagataaatatgagatgtccaattaaatttacatttcagataaacagcaaatgcttttttaagaataagtgtgggcactgggcgtggtggttcatgcctgtaatcccagcaccttgagaggccaagatgggaggattgctggagttcagtagttcaagaccagcctgggcaatgcggcaagatcccgtctctacaaaaaataaaaaaaattagccgagtgtggtggcatgtgcctgtagttccagctactcaggaggctgaggcgggataattgcttgaggccggggaggtccaggctgcagtgagctgtgattgcgccactgcactccagcctgggcaacagagtaacaccctatctcaaaaaaaaaaaaaaaaaaaagatgttccaaacatttcatggcatatacttacactaaaaaacgttatttgtcgtttatctgaaattcaaatttaattatgcatcctgtattttcacttgttaaatctgggagccccagcctggctgagtgtgagaggcgagggtggaagtagaaagatgagagtccaggctggctccgggtaagagtggatgggcctgtgctgaggccccccaggcagcagcttttgtacagagcagaagtggcgcaggctgaggaacacacttttgagaaggacaaggtctcttcctgccaggagtctacatctcgtgaggaaggcaaacttggaaacagttaagtccactgtagatgaactaaatactagattgaggtacaagcaacatgctatgagatgaagaggaaggaaagagcattcttgggagagggaacaaagaagatgcccatatggtctctctctctctctttttttttttttttacttttatttatttagtttttagagacagggtctcgctgtgtcgcccaggctggagtgcagtggtgtgatcatggctcactgaagcctcagcctcccaggttcaagagatcttccagcctgagcctcccaagtagctgggatcacagatgcatgccactatgactagctaatttttttttttattttttgtagagacagggtcccactgtgttgcccaggctggtctcaaactcctgggctcaagtatccttccgcctcggtcttccaaagtgttgggattacaggcatcagccaccacacccggcccccatatggtcttaattagtgacagcagcctagggtgacatagccaaacacccacactctagtttggggggatttggttgttttttgagaattcttatcagggtaaaatatgtctctggtttccttccttccttccttccttcctgccttccttccttccttccttccttccttttcctccctccctctctccctctctccctcccttccttctttccttcttcccatccttccaatattaagtgtctgccttgtacatccaggcggtgtgccagctctgggacacattgatgatccaaagcagatctggttcctgcctttatgggtctcacagcttagtgagggaagacagattttagttaaaaaacaaagacaaacaatattgttttacaccattccagatgtaacaaaggaaggtgccatagacatattatagggaaaccttatactctgggatcagggcaggcttcctgaagaagtaagttttatctgacacatcagtgagttattttatcttattttacttttgagatgagagactcttttatgcttctaatgaaagccaaagactctctccccagacaagtgcatgaatgtgcacctgtaattctagtaacctttttggttatccataccctgcctgaaatccatccatgagcaccaggataacaccctctgctcttctccagaccttcttctctccccatatctcctgccacgagccttcagacccagactcacacgcaggggctgcccacttagaacccccaggtacggaggctttaaagctgtactgtccaacgcggtggccactagccacatgtggctatttaaattaaagttaattaaaaatttttgaaattaaattttaaaaattaaatgaaataaaagtaaatgttcagttccttggttgcacttgctagatcacaagtactcagtggcggccgtggctagtggttgtgtattgggcagatatggaacatttctattatcacagaaaattctattagactggtagcttagacaactttgaacacacaacaggcttgagctggctttctggccaccctacagtgatctgtcacctcccagccccttcctgagttgccccctgaaatcttctagggccctggcaagaagagggagattattctcctgcacagtttgcccatccttagggcttttcagctcagcggctattccaaacacttcttctggaaaccaggtcaggttcccgagagggcttctaagagcctttcagatgtgaagttaagaacagggaagaggtgaggctcttagtctccaagtggaaattggtttcttctaaaaataactcaccactcagccctatctgaccaggaaaaggacctgtcccagggaaagctgaccaggacagggcctaacgtcgaggcccatttggtgattaagggcctgggttgcttggaggtgcagttgaggtgggaggaggggcggcagatgcccttttcagttgctttctcacgggtggctggaccacgtttccagcctttgtctatttccttgcacagctccttcctggtcccactgaggaggggccggaagactctctgaagccctggctccatggacggttgtttcacaacctgacctacaaagcgctgggctacagtaattgctctgcaaacaccgactccaccatgctgctattgctttagtctgaactctggccagcgagtgcacagggtcaatatttgatcagaactgggagaggccctttattttcccctgcaccgcttggaagatagagttaagagggttgttcaggtttgctcattggctctgaaggacttaacctattttgacaagcttttctctctattccttattcatctctccagactctccacccatgcaccccaccctggggtcacactcactttccagctccccaacagcccacctcatgatgggtggaaaaattataattcctgaatcactaacaaccagccttggaatgaatgtgtatatgggtgtgggtgtgtactgatgtcacttacggagctttatgggatcattgcatttttagagttagaggagttcttattccaagtgcctcactttgcaggtaacaaactgtgttaatttttctattcattaaatttatataagctttcatttggtttaatatccaaagcaggcctcagctgagatcaacctggggtgatcccagtgtgtgccaagaaccaacctgaaagcagaaaagaggaggaaatgtctcttccgcaggcactctgccttttaatcattgagggaatttgttcgagattactgaccctagactaaagcgatgaggccacagcctggggaggtaacctgctaagttctaagaatgatcttgtaccaaggattgcagagagctccagcacacctggtgtggcagtgccagctccagaatgtgctgagcatgggtcattgtgaatgctcacatgccttagacagaggagaacatcagccttgactgaggtcattcactggtcccaggcaggcacagacagcctcatgttgtttgcaatggcaaaaatgggaaacagcctaaaagaccatccatacagagttgctaagtcaactgtgatattctcacagcacttagtacagcagtcaaagcaaatgagactgatccatgggtggatctccaagaaacattctgaacaaacaatgcaagtttcaaaacagtacttatagtatgataataattatataaaaaaaaacccaagaacaagatttatattttgcaggtacatatccagcatatgaatgtaaatgttttttaatctagaaggctgtactccagattggtatccgactcatctctagatgggggttagggatatcagtaggaggaagggcttgataaagggggaaccttatcttaatgttttactcttttagaaaaggagaatgcattcatatattatttgcaacattaatattgaatagttaaagagtcacctattgggggagctagggttggtgggaagtcaaaaataaaatatgtctttcctggtcattatggtataatgggacagaaagcacaggtgaaaaaagtaaacataagaacatgtctaacaaggaggacatgaaactcattataaaaatcacattacctcatatttcctggaccatcattctagatcattcctgtggaatgtaaactggttagatcccattacaaccaaccccagggacctgtccaaattatcttgtccaactggaatcttgtattcagatattactcaaaatctgcaaactacatattgaggcaggaagcagttgggtgggggttcttgtgtcatgacgaaactgtactcagagttgtgtgttgctggggcacagtggctaagggcatgtgctccagggccagggcacttgggtttcaagaccagccccagcgcttactgtctaagctttgatgagtgatttaacctctctgtgcttgatttctcatctgtataatgggtgtatagtaataactgcctcactgggtaacaggaaaaataaaatgacacagtccatataaagaaagcccttaggataggactggcacagagacgccagacaggtaagctgaaatgtcaccaattaggccctcagaagcttaaaactccaaaaagccagagagccccactccatctagagacagaagtttcttcctgtgccccgttaatgtagacatcactttcaccaaatagctcggcctgcctccagggaagagaggcagaaggcagtgttaaaggttttctagataaatgattttcaccttcaaagtttaactacaaacctatttcccttccaacaatgctgttaggaaaacattgttttttaaaaagtaattattagttgacagcttttccttgctcctggaaagaggcatctttgattcctgaaggaacacataggggttccaggggagccttgtggggcttccatcggctcttggggattccctggctggctccgctccacctgggagctggctgggctccagcgcccctttcaacttgtgcctgtggcctgagtatgaactccagcttcctcctgcctctcctgagttcccctttggcagatcctgttagcaggtgagggagttgtggaatattgggagaggaagaccagggtgaactggcacctctgggcaggctcaggatgggaaagccagttaccattgagtttgaatcctggggttacctgggtccggctggagggtgttgggaaaagtttgggttgatcttttttcccctttaagcagatggagtttgcaacttctcgtgcagtttcccaaccttgtgggtttaggaagacccctgtgcttgtgggggcctctcaggtccagagcaactcgggacctggttccaagcagatggagagaggtacggaaggaaggtggtggcagcggggatagagcatctaggagaggtctctgcacatctatgcataaagggaaataagacccagagggctgagctcaggccctgagaatcaccgcctcggggcctgccctcaggagaactctccacccagccagagcctgtggacatcaagagagctggggaacttgtgtgacactgaagccgctgggagttgtcagatatgcaccgtgctgtgggtctgtgtgggaaatcacacctttcctatacagttgaggactcgctctgtgagcctcattttggatggttgtgtgcatttgatccaggcccagggtattcacggtgttcacagggtgtttggccaaatcctattcctaatggactcaaggccctgtcagatcagaccctcatttgtgcagtagaaaatcaaaagccatctccgccctttgctgcacccccagcctctccatggggtcaatgtgggattttcatacagcgggggaagctcttttgtaaactggggaaaattgtaagaagctggaatgtcctctgggtgtcagtccttggcactgttcattggctctaaatttctgggtgacgtcttgtgagtgtgagtgctaggagccttgggggcatcactgctcccccagtgactgtccagcagggctgagaatgtccctttcagggagagaaatcagctgtgtgcaaatagcacaatatgggaggtacatgtttgtcaactgatgttaacgatgtccgctgggaaatcagtggtggaattataagttttccaaccaggaagcccttagagatatctagcaggatgacaagtatctggcactcatgttgctatctcccactcatgcctacagcagacatcactaattgatcatggcattctcctgtcctgtacccatggcaggcattgttaattgattacgagcccagacatggtctcagagtctttctaaaaaacaaaaccgagtatctttaggaagtcactacctatcagttggcaatggcaccttgagatgaaactaactggccgccctctgatcttgcccatttcccttatttgacagacaaggaaatgaggtcccaagcagggagtgatttgtccaagatcacagcaagtgacagcaggactagaactctggtactctcgcttctagctcactccaatctgagttcctagccttccactcagaagtcctctttctgggccgggcgcggtggctcacacctgtaatcccagcattttgggaggccgaggcgggtggatcacgaggtcaggagatcgagaccatcctggctaacacgtgaaaccccgtctctactaaaaatacaaaaaaattagccaggggtgatggcgggcgcctgtattcccagctacccgggaggctgaggcaggagaatggcttgaacccgggaggcggagcttgcagtgagccgagatcgcaccactgctctccagcctgggcgacacagcgagactccatctcaaaaaaaaaaaaagaaagtcctctttctgtttttggctgatgagggcaggaagcttctgttgcctcactgagagtgtgcctggagggaggggtggggaaccattcactctgcctagagagaagctgccgttgcaaagagctgaagacttctctctagatcccagaaaggtcgctggtggctccctcccaggctcagctgcttcctggagctcagcccacatctcctgcacaccgtcacctgcctctctcattgttgaataataaaccccagctttgccaggggcagtgtcagagtcagctcacaccaccttcatgactgttcagagctgcacaccttgttttcctggtgtgcagtgtcatgtcagggtgtgtttgggtgtcacgtcagggaggcgttggaatgcagttgcagcctctgccacctccttcctcctctgctcctaggcccaaaggtccaacttagaaaattcagctctgcccctactgggccttcatcttacccctctttggataaccaacaggaaagttgtctggaaagtgtgttgggtgacagtgcccccctccaaactggagaatgaagggaagggggatctttggtggtggccaggtgagtgttgtgtgtgtgtgtgtgtgtgtgtgtgtacgtatacacaccctgtgaagcttcaggtgtgaccaggtcactctcttcctgctggagggaatttcaagtgcctcctggcacctctggaggagcactagctacgtgcctgactccatgcatggtgctggggaccctaaggggaaaatccagagtcatcctgggtgaaagagccctcagctggcagagcatgagggtggaatgcacagaacgggtgttgccgcactaagtgggcagcccaggatgtagaccacctgcatcatgcctgcatgctgtgggcattccctttggcttgtgggggcagcttcgatctggggcctgaaggtcttgacatcctggtccttctaccccccccatcctcccccactgacgatggcagcagctggttttgtttttgactcttttggaatgaggcatgtagggcagtctggtaagctatgggagcctgagctgtgggcttttctgagggaagatagagttattcgtccctctgggaggcaatctgccaccagtgtggtgaccgggagatgtgagctgcattgattccctcatcagcagcccccgccccaggctggacctcagcttcctgatgatttcagttgctgccatccctgtgtctcagggacactagtttattttattttattttttgaggcagagtcttgctctgatgcccaggctggagtgcagtggtgtgatctcagctcactgcaagctccgcctcccgggttcaagcgattctcctgcctcagcctcccgagtagctgggattagagtagctgggattacaggtgcctgccaccatgcccagctaatttttgtatttttagtagagacggggtttctccatgttggccaggctggtctcgagctcctgacctcaagtgatccgcccgtctcggcctcccaaagtgctgggattacaggcgtgagccaccgcacccggcctcagggacactagtttagattggaacactgtgggagtagttgggatattggagctttttcctttatatcctcaatttagctgaagccaaggaaaaaagattttagatctcccagagacctccacagatggatgacatcaggctctccaaaggacttgtgggagtcctggtgccaaattcccaactttccaagtagggcagcatctcccagagatggaaggttcaggctgtgttatcagccagacttatttgggtttgcgccttggcctgcccctttaccagctgtgtgaacctgagttaccctccaggagtctccaccttcccatctgcaaaatggctgtactcgcagagcctgtcccatagagctgttgtgggatgtgaagatgagcctcaggaaagccttgccatcatggctggagcagcggtgaagcattattattatgagattgttggtgctgcctctggcatccctggagaggggaaggggctccgatcctccctgtgaacagaatgcatgcccagcctggattaggggaacatttttcccagccacagaagggtcttgggtacctccaagctgcagtaaatcaatgctttggggctggtgaggagacagaccccaaagccaccagggtttggctctatctgctaattatggagccttgatctggtgctcagtaaacaaagtggccggttcatccaccctggcagtcttgtgctcagtgctggctgaggggctcgggaagagcccaggaatgtggtccatttaggtataccttgttcaaaaagattttttttgtttgtttgttttttgccaaacaggaagaatgaggctggtgtttgggctggagctaagatgctggcagagggtctttgggtgggtgacaagccagggccattcttcctgctgagacagtcccggcagcacctcccgagggcagccctggcggaggccagcctgccttgctccccagggagacaggcttggtttttttctgggtttcccagggcttcactgctcatcttggaacctttgaggaggaatccccagtgggagggtggagggaaacccctctgtgtgtgcctgcccccactccatccagcagtgcaacagggtggggaccaagacagaagagactggggccaggcagtctggcaaagtgccaatgttttaagaaaactgtgtaggaggactccaaaatgggagactctatccattgctttatatatatatttggtgcatattgagaaaagtctgctgctgcctgagtctggcagttgggacagtttggaatacctgggtttcttggctgtgtagtcaagaaccagggtgcgggctggagccatgggcctgtgccctggatgggtgacagaatcacctgtgatctgggttcacctgcgagccagattaaaaatgcatccagattcctgttccccagcagcctcctgaatctgactgtctagggcaggctccctgtgtctggagttcagataggcttgataagtgaatcggatgcaaagctggacagaactgtggagtgctgggataaggagaccctagggcctgaggagctccctgtcacagctgctggtgatgcctgcaggtgacctcagtcccagcggccaagggcttctctcacctctgcactttctcctcagctcaggaagggcaagaaggaaggaaggagcttagggacaaacctgacttgctcctcctgaggcaggggaggttggggagcaggggtcacccctcaggctggggggactctccgtaggaaccagtgttggcacgtgctttgtgtcaggccctgccccatgtcctttccatgatcacccctgaactgcttacagcccaccctgggatgtaggcaccaccactctcccccatttttcaaaatttatttttattttatatttatttttttaagaggtctcactgtgtcacaaggctggagtgcagtggtacaatcatagctcattgcagcctcacccctgggttcaagcaatcctctcagctcagcttcctgagtagctgggagtacaagtgtgcaccactgtgctggactaatttttaaattttttgtagagatggggggtctcgctatgttgcctggactggtctcaaactcttggccttaagtggtcctcctccattagcctccttagtagctgggattaaaggtgcaagccacagccccccaacattcccccttttttaaaaaaaagagatgagggtactcaggtcacataggatgtcaaggtctcaccacaggtaggtggaggagccaggattcagactgggcagtctggtgctggaatccatgcgctaagccgttcctctctgctgccactttgatgtgctgcagagccagcctgggaagccccacacctcgaagaggagaggagtcctttcccttccttgccaagaaggcttcagctacagagcagaaggggcaggtgggggctgggcatagagagaaatggtcagtttctgtatgttcgtttccttgctctgctcaggagtcttggattctccctgtggtgttctctctctgtctctctttcctcagtttctctatttctctctgtctgtctgaggtctctgagcccatctctggctgtggctgtgtttgttcctgtgacctttccctgagcctccgtctacgctcttatgtcagcctccccggaggctttttctctcgccctgattctgtctttgccagtctcgtctgcatgtctcatcccaggatgcggccgcatcccaagcagaagtctgggagaagggcaggtggaagcctgctctggtctgcatgggagtctcctgctgggattagtgaaggcagaagcccttgcaggggaggaaacctgcttcccctcctcaggagactgtggggatggggaggcagctttcccgagagtggctcacgtacagacgcgccttttggaatcaggcggcagtcttggcacctgatggggaggctgtcctgcctcctgtgggcagccgtgatggccagccattgctctgtccccctcccagaagagcagtgactgcttcctcccttccctgggccatgctgtgcccgggggccctatgagtacaaggggctggcagtggcctcagccctcactcaggctacccccggagagtggggttcagagtccctgtgagtggggttaggggcacggagggcaggagtcttgggccagctcttccccttatctgactggacagagggtccccgggtctcatctgtctgttccattgcctaatccctgcccacccccatgctagctgttcctctaaggccacacctgccccattgctgttcctgctagaaatagctgagcagtgggcaggtgcccaggaaagggagtggctcttgcagggacaggctggcccccaagctgtcagcgatccaggtcaggtaggtgtcaggaacaggcttggggcagggctttgctggcccttgaatatcttctatcagtgaacagccgttttctctggtccaagcctttgccatcaactggaaggaagggttgggggtgagcacctgatcacatttgttgagcacctgctaagggcaagtgttggtgttcagagtggggctgaggggctggagacagatgcaacccgagctgacctgcagactggttacccgtctaagcagacacgcctagtaggctgccgctcccaggtgtctctgcgtgtaagccacacatgtgcctccacctcagtgtgttccaaacccagctgccatctggacccctccccacatcctccccactcccttctccttttcccccttctccccttccttcctccttcttacttctcctcctcctcccctttcttttcctcttcttcctcctccaccccagcagacccatcctcctgcctcctcactgcaccccccgagtttttactgggactgtcctgccctccagccagccgctgccagtgcttctctgtgctgcagcttctctccagtgtttatttgtaattaggaatgttttcaatcctatagaaaatgatatcacaggcatgagaggaccgactgcccagatttaacacgtgaatattttgccacatttgcttcagatatgtctcttttaaataaataaaatggtgcagatagaagaggtgtctggtcaatgctacattcccttcctcctgccttgggtctgcgtgtaggagtggaactggaggtggagaagggctggggttcaggtaggctgggaaggcgctccaggcacgggcatccacgtgggcaaggtgtgggacaggaccgccttgggcatgcacagaggcttgggcgacccctgcttctgtgacctcttggggtctgaagtccagggagggcgggacctggaaaagggcaggcctgcacacaggtgccccagcaacccccgagcagccagcatcttctctccctgcacttcctcctcctcctgcatctcattccaggtgggcagctcccctgtttgaaaggagcccatcacctgggtcagcagctgggctgccacctggagaagtagcctgcagctgggcaccagggtgggcttggaagacagcaagctttgcggggggacttttcctgttgcattcccaggtccctggcaggaggcagtttttcccccaaggagagcctcattagaagggctggcagcagagcctgggaagcacaggctgccccgggcggctcgcctcactgcgggggctgctttacaaggcttccctggcaacactgcccgaggtttatttttagctctagggattcctctctttttccatctgggctccaccttgttctccccttttcccactgtgaaggaacactgggaagtccttggcttaaggagattccaaaaagaagttataggagacgtctatgggcaaaataaatgcctgacctcagtgaccagggaggaagccatccaagcagcagatgccagctttgacaccttcagacctgtacggggcacacctgtgcctgggtcagctgctatgtgcatctaagatgccaaaagggattcaaacccggttgggaccaccccacacctggccagtcatgtcccatatccagcccaatagcaagtcagctcgtcctcagctcatcttctcagactctgccccccagagacagcccggatctgccctcttcctctgcatcgactctgcccccaccgtggtccagccccgcatcaacctgtcacctgggcaactgagacagcctcctcaggggtctccacattctcacggtcacctcctccataatccagtcttcccacgaatcagagccctcctaaaacataaaccctatcctggcagaccatggccttgaacctttctgaagactccctttctttttggaatgaactccaaactccttgcctgcccccaggccctgggtgatggccctgcctgcccttccagacccatctctgtcaccctcctgtcacttgttctcagcaccccagctcgctcgcttcacctgctccttgggcaccaagcgcagtgctgccaccaggcctttgtccttgctgttccctctgcctgcagtcccttccctcaggtccccaaggagctgactcctgggcactcagcctcagctcacatggcacctctcatagaatcagagagcccccccccccaaggcatgcattcatttcatgtactcttggtcactttgtcacattctactgtcttcaaaacacttattacaacctgttattatcttttttttttttttttttttttggagagatggagtctcccagtgttgctcaggctgaactcctgggctcaagccatcctcccacctcagcctcccaaagtctgggattacagggatgagccaccatgcccagcccattgtcttcttaactgttgtttactatgtcattccccacctccctccccttctccccagaatgtgagctttcagagagcaggatcttgcctgctccatagcttctgttttcccgatgcctagaacagtacctgccatatagtgtgtgcttgggaaatcattgttgaatgaataaatgaatgcatagtgagctgccgctggttatgaaggaatgggagagagaggcctgctgtcctcctcctccgctttaaaggcaagttttatttagctcccattcctcctcttgtgtgcccatctttgcctatgggctagatttactattgggatctgcttgttaaggattagatgaaatctttatggcagagaacaatgaggacttctcaaattttcatgtgcacatgaactacttagcaatcttgctaaaagattctgattcagcaggtccgcctggggtttgagattgtgcttttccatcaagctctgagatgatgtcagtgccacagtctgccttgagtagcaccggcgtggaacattgggaggatatgtttgaagtccctcttctccattcctctcttattcttctttcggtcccagtgtgatctttcccttgttaggtcatagcccttcgtgaccaggtggggatctgatctggtgaacttgggctttgtgaggagccctgttgcagcacttcccagaggctgcccaggaatggcgtgggctgcttcagagaggcggtgggttcccatcgttggttcctctgagcttgagggtcatgtgtcaggcatgctgatgtccctgtggcaaggaggaggctcctccctgcaattcagctttgtgtctctgtgtgctttctacaagcttgtgaaaccaggatcttgaggtgtggcccattcacctagagtgactttcagaggccatctggcaagtcctccacccttctcagtccttccgggggaaagcatggcattctaaccactgtgcatgtgggtttgatagatacagctgtgggagaggagtgatggtttagttccagcaatagttgagtcatgcagggaatgtaatgcctgacttgattggatctaaggatagaaccgcaggaggaatctacattttctattgccttccctcttttagtttgtttcaatagaccttgattgagctcctctgtatgagtcagggcaggctaactgctgtataacaaactcagtgactcaacatatttattttctgcacaggtcccagacctaaacaagtcactagagggctctgctccaggcagtcattcaggaactcagactcccccagctggtgaccccatcctgcgtggagttttgcatctagccagcaggcaaaggaagagagaatatgaaggactgcagggagattctgtgggttatgccaaagggaagggtacattaccctgctcatgtgccactggtcaggatttagttccatgattgtacctcccagcaagggaggctgggaaatgtattctagtcataggtccaggtatgtgttggataccatgatggacagtggaaatatcaaggcacagacatgactttcaagaagctcacaggcttttggaaggaaacagtttcacaagcaaatcattaagtccagtatggtaagcatagttctagaagtgtgaccgatctgcaggagtgatggggaggagggagctgtggaacagcaggttacacctgtggagacctcaggcaggccaggcagtgtgcagggacggacaagcaagggtggcagggcgtgtgactagagaggtcagttgagcagaggtcatgaataggcttgtgtcccacaggcagcagagagccaacaaagggtgtgaagccgaagatgaaatctgcagagtggggagcaagttgcagcaacattagagactggttcaaacttagcactctccttgcctggacctgcagagaggtttcacatgtatcttggtttctcatgccaggaaatttctaacagaggaggaaggggtggcagtggggaggtgactctccaagtcacctggtgcaggcagtgcttctggctggagtttgctgcgcctgcctgacctttgagggttccactcagcaacacagggcctggatggtggcttccagtgtcttcaaggatgctttcattgccctctcctgagttctaggatggcccagccactcttatttcctgggaaggccaaagaggctggtgctggttcacagccccagggctccatattaaccaggcaaggctacagggaggagctgaactctgcccgcttgaccccagccttctgcagtagcctactctttcgcttttccttttgacaagactttggaggaagaaggttctgagacctatgggcaccttgacccatttggaatagagaaaaaagtggggaatggagatgcttggggaagggaaggagaaaggcaaggatgttagactgtcatttagaagtgttccgcttggcttccctttccaggaagcccatcagggttgcacactgggggcctgctctggaatctccttgccttgagcagcagcctgggcccaggcccgctgagggtctgttttggcttcatctttgccaaaaagtgctctctttgtcccagatttcagtctgaatttgatcccgtagtggccagggcacttggggtaccacagttctaggccatttggaggatgagaagaatcaagaacaattggggctaggggtgtggttcagccgggaaaaggttaaagccgtttgccttccttccccttcccccttcttcagggcctcctcctattttggatagtccttgcagtttgtgtgagagagaaaagtgtcaggcagctttggggagaatttcaaaaacctgtgagtggtctctggcaaggctaggggatggctagagacccccaggaggaaacagagtgaccacagccaggaacctgccagaaaacacctcaaatctgggcagacttccttctctgcggagtgtcaccaccggcgccctgggctggtgccaggattcctctggctggctgtctcacacacagatgtttcttgcaccactctccgtcctctgtactggccagatgtgtcttcctagaattccactttcacagtgttccttcgctgctcagcagcctcaggggctccctattgcctggaggaggaagtccgagttcttcctctgtttcagatgacccctgcagccctgcccctcacactgccccatgtataccctccctgctccagcaccaggctcccccagctcccacacttcctagggaccaaagggagggaagttcacaagcagccggggctggcacacgggggtatcaggaggatgctggggtgtagctcccatccatagtaagaagccggccccgcacggcgcctcatgccaggcgggtggatcgcttgaggtcaggatttcgagaccagcccggccaacatgaggaaaccccgtctctactaaaataccaaaattagctgggcgtggtggcaggtgcctgtaatcccagccactcgggaggctgaggcaggagaatcgcttgaacctgggaggcagagattgcagtgagccgggatcgtgtcagtacactccagcctgggcgacggagcaagactccatctcaaaaacaaaaacataaacatagtaagaagccatgcctcaggttctgtgactcctggggagacactattccttctgccaggagccaggctcagagctggccacttgcagaatctcttatctgactccttttgtcactagctccccaggtgctctgctgccctggcctcatgctcttccctcttggccaaggggagctgaagtcacctgagctatctgtgttgggacaaagctcaacagccttaggatgagaaagggtgtgaaattataggtgaaaaacccaaaaggccttacagctgttggaagttagggttagatgggcttggcaggtggccctgagcagctccctgaaagcagaaagggctggaggagggcatcagagatcagggaaacaccaccggagtctctttaccttcaaactggcgaccccattcatctagcactcacggtaaggccagcacacctgctcacctgtattctcatttcatccgcacagtgccatggggcgctgtttctactcccattttacagatgagaaaatggggtcacaaagagattaagtgacttggccaaggtcatgtagctaggaaagaataagctggagttctgacttcagccctcaagcattccactactgactagaacactaataatggtaaaacagtgccaagggaggtgcctccttctgggggtttcctctgtgcctggcctgtgttaaagcgctctacctattcatttccccccgccttttttttctggagacggagtctcgctctatcgcccaggctggagtgcagtggcacgatctcggttcactgcaaactccgcctcccggattcacgccatttcctgcctcagcctcccgagtagctgggactacaggcatccgccaccgtgcccagctaatttttttttttaatttttagtagagacggggtttcaccatgttagccaggatggtctcgatctcctgacctcgtgatcctcctgcctcggctttccaaagtgctgggattacaggcgtgagtcactgcgcccagcccattttccctttttaacttcagccaccatggaggggaaaaacaggcatggtcctattttacagatgagtagactgaggctcagagaagttatgtgggaatgatgactcctggcatttggcagcacttgcttgcatcttctccttggatcctcacaacacgtgtggagacaggcaggtccagcatttcacagataaggctgtggttacccagagaggccaagccatttgccccagttgcccagcaacttcttgcaggctagaactggaatcctcctctgttgactccaacctagtgctctttctctcctgcacaaaggccatgggtcagcaggtgggggtctgtggaatgaggccactggggtaggtttggggacaggcatcggtacttgggcaccttttgggcatcagagagaggctttctgtggcttgaggatttcccctgggattgcatcctccagcacatctttgcttaattcaccctgtgtatatctcactgcaggtgtcgggctatccgcccaggcctagcatgttaaatgtcacgtcctggccagcccccacccacggaatgagctgctgggaaagccagaggcctcctccccaaccctggcccacgcacgccagctgggcagctcccctggggcctctagatgcccagagccaagctggcccaggccaagacgcctcccagacccatccacccctctcagtctccctgccgcctccctgacctcagggttgtagtttcctaagcactttccctggcatgagggacgcagcctggtgtcataacaagagtaatggtgacaggggtgataagaatagccggtgtgtatggagcacttactcagtgccaggctctgtgccaagcactttacctacattatctcatttaatcctctcacccacctgaccagtcaggttttgtccctgttcccatttcacagatgaggaaactgatttgaatgcagagctgcctagctattcacgatttatttttcttcacattttctaaaatgttgtgcaagcaccactgtgattcaggaagagactcttcatagtatacggacagatatttatcttttaatggttatgttttgttttaatgtgttaatggtatgggttgaagtttttatgtattcctcccaaaattcatatattgaagtcctagcctctggtacctcagaatgtgaccttatttgggaacagggtcatcaagatgtaattagttgagatcatccgggagtagggtggctcctaatctaacatgactggtgtccctgtgaaagggggaaatttagacagacacacacgcagggagagcatcatgtggagatgaaggcagagatcaaggttctcctttttacaaaccaaggaatgccatagatgacttacatccctgaagctaggggacaggcatgggacagaccctctctcacagccctcagagggaaccaacctgcccataccttgatattggacttctagcctccaggactgtgagacaatcaaactctgctaagacacctagtttgtggtactttgttacagtggccctagcaaactaaatagttagaatacacacacacacacacacacacacacacacacacagacacacacacgcatgcacacacttttttttttttttttttgagacagtggtgtctagctctgtcacccaggctggagtgcagtggcatgatcatggctcactgcagcctcaacctcctgggctcaattaatcctccctccccagtgtcccaagtagctgagaccacaggtgcacagcaccacacccagctaatttttaaatctatatattctgtagaggtggagtctcaccatgttgcccaggctggtctgaaactcctgggcttaagcaatcctcctgccttggcctcccagagtgctggaattacaggcatgagccacggtgtccggctatacacttatgatttgaagacagagaaaggggccatgagccagataatataggtggcctcttgaagctaaaaaaggcaaggaaacagatgctcccctagagcccagggatggaaatggctctgctttccccaacccagatgctgtagacagcagcttagtgagtgtgtgttattatcgagcaggcatctgagacctcccacctgccagtccccatcccagagactccagccacatgtagtgccgtccttgagctgggttctgaaaatgacttctccatctcgtcacactgctggtgatgctttagggcaccctaattacccctgagagtggcacatcaggcatctgccctcatccagccctggtgccagctgtgtggtcatcctcaagtcgctggaataaatgatcaggagcctccaccccggatcccagcactttctctgacatacggcagcatttcatggaatccgtgagcaaggcaaatcactcccatcccactgcttcctgtagcaatcctgacaggcccactgccgagcataagtccctgccattcctccccctggaaggccttcctcccatttcccagctctctattcaaggcctggctctgatgtctcttctgagacatccttttgctcactccagccacactgatcttgtcctttcctaaactcccatcgcctggcttttcataccactcagcaggttgacacccacttaatgctgctagttaagtcccttgtacccatgtgggtgtcccagctcccactcggatcacagaccatgactgacactcctgaaacctgctgatgtggtaaaggcctggttgggaagggacttgaagtagtgaaggcttgcatgttttccagaaaatggtcaaagaagacttctttgacttgttaaggaactttagaacctggaatgggctccctgtcaaagttggggtgtgttctagcaccgtgcttcctcagcgtggcatgagccatgtcccagctaaaagcatcccaactccttgccagggtggacaggtcctctctctctcctctcgctctctccctggctgttccttcaggcctatctggggggccactagtatggaaatggtagaagagtcacttaacttgaatatagatcattagaaatgatcaaatctgcataacactccaggcgtccagctgggacaccggaagggcggcactttagcagcaaggacctaagtaagaccctaaagtaaggcctactgtaaactcaccctaatcaaacccaagaataagtcctaacaatatccacagaggagacagaatttggaggttgagtcacatcaagttagaggtacttggaaaatacctaggactttccatagatcccccctaagaaagcataaaactctgcctacgtaagtttgaggtgattaaccattacttgaattggctactagaacaaaaatcaacacttttcagagaaaaataacagaatccagagtctctacagcatattagccacaatgacaagtataaaatgaaacattactaagtggtcaaagaaataagaaaatatgacccataggtgtaaaaaagtactagaaactaacacagagatggcccagatgttgaacgactttcaaacagttaaataactaaaggaaaatatggatttaatgattaagcagatagtagagaaatggaaactataaaaaatagagtcaaatagaaattttgaaacttaaaagtgccataattgaaatgaaaatttcactggatgagcttaaccgctagtatggaaatggcagaaggatcacttaacttgaatatagatcattagaaatgatccaatccgtataacagagaaaacagaatgaagaaacacacgcacagtcccagaaacatgtagtacaatatgcagtcttctgacttacatgtaacaatagtcccagaaatagaagaaaattataatggagtagaaacaaaacttttttttaaatggccacaaattttccaaatattgtgaaaattatcaacttacagattcaagaagccctgtgaactcccaaagagaataaatataaagaaaatggctaggcatgatggttcatgcctgtaatcccagcactttgggaggccaggacaggaggaccacttgaggccaggagttcaagatcagccagggcaacatagtgagaccctgtctctaaaagaaaaaaagacaattaactgggtggtgcacacctgtaatcccagctactcaggaggctgaagtgggaggatcacttgagcccagaaagtcaaggctgcagtgagctgggattgtgccactgcactccagcctaggaaacaaaagctcgaccctgtctcaaagaaagaaaagaaggctgggcacagtagctcacacctgtaatcccagtactttgggaggctgaggcaggcagatcacttgagctcaggaattcaagaccagcctgaccaacatggtgaaaccccgtctctactaaaaatacaaaatattagccgggcatggtggcacacacctgtaatcccagctactcaagaggctgaggcagaagaatcgcttgaacctgggaggagggggttgcagtgagccgagattgcaccactgcactgcagcctgggcaacagagcgagactccgtctcaaaaaaaaaaaaaagaaagaaagaaaagagaagaaaaaccacacttatcattattgtccctctcttcttctgtgatgctcgctgatgtgtcccctgcatgtaacacaggggactgcttagtcctcagctaagtagaatgaacaaatgaattctgaggtttcccgcaatcttgcatggtccccacagagactgggtggccttgtctctttttttctctttttttttttttttttgagacagagtttcactcttgacacacaggctggagtgcaatggtgagatctcagctcactgcaacccccgcctgccaggctcaagcgattcacctgcctcagcctcctgagtagctgcgattataggcgcccgccaccacgcccagctaatttttgtattttcagtagagatagggtttcaccatgtggtcaggttggtctcgaacccctgacctcaggtgatccaccccgccttggccttccaaagtgccgggattacaggcgtgagccaccgcgcccggctgtccttgtctctttttaaggggaatttctgggtcaggaaagccaccagctttttgtagtaatgcacccttttttcttgagctagatagaaagggcacaaggatgaaggtttgaggattggggcctgaaagcttgagtctctgggagctccaccctctgggaggggcgaggagccggcctcttgggttacagatgtgccccagctgggctcgcccgtcctcccctctcccctgcgtggattgctgcggagccctgccctgggagagctgccgaatcagctttctctggctggagccagcgcgtggagcccagctgtcccctatctctcacacgatccaccctttagataaacagcctggccgcctccacacactgcgaggttctgatgtggttgcgaggggctccattagccaaatgcctctcactccagccaggactctggcgatgggccctgcttttcctccagcctgagtcaggcccgtgctggagtgacaggagaatctgcttcctgcctgcaaaggtggtcccggagaactctctgctgggcggggccttcctgcctcaccgcccccgcgcccagccttcttcctcccagagggcggggcagcaggttcaggagacagccccgctcagccccgattgttttatctgtggaaactagccctgcaaattgggtactgaccaggttagagcccgctttgcagcctgcctggccctctaggaggggtgacatttgaactgtctctcaccgcccgccgatctgacgtattgagggccaagatgctgaactgtgcagctttgcaagtacaagccccacacagaatgaactcttacttggtttgctctggagtctgagcccagagatttgctttcgttgaaagctgacctgtgggcagaaaaggtgtccctggcagctggttagctgtgcttccgttttccgcggccagtggtccatgggggtgggggatgactgacggagagcagctccggggctctgctggtttatcctggtggtgggattaggtgacaggtgtggctgggctcagcacctgaggtcctgcccagacctgctgaatcagaacttgccaagagctgcagatgcatgttgaaggttgtgaagcctggctccttgatgtgaaggctgcagggtatgtgtgtgtctgtgtgtgtgtgtgtgtgtgtgtgtgtgtgtgtgtgtgtgtgttgttttgacggagtctcgctctgttgcccaggctggagtgcagtggcacgatcttggctcacagcagcttccgcctccgaggttcaagcgattctcctgcctcagctgggactacagatgtgcaccaccatgcccacctaatttttgtacttttttttagtagagatggggtttcgcaggctggtctgtgaactcctagcctcaagcagtcctcctgccttgtcctcccaaagtgctgggattataggcgtgagctactgcgcctggccatgaggctacagtttaacttatttctagcacctaaggcagagcctgacatggagaaggcatacagaaacggttcttgggggaaaggaatgaatgcatgagtcctgcctgcccctgcccactccccacagcatcacattccctctgcactgtgagaatctcagactcttaggtctgaaagagatggaggagtcggagaacatatgcatgtcagagctggggaaaaaatgtcaagttttggtagcctaactcccttaagccccagagagatatagcaccttgggtgaggtctcaccacttgtggtggaatagcgggtcaccttgtttcaggagacaggtggttgagataaggacaaagcgttccatacctgggcgcgtgttgctgggcccacctctctcctcagacatctctgtacctcttcatcagaaacctatggagtcatttctcagaggccccaatgacatgttagttatccatttatgaattctcattcttcttatggaaaagatttaaggtacttataaatatgcatagaatacaacaagataaaaagtaaaaagaaatgcattgttattaaggaagtgtgcgtagacatgtgaacaaggggattcacgacagtgctatatatagtagtgagaagtcagaaacaacctaaatatccaacagtaggggagtgggtaaatacactatggcagcaatatcccaccaccaggataagccagcagagccccggagctggtccccctgtcagtcatcccccacccccatggaccactggccacggaaaatggaagcacagctaaccagctgccagggacaccttttctgcccacaggtcagctttcaacgaaagcaaatctctgagctcagactccagagcaaaccaagtaagagttcattctgtgtggcacttgtagctggcaatatccagacattgaaattctgtgtcctgattgagaatgctgacgtgtcctgggcacagtggctcacacctgtaatgtcagtgctttgggaggccaaggtaggaggatcgcttgaagccaggatcttgagactagcctcacagtgagatcccatctctacaaaaaagtttttaaactagctgggcattgtggcacacacctggtcctaattacaccagaggctgaagtgggaggatcacttgagcccaggagtttgaggctgcagcaagctgtgattgcacactgtactccagcctgggcaacagagtgagacctggtctcttaagaaaaaagaacattgatatgaaagtattcattgacatggaaaaatgttcattatatagtgtgaaagtattgatgggttcattttatttacatggatggaagaatgcctagcaaagatagatatcccaaaatattaatgtcagggagagagattatgagtgattcttagtttctttttgaccacccactgctataacttctagttttttcccttagcgaacatgaattccttatgtcgtagtgtaatatagaaatgaaatctacaaaaacagaatatgggtgaggaaaatgggaaaaggagaaaataggagtcctaatctgtatagaatttatttgaaaatgtattaatttttaaaatcctttgctgagcattaaggtataggaaagaaaaaaaaatcctgtttagagtgttatggcccagttgctgtttttacacatagcaggcaattattaatgtttgagagtttgacttaaaacattgagaactcacgtggccaggcgccgtggctcacaccggtaatcccagcactttgggagcctgaggcaggcggatcacttgaggccaggagttcgagaccagtctggccaacatggtgaaaccccatctctactaaaaatacaaatgttagccaggcgtggtggcacacacctgtaatctcagctatgagaatagcttgatcctgggaggcggaggttgcagtgagctgagatcgtgccactgcactccagcctaggtgacagagacagactctgtctcaaaaaaaaaaaaaaaaagaagaagaagaagaaagaaaaagaaaaaatcatgagccagcttttgttaaatatccatctgtattcagggaagtgaaagttaatcatgctgcagtctttgtcttgttttgaatgtaatcaccggtgacctgcccttcattatgtgggatctaaataacctgggtatattgggtaatgattatgcaagagacaatcctaaaattgtgtgttagagctggatgggtggacaaacggatggatggatggaaataaatgcgcgcgcgcgcgcacacacacacacacacacacacacacacacacacacacacacacacagagtctagcctagaaccatgctatagcttggatatttgttccccccaagtcttatgttgaaatttgatacctggtgtcggaggtgggcctaatgggaggtgtttgggtcatgagggctgatccctcatgaatagttggtcctgttctcatagtaatgagtgagagccagttgttaaaaagagcctggcgcctcccccttgccctctgcttcctgtctcgccctgtgatctctgcacatgcccactccccttccatgccgtgagtggaagcagcctgaggcttcaccacatgcctagtagattgtgagccaagctaaataagattcttttcttgataaattacccagccttgggtcttcctttatagcaacattaaacagactaagacaaaccgcttttcaccacctccagtgctaacaccttggtccaagtcaccttcagtaggatcctaactggtctccctgcttccaccctgtggtccattccctacgccgtagctagagccgtcttttctaagtgtgaagcagatcgtctgtctctgcacagaactctccaggacttccccttccatcacgacaagccctgagtcttcaccacagcctcaccaggccctctgtgctctggcccatcctgccactcagatctcattgcctgtccctctcatcctggctcactccactccagccacatcggccttgccaggctctttttgcacgtcctgcttccctgcctgaaacgttctccctctccagcgtagcttgcttcctcgcccccctgcaggtctctgtagaattgctagctcgaggtcaggccttctttgccgccctatataaaatgacaactcctgtactgttcccgtaccatatcctacttgattttcctccgcagcactgatctgatcttccctggcacatgacattcttacttgtttgctgtttgtctccctccaccggagtgtaaactccctgagcgcaagaactttgtctattttctttactgccctttccttagtgcccagtgctgtaaagtggatgctcaatatgtatttgaaagactgattggacttcaaagatcatgtgactgatccttctcattctaccaaggaggggcctgaggcccaaccttgagaggctccattccttgcctgaggtcacacagctggggcagcaggactagatcatgactcccctcctgcctatgcctcagaaaggaaatcagccacacacaaaggggccctggcctcatccatcctgtctcctgtgtgtttttccagtttacatagaatttcagtccagaatagcaaaaaaaaaaaaaaaaaaaaaaaacaaaacagttgttcctccagaaccctggaaactcttccagtgggtccgtccttggaaaaacagcagcgacctcagggtgggaaggtaggaagtggaggaatggtcttccggcagcaggggcaatgggatggatttggttttgcaattaaaataacagctggttctgtttccacagcacggttctggaaggtgggtggtctgtctaaagtatcaggtggggccttcccccatcctggcccaagagggttcgggatggccagtggctgaaggattcaccccacagacgaagtaggaaagaaactaggcccaaaggagcctctggaaaccctacaggcagcctggcctgaaagcctctggtccctaccccagccttgctcggggtcatctcctgacaccttcccctgcactcctacccgctcactgagattgatcagatgccctctttgatgcagagagagctttggcctcctccctctcatgccccatgtggtttgttaatcatctgtgaaatgagggatctcaggcgtcactcatccgtgtgaggacactggggccctggagcagtggagtgagtggggaagggatgatgaggaatgttctggtcttctgaatcctgtccctctgtctgtctggcttctcagatgcagcttttggataagtttcccattgaaggtggccagaaggaccccaagcaaaggatcatccccttcctcccaggtaagcattgggtggctccacccagggatgggggatacccgggaaggaccagtccttcccttaggccgagaagagtactaagcagcagattctgggcggggcatgcccaggaatctgcatatgaacaattcccccaggggatttggaagctccagactgtgaagtccactgtcctccaagtggcttctctcaccattacaagaccgtctctgctggctcctggcctgtagcttctgaggagtttctcaggctcctggactttggtttccttttcacaaaaagcacagagagaccaagttctatgaatggatgaagagctgcaggctgagatgtttgtactgactcccattctaatcacggataaccttaaattgagcgcactccctgatctgatctcctccagtcctcacgtcaccttatatggaagaggaggcttacaccattttggagtgtgtttaaggcaatcaattacattatgtaatttagaggaaaacttctcaggtgtatcataacctgttattttgatgatgtcttaagtgtgtatagagatttatagccatggagtgcttttttatttgttatcatatgcacatctctataccgaggtgtgtactataatctcccccaatgggtgaagaaattggggttcagacaggttaaagaactgcccgtaaaagtggcagagctgaggaataaactcgggcctcctggtccatgtctggctctgccctgcaccagataagcgatgctgtctcttggctctccagaacccctaccgttccccagaagagctcccttcacagtgggcttccccccgggctcagactggccctggacctgcacaggtcaggaccacagtgatcagtcagaccttggcaagaagcagggcctgcaccttgctaacccctggcacactgccagcccacagccagtgcctgcttgctgacttgaaaacggatgtaggggcacctccctcagagagcggctcctctctgaaaggcgtttctcctgcattcctccatcctcaaaagcagcgaaagatgtgagtccctatgaccgcctgtcctcagagtcctatgctatagctagagataattagtttagctacaaggaagaacttctaaattccacagtttgggcaagactggaactagtcagtgagggtgtagggactctcggcccctggcctccccgcacagggtcatagcattgctccttcattcctggcccaggagttcacatggggtgacttgcattccttgcttggctttgcactgggtcttgaatggaatgtccagcatccaggttggtgacaaccttagatggtgctccggtacagtctggaagctcagtgccagggtttggtagcccatctgggatgctgtgggcacaagagtcctagaggcaacctgaggccacagcgtgttaggctggccttggggcatgaaggtcgcctgtttgctccagaagaatgggcttctcccacttcttcctcagctagcactccagagaaagagcaccccatcactattccatcagcagctgtttaccagggctcagcctgtcagagctgatggggctgggtggcctggtgaattaaagggagatctgaatttgttttcctcatctacggaacgctcaggctagtggagagaagacctgctccatcatcccaggaccatttaaggcaggatgtgactgtaccactgtgcaatttgagggtgactggagagggagctcagagaacagtgacctcattgtgagctgaggaagtcagcagagacctcctgaacgaggggggcctggagctggcccccacaggatgggtaggcttggagggtggaacgcagggcaaaggcttgtgtactgccgctacctcagccccttgtctcaggagtcaaactgcccgggttcaccctggaaaccctggctctgctgattaccaatacagagaagttgcattagcttctctgtgcttcagtttcctcatctggaaaatggggataatgatagaatgtacttcgtggggctgtttcaagcataaaataaatgagtgtatctcaggtgcttacaactatggcagctcctagtaggggccaaataaatgttagtccttattattactaatgttccatacatgcctagcattttacaccacaatttacatatataatctgatttgatcctcccaactaggtgatcatccccattttactgactaggaaactgaggccaagggaggctaatagacttgcacaaggctacacagccaggaagcacagcccacaccagagctgtcattcctgactcctgggccagggctcccttccacatcagctgcccaggtgccgagaacacaatagctgccacaggactgaggacctctctgaacttcagtttccacttacaggattgcagtgaggattaaaagaatttacgcaaaacactttgcacaaagtctgtcttacagtaaataataaatggcagctgttaatcaagaaagtcacctgcccccacaccaccgtcacctactgggaaaagtcaagcatggagacaccttccagctcccatgcaaatgtgacctgtgcatagcgggtgatgttgtcaggaggagtgaggttgactcgcccccaccctgtgcccttctttttcctggtttggcttcttttcttgccttgcttcagcagggttccctcttagactcctcttcagctcactcactctccaggacttcaaaacacacattgctggccatttggaatcctaccccggggttcccaagccctgtccctggccttcctcctgctcactagaaactaccttaaccctgttatgctctgctcactccttagctcagacatgaaggaaaaagatggaggaaaaataacgcaacacaatcagaacctggccagggcaagttgagtgggtgtgaggattccccatccacccccaccgccctgatgcacagggcttccaggaggagagggtgtcagagaagggcagtgatgaacattgcctgtcttaggtcaagttcgttaaatgcagagcctgagatgaggattcgcctgctagtggcttttgagggtatgctctcacgtgaacttcctgtggcagggaaggaaacaggatggggcagaagaggaagtgaggcagagatgtgtgttcagctaagtctagcctctgcctgatcccacggggagctctggagggtgaatggcaccacaaaactgttccatcttaggggacagcttttatagcccccccacatcagtcatccattgtctgtgggctgcctcttcttccaaagggtgtggagcatgggcatgatggctctcatggccgggggcatgcatctgaagaagggggcagctggaagcccctagcagtagcccacactcacagcactgaggggaggagccgcagctggtacaggggctcaggacagcatctgctatacacactagcaccagctcaaggctctgcttctgcttccttgcctctagggagggtgtctgaagggaccctgctgattcccccaggctcacccccagcagcagtgactcagcagaactccagagaacttaacagtctttcaaccccagggagggttagcagccagccttgagaatagccttgccagccctttgcctcacctgaaatttcagagcaaggaaatcccaaggggtggaagcagagagcacctattatttccagaagggtctcaattttagctccagagatgctgggatgtgctgagcatttctgttgcccaagtgtggagtctgcgggatgtgcttggagtgttaggccagctgatttgctttggcccatgtggctgcaggctgatggctgagggctcatagaaattttactggctggtggagctgacagagaaattagagacaaagggaaaccatggcttggttacatgcttgcccatctgccagtcaaatcctggcagaaaatctcacacatgggccgtaagtcttgggacctaggacacagtcttgtgatatgtctgggtggtgtaatggtcagttcagggtcagcctgtagatttgaaaagtggtgagtgcctggggctcctgtggtcaaaggcagaagctccatccctggagaagctgacccagacagggctcattggctcttgggggacagatggagtgttgtgcagtggtgctgaggttgggggtaaggattgggggtctgtgagtagggccaacaaggtggtagagtggggagccagtatactgctgacccaggggctgacattggcatatccatcaaatcctatagaaaattttgtaggggaactgcccgtaagagagcccccgaattgttttcatcagggctagaacctgctttctggaccctggaagtgaaaatccactgtgtctgggaccaccagcctttatgaagtctgcagagccttggaagggcaatgagaagctatggacccacgtgggactggcagttctccagcaaggcatcctgggaaagaaaacccagacgtttcatggtcaggaaggggcagagagttactccagagcccagacaccctgaagagtggtggtgggggcaaggggtagagggaaggaaagggagcccccccaggcctatgcctccaaaccccgtattatgtgagactgagggagacacacccatctcttttgctggcctttgcagccttcctttgagacaaggcccttatccgcctctgtcatgtttctatcatgaggctggatggggggtgctttgttaagacatgttgggcgcagtggctcacacccgcaatgccagcactttgggaggctgagatgggtggatcacttgaggccaggagttccagaccagcctggacaatatggtgaaacccccatctctgctaaaaatacaaccaaaaagttagccaggcatagtggcacatgcctgtagtcccagctacttgggagactgaggtgagagaatcacttgaacctgggaggcagaggtcacagtgagcaagattgtgccactgcactccagcctgggtgacagagcgagactctgtatcaaaaaaaaaaaaaaaaaaaaaaaaaagacgtgttgattgctcctagtgtgtgcctagccttatcctagccactctgcataccttccctccagtctcactgcaggtggctttatccccattttaaagagaagtcaaatcactgtccaccatcacttagccatacagcagcagagccgcgattcttcctatggggccgtatgtctttccttgggcaagaaggaattgccacaacagcctcagctagactctgtctttgtccctcccttcttgcctgcacacctcccaggttagggatctgagaagttctgcctgagacagaccactgggaggtccagcctctccctcgggctgtcattgctatctcatgtttcaggagtgccctgtgtgggtggcaggtggctggaacctcacggggactcaggtgacctgtaagggttctctcattccattgagtggccgaggtaattactcaccagcacagagtaattgatatttttcttgcaattaaaccacttaacttattattttaatgattacaaataagatagtcccaaggctttcagagtgctatcttcctttaattatgatctaacaagtttggctatttggtttcctaacagcatttttttaaactttttattttgaaataattagagactcacaagaggttgcaaaaatactaggcactctacattcccccctccaattccaccactgtactgcagggtagctggcattattcccattttaaggagaggtcaaatcactttccaccatcacatcacttccccccaatggtaacatcttatgtaaccgcagtatgttatcaaaaccaggaaattaatattggcacaactcaactaactagaccacagacctgagtaattgatttttattttatggaggtggagagtgctgttaaacaagcatgtcagctggtctttaggaaggaggcagtggtttgataatagtccctgagaaactgtactcccaggcccaacctctcggcattcccatcctcaacaaaaaggcatattccagaaacctgtgcaaattcagctctttggaacaaatcacatgatcttttaggtgtccaaagtattattctattcaaaagaggcatataataaatcctgttgcaaagcaaggaacttttaaaaaaaatattcttttaagtattcttggctgggcacagtggctcatacctgtattcccagcaactcagtaggctgaaacaggaggatcacttgaggataagagtttgagaccagcctgggcaacagagcaagactctatctctaaaacgaacaaacaaaaaacatatttttactccagctctcttttgattaaaaaaaaagtattcatctttccctcgttacatatacatatttattttatatacatatattgtattgtatattttatattttatatacatgtatatattttaaatacatatatatatctttttgagacagggtctcgctctgttgcccaggctggagtacagtagtacagtcacagctcactgcagcctccacttcagaggctcaatctgtcctcctgcctcagcctcccaagtagctgagactacagttgcgtgccaccatgcctggctaatttttgtatttttttgtagagatggggttttatcatgttgcttaggctggtctcaaactcctggactcaagtgatccacctgccttggcttcccaaagtgttgggattacaggtgtgagccactgcacctgacctggtttacatatatttttatactttgggacttctcctgttcctccaagttccgtaggtgtgacaagacgggctcagatgaatgcctgcatatgcagtgagttactttataggaggggagcctgcatctttttataatggatggtaagcaaacctgcccttttgctcccaagatggacactatccttagtccaagactatatgcaaacctgccgtatgccccagagcaaggcactacctctgtcttctaaggctgtttgctatgcaagcacctttgaaaagatcatccaaaacaaaaagcagttagtgccttgtttacaagacatgtacaacagcaggaggcccagggagaattggctcagaagtgtgccttagcgctttctgaggtctcttgctttttggaggggtgggcagaaatcaaattccttaggacattgggccaagcgtggcggggtcaccagcctctcagggcagcctactgtttacttggaattttctgccttgttttagaagatgactgtggaaaatccatctcctgttgcccatcctgggattggagtagatttcctgtgtatcccgagtttgctggcctgaggagactccctgagaggaaatggtcattacgacatgaagtagagtgtgtagctgctgatgtaaaaagcaaacaactgtggccagggattgagggacttcagaagccaggcagtggagcaaaaagagctgcactccctctgcaaaggctgtgcgaggtcccctcccactagcaagccatctgtgtctctgtactggctggcactgggcctctgggcttccagaaagcccttcatcctaatagctgagttagtcccatgcatcgctatccatatccccaggttgatgagtcctggagaagtgagattgcttagggagaaaagtgaatctataaccataatcaaggtaggcgttgccagcctgcagacagccttgtgaccttatgagcttagaggtatatttttagtcagcaggcatgcttgcttcttttgtactgactcgccagtttacgtaacggccctgtaatgaagaggcagtttggagccacagtgcagagggtgctgggtgaattgcaagcatgttctccggggccttcctctcccagcccccagagccctgtgcagaagatccggtatttgttccagcatagaaggaagcagggggaagggatgtctttaactagagctggtccgtggcccgctccctgggctataggtgtctgtgtgtgtctccaccaggcaccagctgagaaagcccttcctgaagggccctggatgctatgagggaggttgtggctcagagatttcaccagactgcaacccccaaggaagagaggttgagaagtttctgggtcccacaggtgacctgggatgtcaggaaaagccaaactatgtgatggagaaggaaaaatagggtctgttggtaattctggggtttaaaaaggtcaacaagattataggcctgagaggcaccgtgtgccatcttaaacacagctttcctccaacctccactggaggtattttgtcttctcttgatgtaattactgcttcccatccccaaaaatcagtctcctactctgtaatctggacgggcagttttcagggcctgctgtcagcagctgactctgaacacagcgtggaatagctacattcattcctttctatcacagatatttattgaacacatactgtgtgccagctgtggtcactggtgatatgactgagaacaaagtaggcctggttgtggttctcaggaagtttaccttccagtgtgggagtcagaagacaaatagatgagcaatttccaagagtgatgagtgccagaaggaaaaataaccaggtcatgtggcaggtgctacagctcaaggcatctgaaattagatggtcacaaagggcttctttgcagaggtgacatctccactgagtaggtttggatcatcagggcccaggggtgccaggcttggggggacagcaagaacagtaaccttagtcggaccaccggtatatgtttgaagaacagtaagaagtgtgtggaacagtgaggagtgctgagtcacccagagacagctgggcagacaggacttgtggagccaagacactccagagcggctccacctgtgtgtttgtgagctgtgccatctggcccagtcacacggactccaggctctgtagcatcatctgtcaaatgggttgatcatggtttggtgacatcgcaagcagttaatgcatggaaagcgctgtgtggcgtgcaacgggagaggactggtgccgcaagcctgtctgtgctcgtggtggctttgccgcaggacacagatgtgggatttcctttgccctccccactctgtgctgagtcagctcttcccactgcagcccaggccgcagcccaggcacagcctcacttcctgcagttctttcccggcctgtggtaacttgcaaagcagcaaggagcttgtttctaaagagcagatgacccagatggctgatctgggatgaaaggtggggatccggcctctgatcacatggcagtgtcactgtcactaccttccagactccgagctgcagaccctccaggtcttgcagggagtaacaagctttgcaggggtcagccacgcaaggggcttttttacttttgaaatgtagatcagtctcccaagcccttcccccgcgacatccccacattccaagaccaggaaaagagccaggccaccttgttacaacttggtatgtgccttcccaatcattctagaagggaatcagctcctgaacacctacccccaaccctccgtcctggatggattgtatcctaggtatcttccccaggaactttctgatctgggccgaaaagcctgtctcttctcatggtctcagtcagtctgtgtcatctaagacgcagaaaatgcacccgggcctgggtctccagagtcctggattctagtgcaccccatgctaatcaccatggcacaaaattgaagaagttaagtttgagcaatcagggatcaccttgcttgttggcaaagtcaccagaaagtgacaggcatgatttcagggctcggtgacactcctgtcctttaccctccactccctccccctggaaatacatcctttccttacctgatgcctaaatgtccttttacaaggttggatcctttccctccatgctgagagagtacagttataccctggtgtccccagggttggtgcttccagccaactcatactccagcgtagatggcagactggatggttactgagaccagggttgatagaggtgagagggcaagtgggcagctgaggctagagacagaagaaggtgctaggcctcaaaggcctgtgtggagtctggagaaggggctggcgggagcttgcacggagcagaggagaccagctggggtcctggagaggcaggtgagagggcaaaggtgacttggcctaggctgggccctgggtggagggaagtagactgaggtctgtcttagaaggacagccaagaggccatgctgatggattggaggtggtggggtggggtcgaggatgactgcccatagctctgtctgggcagccctggccaagatggcagaaggagtgtttcacctcaccaccactccccactcctgcctgtgggctgcatccgtgggggtgaagggaaaggacttcctccctcctccctgaggtggccgaagcctttggagcatatgaaaggtgctttgtggtgggcagcctccctccccaggagcctctgggcactgggcactctggtttctgggtccaggtttcactgagggctcgggagtggcagcagcgggtgatggtggtggaggggaacactgaggcgcattgagaaggagctccggcccccaacaacttcttaggaggtgaggggcactggaagagataaactcccacagtgtccctggcctaatcccgcacactgccctcctgggtcactccaactggacccaggcccaaggacaaagccccaagccagagctcttctctggcagggactgagctggctctaggcatcacctgtgtgaactgatgtatcattcatccagggctgcctggcacccagcagatccatcgttctgggcgctgaaaatacctcctcccccttcacctccacagttcccaggactgatgtccactgaggaggccccaggatgccaggctgcccagcctccagaccacagttggccccaggggactggcatggcctgaagatggagcccgttcatctgaatgtaccttcaaaagggaagggaggaggcaaatgtggagggtgggggttggctggcagcctcgcctttctctacctgtcagggacagggtggcctggcgacacccctgcaggcttcaactgtcaagatcgaagctcgtgtgaaggaaaggggctaggtttatgtttctccccaggcccaaacaggagaagccagatttcgccttagtgaggacacatttgggtggatctcagagagaacttccagggacaggaagaacttctcagcgggtagggggtggttctgagcaatgactttgggctcctgcagatctggttcatacctgggctttctacttagtgctacttgcctgaaccaaaactctgctattttccgtggctgagatgggtagctatcgtacttccacactggaggacttacagccagacaaacctggggttcaaatcccaactcagcaggctcggcatgctgtctcacatctgtagtcccagctactcagggggcagaggcaggaggattgctcaagctcaagagttcgagaccagtctgggcaacatagtgagaccctgtttcaaaaaataaaaattaaaagaaatcccaactcagcctcttcatagttgtgtgactctgggccagttttaatcagtttaattctgaagctccatcataatccccatctctgaaatcccttcagggttattgagagcatcaaatgaaatgtcatctgaaaagcacaaagtaagccctcagcacacgattgtgatttggtaatttttagtatcaggtccctaacaaaattgtgagctgtctctgggatggtttgaatgcagcctcctagaatcccttccaagagtgaggtctcttctcaggagtgcggtcccacagccttgtgtgttttaaggattgctgttcaaaatgtggtcctcagatcagcagtgtggccatcatctgggagcttgttggaaatgcagacacttggcctcccccaagatctgtaagtcaccgtctgcattttaacatgcacaggtgatttgtgtgcaccataaagttggagaagcaatgtttgaaggtccatcagagcccttctacaggaggtctactgtgtctttagggctctcttggtgcttggttacgttcagttcattcacataatacaaacaactgagcctgcaatgaatccatttctgactcaaagtagaggtgcatggggagacaaggatttacaggggtaacttggtgagggctggtttcttggcctcacatccttacatacacctgagctgcctgcctgtttctggtattctgtgggagggagtcgtgagtaacagccctctctccccatcactagcccaaccaggaggatgctcaggtcccaaccacacgccctcatcagatatagatcagaacattctctctcccctcccttccaagatggggtgaagttttgggccaaggagattgctaagatttttattttagaagttccctgattggagatgggcaagactggctcatgaactctctgtggttttgaagatagggtggcatgagaacgtctaaagcctatgtctggagttacgtcgtactgttaggatggaaaacaggctcttgtaagatgtctctggaaaaagttaagtcaacaaaataaagtgaagccaagcatggtggcacactcctgtaccagctactcgggaggctgaggtgtgaggatcacttgagcccaggagtttggggttacagcgagctatgatcatgccactgcactccatcctgggtggcagagtgcgaccctgtctctaaacaaaattggttttaatttcaaaaaagaaaaaaaagtgaaatttgaaaggagcatattttgctcttctatataaaataaccattgcagacctaagcttcaaagtaaaggagccagggaggagagttgagatgagtgagtgactggtaatttggtggccaggtaattcttctctgattggcacagtttttactcctggcctcttgtttctgatctgaaagacgaattaaccagtttaatagttggtagttggtgaagatggcttaagtgagacctatgtggtcttgttaccagaaaaacttgctggtgaaagacagagggtggagcagctgttcacgatgtgagcccagtggtccagagataacaattcgttgaattggctgtagggaaaaagttgcaaacagctttctaaggaactttgtgtgaggcctggaatttcaacaaattaaactattataaatgagagagaatgtctgcttaaggattatagctactacttattaagcatatacttctgccagatactgtgcaaaggattcatgtgcttatgttgtctcatttaatgacaagtctacttgacacatgaagactcacaggctagaaggggtgcatgacttacccaaggccactcaactagtaagaggcagagctgggcttcaaacccagttccctccacttccaagcccaagctcttgataactattctttttttttttttttttttttttgagatggggtcttgctctgttgtccaggctggagtgcagtgggacaatctcgactcactgcaacctctgcctcctgggttcaagcaattctcctgcctcagcctcccaagtagctgggattacaggcgcccaccactatgcccggctaatttttttttttttttttttttttttttttggtagaggcagggtttcaccatgttggccaggctggtctcaaactcttgacctcaagtgatctgcccaccttggcctcccagaatgctgggattacaggcgtgagtcactgcacccagcctttgaccactattctttatgtccttgccacaaagtgggattgaccaaagatgtactgtctggagattaacagttaagatttggtataaaatggcaggtatgttgcctgcaccagggtgtttgcattatctttaaaccttgtttcaagtattatctcatttaaatatatatatatacatattagaggttgatcaatgttgtccttttaataaagtatcacattcttatggtaaaagttttagctagattacattattttctcagtcacctttcacttaatctatcaactgctaccagccacctagtggcagatgctggaattgcaggcatagtgtccagaaggaaataattgaattctggaaagctggctttggaaacccaaacctatgaagtaactctgtaatgataatcatcacagatattatttcctaaaccacgattcaacagagtactgaaaacaaggaagaaagatgtcccactttactgttatgtttctatgtgacacgaaaactgagaagttttcctttgaggcaccaaatagaaccttaggaaaagtcgcagggttttacttattcattcctaaaacttggtgagggaggaactctgggcctggggtctgctttgctgtccggtttcttttgctgtgcatgacagcagtttctccaacattagggtggtgttcttctgtgcattgtaatagatttgtatttattagttcagaatcccccataaggataagtcacagcccttctctgagcctgagttccctcgtctgtgaaatacaagtattggacttgatgctgtctaggttttctcatagtcccagcatttagtgatctaatagctattaagaccaaaggaataaatgcctaataatggaatatcatgcaaaggggaaaacattttaggagaacaggagtcctctaggcctgcctcaaatcccactgtactggcagaacgtggctgcctctgtataaggcaagccttgtgcccttcccactcccctgttccactcctccatttcctttggaaggcagagaaagcccccttgtcctgaatgtttccctgcaaagggctcctgctgaaagactgcatacacagccaagactttgaccttcacctttgcccctcactgacttggtgaaaaagagttcttatcctcccctctctaggtttgggaggcggggaatcagctagggttagtaggaattcaatgaaaatataaatagaaacatgatctataaataacagtgccccaaaatatcaggaggcatgaataccggctgggcagcagacagtcacagatcacgagggcctggacagggagtgcgggttattcggttgctttggtgtctcttgggatgcttccaacttgccagtgggcttggagaaaccctctctctttctggactctagaaacgccctctttgttgcctctcttgcacccatctctagctaaaccttccttaacactgcctggaattagatctggtgtttaatcccagcagtgtgtgacttggggaaattcagaagatatctctgagctttagttttttcatctgtgcccatgaggatttttaaagctggagattttgaagagcaagaaccgtatctcattttatcttggttaacagggtggaacctagggccagattgcctggattcagatccccatagtgctccttactagttgtttggccttggaaaagttacttaacctctctgtgctttaatttccttgttaaatgggaagaataatggtatctatattgttgggctgttgtgaagaataagttagttaatatttgtaaaatgcttaaaatagtgtctggcacatagtagacatatataaataattattaagcaaggaaacaaatctatatatcccccgtgcctacagcgttacctggtatgtagtagctgctcaatacatgtgtagcatgaatgactgaatgacctatctatcttgtagtctacaaaagtcattcaataagatcatgcgtgaattctttctaagccacaaagttctatacaaatgaaagtgggaatattaatcttacctactagggtgacagtttgacaagggttaaaggtacactcccttattatcctcattcatcttctctgccttgcatactctgcattctattggtctgggggaaatgcctggagctgagacagctcagtggtagaaaaagtccgtttcccgctgtggtgttctgcggcagtgccagcctctctgcgtggcctagcactgccctgcccttcttagcattaggccctcattgtgggtagtgctgacaaaattgttcacaggcaaagcaaagcaaagcaagctcttaagcagacaaacaattggctgtgtcgcattttgctatatacagattttaaatataaataaaagaaacaaaaaaagcccgtgcccctcaacaaagcaacctgaatggacaaggcagaaagagcattgaccccggagtcaggtgctgggttctaggctcaggcctgcctcagcttgtgtgtaggatggggaccatcccatcagctctctgagcctccccaggtctggaaggtattagattctgtcagtaattctcagcctcagaggtacatgagaatcgctcagggggctcatgaaaaaggcagactctcgccctgtccatccccttccacttcaattcagggtgtctgggcaaattttaggaacttcattcgttaccagtgttccaaatatctctgattcaggtaacacagggaccctgtccttccaaaaggagtgctaggccttgtagtagttacctgggtaacaaatcatcccccaaaattagcagcttaaaacgacaataaaaggccaggcacggtggctcatacctgtaatcccagcacttttgtaggccagggtggcaggatcacttgagcctgggagttcgagaccagcctgggcaacatagagacccccatctctacaagaaattttttaaaattagctgggcatggcatcatgcacctgtggtcccagctacttgggaggctgaggtgggaggatcacttaggctcggaggtcgaggctacagtgagccaaaattgtgctactgcactccagcctgggcgacatagcaagactctgtctccaaacaacaacaataaaaatgtattatctcagcatagtctctgtgggccaggaattcagaactgcttaactggatggttctgagtcagaatctctcatgaggttatagtcgagattcagctgaaggcttgactgcagttagaggacccacctgcaagacggcttgctcatctcgctggcagactggcgctggctgctggcagaggcctcagctccttgccacatggatctccacagtgctgcttcagcatccttacaacatggaagctggcttccctcagcatgagtatctgggaaagagatgaggaaggcagttacaatgtttttataatctagccttgtaagtcatacgattattcccacaatatccaattgcttccacaggtcagccctggttagtatgggaggggaccacgaggcaagagtcactggggccatcttggaggctgacttccacagcctcctttgagtcctcagttctatgaaacactgttagtggatggcagctcttgttgttgggttaggatttgtagaaattggaggcaggaaagacagctgagttggagaccctagcagatgtagcctggaagcacagaagcacagaagcttataggctacgtttgctaggctgtctgtaagccagaaccaggctgccaggtcgggtgccctttgagttcagcctggtcactgagttgctaagagaaggtgggcaaagcgtgaccctctcagagcttagctttgacttcagaaggtgaggaggctggacaagatggcctctggggtcacctggtcttcacccctgtgttccacatgggctgtggtgtgagtttacgttgtatgtgcccagccagtgaccaggcccaggctgctccccgagctcctgagatgtgaggaaggctgggtgcagtggctcccacctttgggaggccaaggcgggtggatcacctgaggtcaggagttcgaaaccagccaggctaacatagtgaaaccccatctctactaaaaatacaaaaattagccaggtgtggtggcacatgcctgttatatcagctacttgggaggtaacagagcgagactctgtctcaaaaaaaaaaaagaaagaagaaagaaagaaagacttcaggaagaagggcttcgggcagggtctgaaggttctggtgtcttctcaccgtgaacattatggtccttggccttggaggtccaggaactcaggcatttctgaatatgcaactgtagtggcttcagtgtgctctgtgtggccattcagtctctttggcacctttcataaccccaccccagggacctcccagcatgcgtcctgatgcacgtacccactggactcccttcagcttctcagatgtgcctgtctcttcagtctctgggcctctgctcagactctccctctacctggaacactcttcccgcttccctttgcctgtctcactctctccacttcctcagccctgtctccctcctgcgtgtgcctatgacagccaacacatcacagcgcagtgcccatacacagtatcctttgcgagggcagggaccgtcaccatcacagcccagcccccagcacagtgccagcatttgggagggagtgaatgggtgttgcgtgttgccccttctttcagggatggggtagggttgagatgtaccccgtcaggaaagctggccacaggttgcacagcccggggctcagggaaaggaaggaagatagcagaatcattaggagcctaggcatgttcagtctgcccaaagaaagagactgtggcacacccaatcccagctccaccacttcctcgctttgcaaccctgggcggggcactcaacttttcttaccttcagtttactcatctgtaaagtgagaataacaacagcacccagtatgtagctcagaggttgttatgaggatcaactgtcataataaatataaagtacacggcacagggcttagcacataccaagtgctcaatgaatgttacgtcctcttaatgttactgtcaccatccttgcaggagatgggtggaaccacagaaaatgctggtgggaggttgatgaagagagttgactgtctgggctcagttttgccaacagaaccaaagctcaaggaaagcaggctttgggacaggcgcggtggttcaaacctgtaatctcagcactttgggaggctgaagtgggtggattgcttgagcccaggagttcaagaccaacctaggcaacacagtgagacctcatctctacaaaaataataaataaataaataaataaaatgaaagcaggctttggtggacagtgtccatcccaagagagccaggcaaactcccctgtggctggcctggccaggcctgtggttttgggccctttaccgacaggcctctgcttcctgcggcttttcctctgtctcagagcctcagaagtgagtgggtgtctttcagcatcatcactgcgacccaggacttccatctgcctgccccacagcctcctcatctggctgggccattctgcagtgtttctctgagctccagaggcctcgtgcccctcgccaagccccccacactgtggaccatgccacagggagaggctgccaggaagctctgcccagcgtcccaccgtctttcctgagggcagcctcccctggagggaggagccgaggctgcacaggctgaatggggccctttattcccggctcccacagggagggtacagagccactgcccaccacgcccaccacacccacgcccacatggagggggtacagcttggccctgatgccggcctctgagctaaccacactctggccccactgtgtctgcgtcctggagggtgaatccacccctctccccagctctggctgaagctgccgtccctaatgtgtggggtgagctgtatttgctagtctgccaggggtctgggggtgtgtaaatgagagacagcctagagcaagccagtgtgaacacacactcacactcactcacctttcagcaagtcgcggtcggggtccctgtgtgcccgtccttgtgctgggccctgaggatacgttcgtgggcttcactggctgcaagaagcttgcattctgtccttagggaacgctgtaaagaggcaggttcagaagatcattatcaatggtggcagattctgggagggaaacaacggaggccggagagagagggcacatggccaccaaaggcctcccaatgagggatgcaaggcaatggctgggcaaagggcagcaggaacagtgctccaggaacaggaacagggacagcgaacacacaggcctgaggtggggaagagcaggatgtgtctgtggcgtgggcagagtgacaggagatgggcgggcggagagagaggcaggagctgaatcctgcccggccacagaagggagtttggattttatcctcagtgccctgggcagtcactgaaagggttaagcaagggttatggtttgagaatattattctgaggccaggcgcagtggctcacgtctgtaatcccagtactctgggaggatcgcttgagcccaggagtttaaaaccagcctgggctacatggtgaaacccagtttctacaaaaaaatacaaaaaattagcctggtgtggtggcgcatgcctgtaatcccagctactccggaggctgaagtgggagaatcacttgaacccgggaggcagagattgcagtgagccgagatcactcccctgcactccaggctgggcaacagagcaagaccctgtctcaataaataaataaataaaaataaaaaagaaagaaatggttctggtcccactgctctagaatgctgctcaaaaagacttccattccatttggttcagcaaagatgtattagtccctccatgggcctgggactaggtgctttatcactagcagacacccataaaatcccagttgacccacctggggtgagggagagaaagatactgttcccttcagcctggctctgcttactgggtatgggaacctccgaaccagaatttgggagatcgttcttccctccaaggtgcgctgatgctttctgcaagcaagccgtggctgcaggagggtgaaggcttcactctgtcgtgaaccccagtgggcttttgcaagtgtgtttccctgggcgtgtgggagagggagtggggagtgctggagcgggcagacacacctgtgtgagtcaccctagaatgcccctagggggcgggtggaatgaacaattggcctccttgccattgtgtcacgtcctctgccctctgagttgggcctccgagaaacggaagccgtgtgggagacacagatgtgtttatgggttgggtgaatcaggaagggcagccgcaggctgaggggagctcgtgtttggccttggtgggaagccaggtggatggactgggtgcctgggaaatgcttctggtacttggattccacgtggccagcaaggagacaggcagggcccaccccaccccatcccacctccttgacctggaagtgtcaactcataagagatcccatttgttcaccatttgccatgggctgggctccatgctaaatgcttttacagactcattcactggctcctcgtaatagtcctttgcattagacattactgcctcccattttgtagtctgaggaaactagcattcgaataggttatgactcatcccctgtcacataacagtaactggcagagccagatgtaccagtcaggactctcctggtgacaagaaatagacccatctcaatctggcttaagaaaaaaggggaaacttattggttcacataactgaaaaccaagagtaatggtttcaggcatagctggatctaggggaccaaatctgtgtctcttaagccctcagctttgctgtcttttctgttgacttaattctctgataggcttcccccaggtggtaacagagatacataaagatgcttcctagcagcttggggcttggcatttatgagttagcagctgtagagagagaacacatctcttcctggtagttccagcagtagtcccaggctgattcccactggaccaatgtgggttgcatgcccatggctggactgtacttaatgatcagccccagagtttgggatgggatcaaccccactgaaatcccatggactgagaatgaaggagggattgtttcccaaaagaaaatcgggcactgtaataattaaaagctggcagacaaaacctaccaatgtctaccatgctagacttcaagccagaggcagcatcttggctctaaagagagattcatgggagccagaactcagggcatggtgtcagtatgcctcaggctgctgaccttcgctatggggattgtgtctttccggaacctgcatgtgcccactgcttccagcctcagcatctaggcctcactcctgccttcccccagcccaagtaaatggcaacaaagccagatgttgcaagtgaagaaggaaggattgggtgtcagggtgtgatctgagccaggtacaaggctgtagactctggggatgtcatctcagctgcaccagaagctggaggcagcccagcaggggaagaggtgacctgcagtccccaggctgcagagggtcagaggtgacatgtgagtttcaggggcagcacttaaaaagacaagcaggggccaggtgcggtggctcatgcctgtaatcccagcactttgggaggctgaggcgggcggatcacctgaggtcgggagttcgagaccagcctgaccaacatggagaaaccccatctctactaaaaatacaaaattagccaggtgtggtggcacatacctgtaatcccagctactagggaggctgaggcaggagaatcgcttgaacccgggaggtggaggttgcggtgagccgagatcatgccattgcactccagcctgggcaacaagagcgaaactctgtcgcaaaaaaaaaaaaaaaagacaagcaggggcctgccattcagccactcccaccctagcctaggcagggctaacccaggtgaaagctgggtggccccatggtcaggaaacagctgaacatcaagagcagggccagctttcaggaagacaggggagccagtagaggctgttccgccgttcttctcccctgcccattacatccagttccatcaaggcctctctgctctatgctctcttccctagcgagaccctgttattgagtgagaagccggtgcctgctcatactcaggtgtgaatggttaataaggctcactgtaccattctccaggaaaaagttgatatatcttgacgaaaatcttaaagaaactaaattctgattctgcaatctcaggcatcaaagaagtagattgtgagtttgtttgtttttagagttgggtattcttagggcccagggcataccctcttggtgtctgcttgctttaaaccatcaaaagtcccagcctgggccaggtgcagtggctcaggcctatactcccagccttttgggaggctgaggcaagaagatcacttaagaccaggagttcgggaccagcctaggcaacataacaagaccccatcactataaaaatgtagtcgggtgttgtgtgcacctgttacttcggaggctgaggtgggaggatcacttaagcccaggagttcaaggctgaagtgagccatgatagagtcactgcactccagcctgggtggcagatgagatcctctctcaaaaacaaacaaaaaaagagtcccagtctgcttctccttggaccagcttggatcaccgagcctcagtgactcggtgagttgggggttggtaacagcctctctgaaatcaaacagacttagaatgaaagaggggtcgtttgtgttttgtttttaatggtgaagaaagccccattagtggaatcatggttatattctctctgccctcccctgcccagggcccttcatttaagagcttctgtcttcatcaatctgtcagcaaacaacacggatggaggcgcctggtgagggcagctggacatgggatccttggctggtccagcccactttgcacagggacctggtcaggtctcaggaccacagagagctgtgggagtaggaaacttaacttctcctccttcctcccacatgcattgcctgtgtcttatcaccccacgagcatgcgtgtcacccttgagggggggagggaggttccctctaggaatcctcacatcttctttcctccagttcatctgggaaatctgttcgtctcttctctcctgggtgtcacatcagccctcagagccagagaaggacccgcccccccattctctcggcttcaggtccccacagcttgcctgtctcctctcaggctgagactccggagctgctctgttcagacactcccctgtcccccacgagggcttcaggctgcactcatatccatttcacccagcgccatgccagacatttccagggattcagggagtatagaaaccacccctgtccttggggccactgaaatccgcttagggatatagggccctgtcaggtgactggtatgccctgtgactctcccataactaccctgcggtaggttgaataatggctcccaaaaagatatatccaagtcctaacccttgaaacctgtgaatctggccttatttggagaaagggtctttgcagatgtaatcaaagatcttaaaattagatcatcctggatatagggtgggcactaaactcagtgacaggtgttcttataagagaaaggcagaaggagatgtgggacacaggcatggggcgggaaggccatgtaaagactgagacagagatcggagtgatgctgccacgagccaagagatgcctggagccctcagaagctagaagaggtgcagaagaactctccctgatgccgccagagggagcgtgaccctgctggcaccttgatttcagacttctgacctccagaactggcagagaatacattcctgggttgttgtttgatttgagacagtctcactatgtcacccaggctggagtacagtggcacgatcatgactcagtgcagcctcaaccccccaggctcaagcgatccccctacctcagcctcctgagtagctgggatcacaggcgtgcgccaccatgcccggctgattttttttatagcattttgtagagacagggtctcactatgttgcctagtctggtcttgaactcctgagttcaagcgatcctccagcctcggcctcccaaacagctgggattacaggcatgagccaccatggtctgccaaattcctgttattttaagccactgggtttgtggtaatttgtgccagcagccttaggtgacaactgcctcccaccttcctttctgttctcagacccagttagaagggcaggagggctgtccttggagcacgaggcctttgcaccgtgcagtctgtgggctccaggcccacctgtgctctcccttgtttcttaggcaagtctccctcgacagcctgggctctctgggctgcattgaggggaggggtttgtgagcatctgtatccctggaggccagggtggctgggaggagctggccctccttgagcccaaggggctgctgaccctgttgctataaatcagggatccccttgagaagatgagagggggtcctgaggagggtggcttcctgacaaattctctaggacagcaggggagagagggccagagtggggtgactgccagagggccctagtggttggcaaggaagggcgagacaagcattcaaggaaggcttcatgggggaggcagcatggaactgtgccttaaagacagaatgagtgttaagtaggcaggcccaagggcacttagaataaaaccaaactcttttctgtggctgcaggctcctctcttttctgtcttccatcatgtccagttccttctgccccagggccttggctgttgtagtttcctctggccaagcccgcttgttccagagctttgcacagctgctttttctccttgaaggctccactgaagcccagagaagcttccttgaccattctctaaattcttctctaggcacccctcttcacattaccctgtgttattatctttgtagagatgggggaagacctggaagtataaccaaattactcaataggtatgaaaatgtgtactgccttcttcccgtgcccactcccttcccaattggaaggtaaactcctgagagcaaggccctcatctgtctggttcactgctgtgctcccagcgcctggaacagagcccagcacagcaggcctccatcaagacagtgctgggtggatcaagggaaggaaggaagggtggaaggaaggaaagaaggaaaggcagggggaagtcttccaagaatgaatggcgttccaagtggcagaaagacagggaaaaaggagttgtacatgcatgcatagacactgtgagtgtgaagaggagaggctgccaggaatagatcagcctgctcagaccagaagaggtcccgaggccagccctctcttacggctcctataatcagtgccctcttattacctctacaaatgggtcctagttcatggaggtagctaccaaactcttcatggctggtgtggggaccctggccagtggtactgtgtctggtgattctacttgaggccccaggccctggctctcatgggagtccatcccataggtaccgctttcccaagaagagccctggaggctgtggttggtttgggggtttaactgttctcatctcccttcacatgcagaataaaatccaaagtcctcacggtggctctcaaggcttgacatgatccaagtgcaaagatcatggctcccccacactctctaagctttaaaaccccaggttgaaatcccagctcagccactagatagctgtgtgactttggacaggtccttcaacctttctgagctgccatctcctctaggacaaaatgggcctggttaaagtacttgcttcaaggttgttgcgaggatgaagggagggaattcagtgaaaagctcttagtgtgcaccaggtgtgtgctgagcgcttagctaccattaaccctttcctccttcctcctctgcccactaacgtccccactgtcaatcaatcttagggcttccagaggtagcagccatagagcccaggcctccgatgagcacacagcagtcccagtggagaagggacctgtttcagggtcacacagccagcctgtggcccaggtaggacttgaaccccagactcccaccggaggcccccactccttcgctggtctcaccccagcccagcccagagtggcaggaagaaggacctccagttactgcttagacgtcgcagctgcacagcttcttctccgctttcaggactgagttaatcctgatgagttaggtctgtctcatgccccgtgcaatcttccttgcgatgctcatcagattcctagggcggcatctggatggctttgaagactctggcagaagctgagccctgccgtcaacgggctgcactatatttacaagaggcctttaatgccctgtggtcccggcttccttcatggggattttcctccccctcctttttctctccccctttttatacggtcaccggtttggctttcagagtgtggtttggattcctaacagagaagtcaagaccggagaatcccttccaggccctccctctctccctccctctctcccccactggccaattgtgccaaagccctgggaaaagaaaacgttgctcctgtcaggatttcagcgggaaagggggaagccccattgggcttccaaaaactcagctgggaattggcttgtgcagaaattctcctctgaccttgcaagtgagcagcagatccaggagcctggtggggaggactgggcagccccaggcacagtggcccggtggcctcactcagagtgcagactggagggcagggcggggtcctgtgcttggggccagcatggggaggagtcaggagcaccctctcatctacctccccaccccaacctatccctcccttctctggatctcctacacctgtggaggcctcagtgctccttaactagtttttaaaatgagttcttcccagcactttgggaggccaaggtgggcggatcatctgaggtcaggagttcgtgaccagcctgaccaacatggagaaaccccactctactaaaaatgcaaaatcagccgggtgtggtggcacatgcctgtaatcccagctactcgggaggctgaagtaggagaattgcttgaacccgggaggcagaggctgcagtgagctgagatcatgccattgcactccagcctggacaacaaaagtgaaactccgtctcgggaaaaaaaaaaaaagagagttctgtctgcaactaggacaggaatgatctaagcctcagccagagctttggctaaccttgagattgggggctgggagagggaccccatttatcttcccatctccctgctttcttttttgtcccccaacaggatgagaaagggcgggagtgcatttttggaggctgaggccctgctccatgcaggtttgtgggccctcccccaccctcctgtggtccccctgggtttcctctgtatctcagacagtccttcagggtcctgctcatacggctggaccgctggtgtcactgggtctgggcatccctcagcttctgacaaacaactgccttcattagaaaggcccagaattccagccccagggccacccatcttcttggcagtcctgagctcaggtcacctcatgtttttatttttacacagcctccccctggcctcacacatgtagcctgtggcatgtgagcaatcaagcgacaggcaaccaaaaaagggtaggaggcaaagaggcaaggaataccgaatctgtgacatcttcccccaaggaacagcggcgtcgccagtgtctggataaatcacgttttatctcctttcgagagggacgcagggcagagccgcttcatcttggtgatgtcgtctgtctgcacagtgttgtccatctgacagggagatggcccggccctctggcttcagagaaaagatgatgaaggagagcttgagcaagagtccaggagaggaacaagaatgacccagcaagcactcattgagcatctgctgaatgcaaagcctagtgctccatgtagtgtgggggcagacaggaggggtgagctgcagagccatcatggagagatgagagatatccacgggaagcaggtcacatgcaataggatgcagttacacgttccactgtctgacttcagcagggctggcgaccaatgcttgtggtggcagggaagtcaggggtggctgcagctggggttttcatggcccctgggtcccctgtctgttcacttctgcctaccaaaggctgctcactggagccactagggccttctacctcagggctttgtctagccatgggcacacactcagccagatgtgctggagttaacgccctcagaggcagtcctcagtgacaaacagggagttggtgggtagatccccagcctccacatgtcaggtacattctctgtcatctcctggagccccccagcagaattgagctctagttgcccaccatgattaactggcctgataacacttccttcccctccctgcccttactgtcccactcccctaatgatatttcttgggatcgcctccaaaacaagtcaaatccttgtttctggggctgtgtctgggggaataatctaaatcaaggcaatggcttttctgagtacttcactcggaccttgacagaagcagctggtgtggattcatatgcagtctacctgtctgctcacatgcaatggaaatgatctaaattgggtgtcctttaattcaagttatgaaaacccatcttcaactcatttaaatgaaaaagaaaatggtattgttttatgcaactgaaaagtaccaggtggaccctggtttaggaacagctaccgacatccagctgctgaaatgatgtcaaagggctctgtctctccctctctccacttggcttttcaatcactcaagaagcttttaccaagcacctgtcttgtgctagccacccttcctttctctcattccgtttgcttcccaggccactagaggtgccaggctttcatcctgccagcttagcaaccgtgggaaaaagcagtctcagggctgactctcattggcccagattgggtccctccccaccactgagccaatcactgtgactctggctgactaggctgcatcctgtggctacctttgttgctagggggtgtggctagactgactgacaccacaaggactgggagtggaagatgccttctccagggggaaattaggtagactgaggcaacagatgcccgttacagctacaggtgagcacttcatcatgtgccaagctcatgggccccaaaatgggtcacaagtgctataactcacagcagaatgtggcagatagcctaggaatggacaacgagttgtggatgttctggaaagagggacattactcccagctcagccaatcaaggaaggccttctgaaaagggggctttggccctagacattgacagccgcctagcacagaagtcagttgtgtaagaccttgaacatcaaaccaaggagttcagattctaaatttctcagactagaaaaggacttatgtcttgatgcatttgttatgattgaatgtggccagcttgggagagtcagctgggaaggtctgaggggctggcatttcctgtaagccttgcccatacctgtagaggggtgtcccagcccagctggcagcagcccgtatggctggaggctgtgtgtgcagcgaggccagggaagagtcaggctgggacagccatgcttcccttggtattgccttgtgcccgccctggaaggagccacccacctaaactaagaataggaattcctgcccagctggcaggaacgaatgccgatttctcaaggagggatgggcctgaaaacaaagcgtagcatgtgggctgggctctactttgtgttgatttgcaaggtcacttgagagccgcacccactccgggcattcattgatcctgccattagatccaggcaaggtggcctggccaagtcactcattgaatcccaagatggcagcctccagggctcctcacccaccagagaggtcctgggctctcagcctagggcgcctcctgccctccaggaaaggtgactgtttctctcttgtttccttgaccgtggacggggtggtggcaggtagtgctggactaagatgctgagaagccaagggagaggggaatgagaaggtctctgtagcagttttagccagaatcccccactcatgagcatctctcttccaggcaagatcctcttccgcagaagccacatccgggacgtagctgtgaagagactgaagcccatcgatgaatactgccgggtgagagtgtatctggggctgggggaggggctcggggagggcttcagggaggagaggggcccatttgcctgagtgtccatctgtgaggaaaggttgctgtacagaaccgtcctgaggcctggtgtttcctggccagaggggtgggtatgggatcaccccgtagctgggccaccctctgggacccaaggacctcgggttcacagctaagcttctgtgcctgtcaggacatatccatgtttacaaaacacagttttaagtcacttcctctgggaagtgaactgagctcaggagctaagtcaaagagcctccttctgaagggctgcttgcttctctatgtgagattttgctggacatagaagaactatttctttgaattcctgttgggatgttgttgggatcagttcactagcatcagcagtacacatttgtttattcacctaaatcttggtaactacaaatgttcatgtacacatctttacagatgcaggtgttcacacaaacacatgcacattaacacagccagtgccaaagagcaggcaggagaaggacagcagtgtcatgagccagagcccacctgtctgtctttgattagagcccagcgctgctgcagagagcatgagtggctaccagaggatgagcggccctcagtttccttggcacatggcctctggagggccagtcttcctgggttggaagccctgtctaatttcatgaacttgggcaagttactgaacttccctgagcctctatttccacatccgtccaatagggaggagaacacacagggtgcctccacacggtggtcatgaggatggaatgagctggcacattgtaaggcaacagcacagcgtctggctcagaagaagcattcagcagatgcttttgttattatttttacaaagggcaaacaatttgtattaaataaacaagcaaatgaaaaagctttattttttaaaaatttttatttatttatttattttgatgagacaagatctttctctgcagcccaggctggagtgcagtggcaccatcttggctcactgtaacctccacctcctgagttcaagcaattctcatgcctcagccttccgagtaactgggattataggagtgcgccaccatgcctggctaatttttgtatttttagtagagacgtggttttgccatgttggccaggctggtctcaaactcctggcctcaagtgatctgcctgccttggcgtcccaaagtgctgggattacaggcgtgagccaccgcacccagccatatttttaacatgtttttgagacagggtctcgttctgttgcccagactggtgaaaaggctttattaaaagcaaataaaaaaaaaaaacaagcaaataaagcaaacacaaaataatttaatgtttctactgggcaccattggctttaatagagctagaatttcgtagttaaatgaaacccactgtggttcctgactcaaaaatcttgagaagatgtggtataatgtgttataatgtggcaaataaggtataaaatttcacaagtgctggtattagagtatcagaaggagaagagctggagtcgaatcccggtgcccacttactagctacgtgaccttgggcaagctgctttgcctctttgagccctagtttcctcatctgtaaaatgaatataaaaacactacctcacatgggagctgagtagggagaatgtatatcacagtgtcctcatacagagctgttgcaggaggagcacttgaggccaggagtttgagaccagcctgggtagcataacgagacctcatctctccaaaaaaaaaagtttaaaattagccaggcgtggtagcacacacctgtagttgaggtgagaggactgcttgagtcaggaggtcaaggctacagtgagctatgatcacgccacagcactctagcctgggtaacagggaacgatcctgtccctaaaaaaataaaataaaataaaataaataaaaaatgtttaagaaccaacttgctaaatttattaactggcattcccaagcctataggaagaaaagacaatgtagtcttcattaaactgaagtttgaatttcgtgactgtgaacattatacttgggtcacatgttctgccttattttaaaaggatgccccagtgctggattcccttaagctagaaacttctcttcttcagaccaatattcatttttctctttaacaggcattcactgtttctggttaaattgatggctgtagcctgagcttttatttctcttttttcctttctcaagaagttaaataaatgggcaaagctaatggaggagggggcatagggcgggaggaaggcttttccagctgggatttatagctcagattagccagcccaaggcatctgcagttgggctccaaggaaatgctgtctgctgggtcatccggaggaggaagtgatagcatcttatctcctgggatcaggctttgaacaggactcctgattcagaggggctctggagctccagtgtaccacgcgtagctgggggagccattgaagtggggtctgcaagaggagggacctcctaacctgattagcacagatggaaactgcccagagccagacaaggaatggggccatgggctcaccaagcagacagccatctatctcacaggcggtgatttactctgagaatggcgggggtggggcagtacagagtgacctttaattctgctgaactaagaagctgggatctgtggtctgattgtctgagaaacccactgaccttggaatggtttttagggacaagtccatggccactgccacctagctatgcatttcacagctggcctccagacagaccactcagcatcaccggccgaccccagccagcacagtgccgtgtgcagtccgctccacggccagaccttcccctgtctctacctgcctttgtctacgtactgcctagagcctctggagtctctacttacagtgccctgcatagcccacctgcttggctggtcatcttccttcgacctgctagacaatgtgggctcagagtctggggtttgatgggaattcaaatgcacccaaaattgtgcagctggctctgcacacagagcagccggctccctgcaaggactcagacatggaaagtctgaccgtgcagtggacctccccagactttgggctccctgcccttgctggccagccagtcccaccacctaatggcggtttcacagcccaatatcagtgttaatttttaacatataagcagcagattggatgggaatcacggaaaatttaccacatgccgactgagtgatcattttatgtggcacttgagggtcaggtgtctatgaagaggggttccaaaggcatttctttaactttataaattaatttaaacggaaacgtggtaatgcagttaatatttaatggtctgagacctcaacaagtcgaagactttcatcagactaacaagagtaagctataccatagaggcttggactcacaattttttaagtgactctatttaccccgttcctaggggtgaaatacatgtttgcagtgtttgtccaagggataaaatgaatattctagggaggggttcagagaggagtgtgagagagtgtttgagaatgagcaactcaccctttgacatgttaatgacatttatccaagtcaccacttcctggttggtacgactagaatttttttgctgcccaaatagctgagcatgtttctattattcgtctatctatgacacatttgatttcagggatcaatggctttctttgtaggagggaagagggattgggtgcagtcagacttaagggcaggaagtctgagcccaacaagaggtcagcactgaagggtaaggatcccctgaccctccccctctgcacttcccagactcattcatttttattcccacttcccagacttgaaaactgaggctattgcatggcagtggttcctagtcccaggtattctcccttccactgtgggattttccaccacagccaatcattggctctccccttgaggagagtaatgttgttcttgtggtccttgttctaaaagcagacctggcccaggagaggccttgccaatggggagtcttaggcagagcccaaggctgatccattcatgaggtgcctcctgagtggcctggttctctgggggaacccagatagtagaacctcaccatctccctcaacccagatagtagacccaggagaaggagtttctaggctgagataaagcagatcatgtcccttttctccttaaagaccttcagaggcccgggcacagtggctcatgtctgtaatcccagcactttgggaggccaaggtgggcatattgcttgagcccaggggtttgagaccagcctgggcaacatggtgaaaccctgtctctacaaaaaatacaaaaagtagctgggcgtggtagtgcatgccggcagtcccatctattggtgaggctgaggtgggagggtcacttgagcctgggaggcagaggctgcagtgagccatggttgcaccactgcactccagcctgggcaacacagtgagaccctgtttcaaaaaaaaaaaaacaaaaacgggactccttcagaggagtcctgctgcccccgagaagaatatctgagcacctcagctgggccctgtgtgggctggttccaagtgctgctggggcctcagctcctgcctctgtcttccatatcctgcagtccagtccggcagacacaaggccatccccagctagccaggcctccgcccctgagcctgtgctggtcccctgcctgggtgcacattcagtctccgcagtgggcccttccataagcctcatgactccccaggaaaagctgatcactcctgccattctgcccccagaggactgcgcccaccccgactctgtgcatttctcctctgcaggagggtaacttctgtgtgtctgtcttctcccagactatgagctccttgagggccacatttgtcgtctctgtgtcttcactaataaacaggaagcccagccctaagggattgtccagccaatgcctgatgacaagatggaaagatcacaagtagacaaaacttcctcagagagtgacatatcccccaggccctgatgtactaagatcccttgtgaaatggcttaaactgctaccaagaattagacatcatttacatttcaaggggagtcgctgctcagatccttcaaaaagaaaacccatgtgttttgaatactctgaactcagaagttcagtgagaccccagctttctagatggtgacctagaaagaacagtccaagcaggttagaggcagccccagaggtggggctggaaggacacaggtgggaggccagaggggcaggatgccagcccccttgtgccacacctccaactccacccagcgcggccgggcttttacccacaagatttccagggattagaaactgatgctttaaaaaaattaaaaaacaaaaaaaatcagtgtgcaggaaggagcaaaaaaaaaaaaaaaaaaagaaacgagaaaagaaactgatgctgctgaaaagagagaagcaattgatcctgtgtaaagagtgggcacctgtagtgttttgccaaatgcacagctttgctctttgtcctgacgcaggcattacccagagtggtgggctctgtggaggatgaccgtttcgaggcagaaggcctgagcacagtctgccggggccccctcctgtgccacttgcatgtgcaaagaccacacttgtgctcaccatagctgagtggaggtcttagagacacacaatgcagccaccctctcccttgtttacacctgcatcattggccatgatgacactcagtgctaagtggtggctcatgtcatggcccccatgaaatggtcttgaggggcaggagctggagactgcaggacagtttaggactggaaatggggaaactggcagggctagctgatggcaaaacctgaatggctcttcagcacctcattaccagtccccgcgacccagttacccactaccccagccccttcctgcatgccatttctgcagatctgctctcagccagctcactgacccctggtttacagaatggcagggttggagggggactgaggccagctcagctgacattctccagggacctgcatagttccagcagccccgcagggcaatgcttcctcccacttgccccagaacctgagggctagaaagtcgtactcatttcagcccttctccaacctgaggccttcggaaccctctgagctcacctgagctctattagaaagtctcaatcagattgattgatagatcagacaaatgaattcactggtgatggtgctgtttagttagagctattaacagttagagctggaagaaacttcagaatgtcttgaacctggatttgcctcagctgtgttccacagggcgtcactaggagttgtctggaaaatcagcaccgcagtcaaatacctgtgggtaaagctagaggcaggagggagtggatcagggcataggctctggactcagcctgattcaaaattttgctacttacagccggacgccatggctcatgcctgtaatcccagcactttgggaggccgaggcaggtggatcacttacttgaggtcaggagttcgagatcagcctggccaacttggtgaaaccccgtctctactaaaaatacaaaaaattagcctgctgtggtggcacgtgcctgtaaatcccacctactcaggaggctgagacaggagaatcgcttgaacccggcgagggggaggctgcagtgagctcagatcgggccattgcactctagcctgggtgacagagtgagactttgtctcaaaaaaaaaaaaacaaacaaacaaacaaaaaaaacaactctttgctacttactagctgtgaggcctcagggaattatgtaaactctctgtgctttagtttcttcttctgtaaaactgaaatcatagtcatactgtcctcttagagttgatgtgctgattaaatgacacagtcctacaggatattgttagtagtagtaaatgctggcttgtacaaagctctacaggtttctttcctgcaggatttctcagaggctttgtgatggtaacaaacatggtgatccccaaggccaagatggggggaccctcaaggcagatttcacatgtgctcacagagctcatttcacctcatcagggagttcttccatgagacatacttcgggattccattttatcttggaagaaatgacaaccagagaggtgaagtgagctgcctaaggtcacacagcaagtatataactgcagaactggaactagaattgactcctgtctcccattccagtgctctttcaagtgttcatcactgctttctcctaaagaatgacaatggcagcgatgacactaatgttatcacggctcacatttactgagtgtactcttcaccagccactgtgctcggcttctcatattcatctcgcttaacttcctaacagctaggtaggtgccacgtcacatcccagagctcagagggcaggtaatgcatccagcctcacacagcccataaatggcagagccaggacccaaacctgcatctgcctgcagccctgaggtcctgaggctctgaggccctgaggctctgaggccctgactttaccaccacgtggcatacatcatgaatgtctcatggcagaattttagacctaagctggggttgctaaccctgatatgcccattatctggccccctactctgctcttctcacaacggctgggcttgggggtgccctggccctggccatcatcaccagcccaggctgcggggactcactgctcagcatcactctctcctgccaaatgattttggccagagctgagctttggcagcagctctgatggaagctgctctgggctgagagcctcttgtcagcctgaaatcaggacgagccctccacgcggctcccctcagggctccccgttaaataaagatgctgcggttgttccaccaaaaggcctctttgtctgaggccctcgtggcccacgcgtcctctgcctccggaatgtgggtctctgtcggcatgaagagcccctctgttccctgccagggctgggtgagccatggctggccagggtctgtgcttagggtgagtggcagcacactgagcggggagggcactagtgctgtgggccgctgaaacccgccctctcctgccctgcgtccctccttctccctttcagggtggtcacccggcaatgactttgcacagagccgggatccctggtaatggtttcctcctgccttctgcccatcccgaccccattggcactctctcctggggccccctgtcctccctgactttctctccctccctcttgctccctgtctgtctctctctttcctcagtttttcatttccttttccttctacccttcccaaggagaacacagcatggacagtgtgcgttaaatgagaacttgaatattctggaggcatgctccacccatctgaccttcacagcttggggctggattctgcccctttcctcacttatggcttcacccccagcagcctcagtgtccccatcgtatgtggaggcaatgatgtctacctccaggacaaaatggggtgacatgtcattagatttgctctctctcatccctgtaaaaccaggcacagccccatatgcagcacacactgcaaagccctcactgtttggtggatgactggaggagtcaaggggccaaggatagggcctgacacatagctgctcatttaatgttaattttccttttctgttttttgcctgttgatggagatgtgttatttcagagacccttggagagccatgacccctgaaaggaatgactgagggttacatcatgctctcttatctgccatggtctggtcttacctcatcttgcctgggtgtgggtttggcatcgagaagggcccatcttgataggatgcctggtgctagatggcacacttcaattgttatctaactagctcagagaataactaaaccattactttcctcttcctcaatattataattctatagatgcaacctaagattatatgtgggttttttgccccactatcatgtcccatagctactggatattgggcttatagacatggaaaccttcactaccttatccatttttcattcatttctttaaacaaatataaatcaagtgcctgctctgtcaggtactctactaggatctggggacacagaaatcaaccaaacagactaaaatcgcgcctgcatggagcttaccttccagtgagtctttcccaccctccgtgggtgcctgtgggcaggccacatgtctccctgcacctctgtctcctcacccgtagtatggggatgggaattgtgccctcatgaggacgaccctcatgagaatttcctggaacgacactcacagacttactgtacttggcccaggagccactggatctaggccttgcatctgaagctggtcgtggtgtgtgaggtttcaggaggcaggggtatgggacagggtcctgtcttatagaccaggtctcatcaggagtttctcacaaaccctgtgtttgttgactcctccagtcctgggttttcctgtcttctcctggctctagccctcggctccctgtccccgtccctcagctctgctttggtagtgttctctcctgtctgtttggaccaggggatccttccttgccccagtatttctccccatactaaattgaggggcccagaaaacggggctacacccggcctcaccctacacccccaacccctccatgtcggactgggccaggtcagggtcctgcgtgctggtgtgcagcatgaactctgactgccttctttttattttattttgttttattttattttatttatttttatttttattttatttatttatatttttttgagacagagtcttgctctgttgcccaggctggggtgcagtggcacgatcttggctcactgcagcctctgcctcctgggttcaagcgattctcctcctgcatcagcctcccgagtagctggcattacaggcgccctccaccacactggctaatttttgtatttttcgtagagacggggtttctccatgttggccaggctggtctccaactcctgacctcaagtgatctgcccacctcggcctcccaaagtgctgggattaccggcatgagccaccacgcctggcctaactctgactacctcctgacctagtgcctcactttccagctgcagactctccccatgcctggatgacaggctcacagctggcccacgcacttgccatgactactgtttcccatagaatgcccactcctcctctctgcttgtccaaaccctgcaaactccacaagccgtgctcctgcccactcttctaagaaacctttccacactcttcagtttacattgtttctccaggcatcctcagcttggcctaaaacaaggccctgctagtcatgcccctgcccacctcctatggcccctctcccttgctctgggtcctcaggccgcactggccttcattcatctcctgaaaccaacatgcttgatcgctccacctccaccttgaccagttaattgttatccatccttcagaacttagctttaaagagtccttcctgaaacactggctccccatcttccacatcttcttgggttctatcaaactccatcatagtgctttgttgtccttggcagcaattatcaacttgtcatgaaataattaattttgtggtcagtgtttagggagtgtgaatgcctggtgcagctggagcgtggctagtggaagacaaggctgggaggacgtgaccttggactgttaggttatggatcttggacttattctgtgtgcagaagggaattccctcagggttcctgcagaatgattagctcctgaggaccctaagacccagggttccagggttcagtggtctttttttttttgtttaagtcagttgtttagttggttgactggctggttggatggttggttggttggttggttggttgactggatggttgatgggtaggttgattggataactggttaggggttttcttgttgttgtcttgttggtttgttgattaattggctggttggttagttggtcagttagttggctggctagttagttgagagaaatggatagaaagagggagggaaggaaggaaggttggttgtttgattcgttatttgattggttgatttgttgattagttttctgggtggacaggtgggtggctggttgaccatgtcttccatggctcagttcttgagcctctctgtcactgttggtgtaaggtgacactgtcttggttttcctgttcccaagttcatcacacctaatgccctttcttcctgtctctccacaggcacttgtccggctgcccccccacatctcacagtgtgacgaagtcttccggttcttcgaggctcgacccgaggatgtcaaccctccaaaagagtaagtaatagctcaggcctctcctgtgtgctggggaggcgtgggctaaagcaatggccagcctggggaggctgaggctgtgggaacacaagcagaaggtgagctagcagggccagccgggctaaagaacagtggtccaaaggaatgggggacattattccccaggctcctagtgccagagcccactcttcattttcctttaccccagggctgcagggaagagtgtctctgcatttgtggagcagattttcctacaaactctttctggctcacagggttgttacaaggagcagatgagataacagaaaatataatggtcatgccatcgagaccactcagggctagcacagtccttgctcttcgctgttatggctgcagaggtcccagtgtgcactgcccaggatgaaaactcacctgccaaataacagcagtcctgggctgctacaacagattttataatcatcataaaaaatcataatgaatttacccagtatcttttatgtatagcattttatgataggcattaccatattcaatagtcctatttacagaggaggaaaccatggctcggtgaggtcaggtgcttttcccccagagtcatgcagatggtttgataggagacaggacaaaacctgaacctaagtctgtggttcctagtggcccagtgctggctaatgtttccatgtttggagagaaacagggaaccatgcaggtcttttttctctctgaaattgggatgctgtgggtggtggtaaagatggcccactcagccatgctggtttctcacacccaggacccgactccatccagatggccatgctctcttgctcagagcattctgctcacctgcagtccccagcataggttctcattggagagaaaaattcagctcccacccaggagctggtgggcagaaggcagggaggggtgttgggtaagagagagggttggggagaggacttaaggggatgctgatgaatcagctcactccatagctatcccctggaagcttaaagtaccggatgggtgagagagaggcagatggggtggctactacagagggaaaggagagagtaggacacaggaaccctctgggccaggtggggagaggcagggggaacctggtgatggggaggagaaagcctgaagatgagggtgagcattgcgtggctctggaggtgccattcacactgcactttctgtgaatgtgcccatgaggttgtagaatatgtggcctgcacacccatacatggcagtcctgcctaaagggacccttctgtcttcacgcatgctaaaagactaatagcctgaaatagcctgggcatttcgagggaggaaaaagcagctccgaggcccacctggcctagcaaagaccatcttcactgatggctgcctcaggcaagaaacaagcactgtgaaccatcaggagcttatcagtagcttggttcacagcgtgaagcagtggaaagccacagggtataggatgcaaagtattgagttcacgtcccagttctgctgctactagctgtgtaatgtccaggcagatccctcgtaacttccccaagccttcctgtggtccctagtggctcagtgctggccgaagtttctacatttagagagaaacagggatgaatcttaaattcagctgattgaaaaaaaaaaaaaaaaagctaggcatattggctcacacctgtaatcccagcactttgagaagccaaggcaggtggatctcttgagcccaagagttcaagaccagtcctggcaacacagtgagaccttgtctctacaaaaaattaaaatttaaaatgtaaaatttcagaagaaagaatagcgagaaatagggaaccatctgtaaaaagggaatagtgattaagccctgtttttgctacctccaagggttatccatgaaactcagatgatgagaggtttgcaccagggcttgtatattctttttttttttttttttgagacagagtctcgctctgtcacccaggctggagtgcagtggagcaatctcggttcactgcaacttttggctcccaggttcaagcaattcccttacctcagcctccctggtagctgggattacaggcacatgctaccatacctggctaatttttgtatttttagtagagacggggtttcaccatgttggcgaggttggtctcgaactcctgagttcaagtggatccacccgcctcagcctcctaaagtgctgggattataggcataagcaactgcgcccggccagggcttgtatattcttatccccacattacagattacaaaacaggagctcacagctagagcgggaatttgaacccagaacttccaggttgcaagcagaagcccacattcatctgtttctcccacctgcttcactggtttggggactgtggtcctgaagctcctcaggatctcctttctgtccccacctgtctgcgctcctgccccttccttcttcatccttgccttgcctcagggcaagggaaggctctgagcctggcagcagtatccctgggtcctcacctgacccgcccttgcccagctgtgatgttctctccaagcctctcattttctgtccttgcatggggagagaggagatgctcctccctacgtgggtggctgttgggatcccccgtgatcgtgtgcctggccacgggggaaaaggatcaggatcgttgatggtggaggcagcaggtgtatcgccacaaaagcagctgacccagcctgtgatccatgcctccaaacctgctctttgccagtcagctgaatccgtcggcctcacttcattcatggcattaagttagccttttgcccacctctaggaggcccttgaggaacagtggaaaccaggctcagcaagacacttggctgttggggaggcagcaggccatggctttgtggggccaggctctggggccaggccctgccacttaaggctcagtgatctttggccatttgctcaatgtctctgcatttctgttcccctaaaatgagataatgcagaactcacgagctggtcaagagggtttactcaaataacccggccaggtgctactggtgcacaggaagtgctccacacctgtgttcatggaaggctggggaacagaatggaatgtgtgcacgttccgtccctacctgacttttgcagggaggggctgtgaagcatttggccgctccatcaccaggccagcaggggttatctgcctctttcttgaggtggtattggccacgtgggccagttcaccactggtctggcaagttatgggcctgggaataggaatgcctccagccccaagacaggtctgaggctcaggaagtgagctcagctgtggccaggcagttctgaggggctccccctccccgggcccggccctgtctctgctccgcctccaggacccaccaagagagacctgtgttcccctgcagagtgtgcctgccacaaaagagccagagcttgtccatgaccctcggctgacaggctgccgacgtgtcagcctagtgcctgcacctcctccctctccggctgtttggacctttccaggcgactgtgcacctcccttccctccagcctagaacataaacacgggatcgagtaacagcatattttgactctggggcgactgtggagtggcttatcaaattatcaaagcctgtggatttaattggaattttgtagataacccctggcttctttcaagtgtgctgctgcagggtccattgagaattcatgggggctggggtgggggaccgtcttccctttccatcttccagagaagacaaggtctgtcacagcccagactcagtgggggaggtgggcagcaggcctgagcgcctcggctttgatcccaggccactcgctggcttctgcaggcggagagccagacccatctccggtcagttagtggttgctcttccagaccactggccctgcacagaaaggatgttcttcatggacacctttgatgagcctggcacagagcagccatggtggttttgcctcctcacacggaaggataatgggatttgcgcccttatgaaagaggctccagcaaggcccttgccccttccatcatgtgaggacacagcatttgccccttctgccatggcaggacacagctagagtgcgccatctgtggggaaccagccttcaccagacaccaaatctgctgacaccttgatcttggactttacagcctccagaactgtgagcaataaatttctgtttttaagaaattacctagtgtggccgggcacggtggctcacgcctgtaatcccagcactttgggagcccaaggcgggtggatcacctgaggtcaggactttgaaatcagcctggccaacatggcaaaaccccatttctgctaaaaatacaaaaattagccaggcgtggtggcacgtgcctgtaatcccagctacttgggaggctgagacaggagaattgcttgaacccagaaggtggaggttgcagtgagccgagatcgcaccactgcactccagctgggtgacagagcaagactccatctcaaaaaaaaaaaaaaaaagaaagaaaaaaaaaaagaaaaagaaattacctagtgtaagaaggtactctgttataacagcctgaacagactaagacgcttgctgtgtttattgttggcccctcccactagaacacaggctccaggagagtatgaacttgtctttgttctgttcacagctgtatccccagcacccagaacagtgcatgtcccagagcagggtctcagagggtctctgttggatgaatgattgttgtcattcagccctcactatggtcttacatggtaagtacgactgtgacatgattttaccaaggagctgaaggctcagggacatgaagccactcacctgaagtcacccaactggcaggtgcagggccaagatccaagccaggctggctggccccagacctacggttctaaccacagccctgacccaacccatcactcagctcacacccactacgccttcccaacctcgtcagcacccgctccccacctccaccccagccagagtaggtgggtaccggcctcagcccctttgatgttttcctttgaggatggtgtgtgtcagtctgttcaggctgctggaacagagtaccatagcctgggtggcttataaacaacagaaataaaattctcacagttcttatgaaagaggctgggaagtcctaaaccaaggcaccagcagattcagtgtctggtgagggcctgcttcttggttcatagtcatctttaccctggtggacagggaaacaagctctctgggttctcttttataaggcactgatctcattcatgaggctaatgaccatagcctaatcagctcctactatatcaccttgggcgttaggatttaacatatgaatttaggtgggacacaaacatttggtccctagcagtgtgttcttggaaagtcagcagttgaataggggtgtatgtgcgtgtgtgtgtgtgtgtgtgtgtgtgtgtgtgtgtgtgtcctgattggggggagggaggggagcagaaagggaaaggaagagtgtttgccttattgtattggtcacctcctctgtagtctacatcatgcttatttaaatattcatttaaatattaggccacccacgaaggtgatgttattatccccatttagcagatggggaagcgaagttgctagcagttacctgacttccccaggccatgcagccaagtggggaggcaggccttggagcctgggtgcagttctgttaggcccctccagccccccagcccccagccctttgccctgcagtcataaggggtcaatgggcaggggtgggcaagagaagcttgatgtagtttcttggtctctcctgtgtgaattgctggggagccatgtgacagcttgggatgaggagacccttggtcaccaaatcccaaagaaggcagataaagacatgcccttggccccgtgcggtggcttatgcctgtaatcccagcacttcaggaggtcaaggcgggaggattgcttgagcccaggagtttgagaccagcctgagcaacatagtgagacccccatctctacaaaaaaaagaaaaaagaaaaaaaatgagccaggcatggtggcacacgcctgtggtccccgctactcaggaggctgaggcaggaggattgcttaagcccagagtttgaggttacagtgaactatgattgcaccactgcactccagcctgggcaacagagacagaccctgtatcttaaaaaaaaaaaaaagacacatggaagccacaccaagagacaccctctgtagcagctgagatgaccccactgtgagcatgacctgcctcctggcacagtgtcctgaggccactttactgactcagctcccccttgctttgctctgcctgatctcctgagaatcccttgcttccacaggcaaggcccctcacccccagatgcagtcctcccatatggtgtcaacaagggcaaacaggagctaaaggcaggcccaaactggcccggcaggactcaccacgtggtcaactgcgtgacccagaaatgcctctttgtgttccattttaaattctcatccagtggaaataaggaatctaaaagtctttgaaacgaacgctaggaactctgtctgtagattcccaggaggatgcagttctggtgggagaaagatctggccgtagggccccaggatccacctttgcatctctgcagcctcctggcccagtggccacgccctcattcttttcttagcttgtcgccagcctccatgctctgccccatggttccctccaccaggagcaccctcctctcctccccactcgctctggaactgcatcctactctgtctccagactcagcttgggcccctcctccagaaagccctccctagagctggcaacctggcagccttgggatctgtttatggatctctccccaccaaggaacccacatctctggacccccaggacctggcacctagtaagtgttgggtgattgcccaactgtgccaaaataaagccaggctatttaatagagttatacattgaactgcccacctcggggagcagagccaggaggattctcaacctctccggagtcagggggccaggggtcagagaccagctctgccacttgcctcaggcaagttgcaaggcccttgtgtgcctcagtttcctttatctgtagagtgggaatcgttgctgcctccaaaggcagttgcgaggatgatgctttagcacacataaagtgccaaacaaacctggcacggtgtcagcactgccaaggccagtgtttgctgtccccatcatggtgggatggggacatcccgggtggaagcgcacagcagcagcaggcccacatcacttccctccacatacatacacacgttctccacttctggagatgcaaggctgcctttgcagcctcagggctgaggttgcagccttcttgaccactgctggcagtccaagcctgtgggcagggtgggcacacatgcctttggtgcacccatatcacagaggggaaaactgaggccagggctgagctgatctgccctgctcttgtcactcacttagtatctttcttcttgggcctcttaccagcccactggccttaccagcccacctcttacccacgatgggacacatagtgggcccacacagtgggtagacagtcacctcccacttcctgctctcaccctgggcttatcccttcggcttgtttcttcctgctgaagccagccatgatcctggttaaattcttgacattgcatgggaggagcagatagccctgctaaactggtttctgttcttcagcccagggccacagagccaccctctgttgtacagtagaacaatgccccaatgttccgagggacctggggtgagaggaggatggactgaggccaggccagaaccatccctgcctcagcctgcccatcaggggcccccaacactccccatggggcagagtccacccccagtgtccctgcctcctgcggggaaccccagggcaggccaaaaggggaggccatcctgcgggaggcctgccccagccagagcacaggtttgggaactgggccgggctggttaaggtggtgcaggggctggcttaggacactgagggaggctgccagggaaggagggccagggcagaggcagatgctgcttggggcctggggtgggaggaggtcagactcaagaaaacactctcctctgcatgactttctcatcctcccctcccatttatattttggggatggttgtttcatcttggactgcatggtaaaattgtggggagtccagtgagggggacagaggttgttgctgccatttgcctgggagaagcagagcccaggaggacagatgaactctgccagccctgcttcagggttcccgtaggaagacgaggggcaaggtggtgtgtgtggcagtgcagctggaatagcactgagaatgtggggtgtctcctccaggagccccacatccccaatcccagtcgaatgccaggtctggcctgttcgggaaggcagggcgactgctcggcttatgtctggctgccagcctcttgagttagagtccaggcttccctgctcaccagcagcattgctgtgggttgactgcgtggccttccattctctgtaagtcacccggagtcactgctccggcactggggagaatgaattgggatgatgcgtgtggatcacaaactgggcactgagtcatacaccctcctactcccttccttttcctaggaggcaaatggaaggttgtggacagagccctggaacctctccacagcagcctcccttcactctgcaggtagttactgagtgccagctgtatgccagggaccgcgtaggctaatcacctcaagggtcaaagctgaaattgtgaattgagttaaattaactgcagtggcaactgtggggacacccagctctgcctgtgagcttgaatggctcacttctcctcttccagtctgtttccccatctgtgcaaggcccccgtggtacatgtggcaaaatgattgtgaggttcaagggagcaaatgcgtagaaaatgcccctatgtacttaacccatcacaaaagctcaggaaatgggattttctgtttttcttctcctttcctccattagcccaggcctgggtacagagcagccaccccaaaaaggctgggggaatggaattgggttggccgagctgaaggtgagagctgggagaggagcatctcaccgcatccctctctgctctgggagtcctggccagggctggtgctgcctgtggagcgaggctgcccctaccaccctgcaggctgttggaaactccagggcatcccaagtccctgtctctcctgggggattggggtagaaagtccacccacacatgcctggctgcattctggtcagacacctatcatcaagatggctctgtgtgctctgtaaagccctgccaccacccatctggccagggacgtgggccacactgtccttgcagccccctgccactggctgctgcacaaatagcctctttatgttgatgggcaggagggccagctggaccttggagctgtgggaggctgagggagggaacagaacgttagataaataaaccttgtccatcccctgccatgcccccttcaacctgggtgggcaggtggcaggaaaatgcccacaggaagctgtgtccaacccacttgaaaggggcattggccgtggggaacaaggacttctgcaggctcagctgtcatgctgggtcggcgagctggagggaagcagattcaaacacccccagtccagcccagctcatagcgcacacgcctgggaggcccatgtccagggagagaagatgactctgttttcaggcctggcacaggattttcttcagggtggggaggaaggtggcagggaagggtatcctggtgcaggagtgtgtgggggtagactgggtcccccattaatttcttgggcttgtgcattctatgttctctgaaacctcaagacccccatgtgcccactctcttacccccaaggaaggcctacagagccctttggagcctctggcggaaggggtaagccctggaagagcgctgaggcctgctttgctgttatgttgtgttcaaggtgggtcttggttcccctgtggttatcactaccctccatgttcctagtccctgggtagttacccctccatggggagtttaaggcagaactgaacctagaacctgggtcttcggccactgggaccagccttcctctgttgcattcttgtgggaggcgtgtgttcatgcaagtgtttctagatcatctctatgtgaggcccgggacttcagaagtagctcagtccccactctcggggccctggtggtctaagggggaggatagcatggcatgggcctggcttgcttccacaggaggcagcagaccattataggctctggcaaaccctggctcctcccccacctgctgtgtggcctgggaattatttaaactcccaaaacctcaatgtccttgcctataaaacagggcttataacagctgctgataatggggaagacagaaaaagaacaactgattgtaataggtgcagggccttgcgcagcaacaaaccagcctgctgaggtggtcaggaaggcctccctgaggaggtggcattcaggctgagactaaagcaagagctcactactcaaggagagtggcagaggagggcatccaggccagagggagtccctgagattgtgtttcaaggattgaaagaaatttcatcttccgtgagagtaagggatttttggctagggctaggccaagaagagataggcctgaggcagtcattaacaatcgctacacttcagcatcaggtaaatgggcagaacctaggggtctctgggctatctcctggctctgacattctgaggtcctagcagaaccagttggctattgcagtggtccaagcatgcaacagtcaggatctagagaggggctggatggctgtgggaatgggagatattcatagacatagtccgagatgaaagggacaagcatccagagaccttgtgactccttccccttcacaggctctgtaagttggatcttgagggtggttggagtttgggcacgtctgtaactttgggtcactttgaagccctcggttcatgagatacatgtgtatctggctccaccccatggccatatcggatattacagctcccagcgtctggctgatgctgtactaaagccgtgctggacccttgagcatggtttatcttgtttgagcatccgtacaatccagggaggcccatgctcctttctgcagatgagggaccttaggctgagactggttgacttacctctcagctaggaagtgtcagaggctggactcatgccattgcccttcagctccaagtccacaccccacacgggggtgagctgaggatgaagtgagaagcacctgacccttggctggggcaactagctccaaatttcaggatgggacccttcatcagacagaagggcagaataactgcatcaggacgccatggttgccatggtcaccacgggggctgaaggtagagttgaaggcatgtgccacatttgggatcttttaaggggaacccaggtttcctgctgggccacatccctgaaaaggtacaaggtttgctgagactgccaagtctggtccaggccccccagggcagcctgttgagacccttcccccagcctcaggagctccaaggaggggcttcctatcccaggagggttcaggcctctgaggaggggtgctgcctggctggtacaggctcctctgatggaacagacacagggaaaccggttctagaagcactcagaaaaccaggtttcccgctcccaaaccacagactgagcccttggcttcccacaccctctctcatgaatggcccatttggtcatgggtccagagggcacgcagatggctacgtgcaaaaccccacccaggacatgtggcccggagcatggctcagtggtcagagccagagggagagtttcccccagacagctttactgaggtataatttacatgctataatatgtacttgttttaagtgtacaattaattcattgattactaatacttttacagttgtgcaaccatcaccacaatccaattttagagcagttccatctcccttaaaagatcccagagggaggttttggggttattttctttcctttttttttttttaattttgagacagggtttctctccattgcccaggctggagctcagtggcacaatcgtggctcactgcagccttgacgtcccaggccacctcagcccccaagtagctgggactgcaggcacacaccaccatggcaggataatttttttatttttattttttgtagagacggggtctggctctgttgcccctgctagtcgcaaattcttggcttcaaacgatcctcccgcctcggcttcccaacgtgccaggattagaggtgtgagctgccatgcctggccaccagagggacattttatattcttccaaactccaggttttggagacctgttggtatcccttccctctgctcctgtgtgaggggaggacatgcctgttcccagggactgagtctctgccccacttgctgctgctgtcatttctgggccctctggtagttccagctgctacgctgcccttgcacagattgctcagtagcccggggacgaggtctgcctggccctcccggtgcagctctgaggtggactaaccactgagttggcgcccagggtgaagggggagggtgttcatctcagtgggcacgttccctgcgtattgattccagtggcccagctgggtgttcactttgaacttcatccccaaccccaggtagttacgtgccccaggtcagtgggaaggccacctcaaatgcaatgcttacttccccccaaacttcttagaaggccagtaggtgcaggcaacaggccaagaggctgcaccacaatgatgcccaactttctacccagggaaattccaggtgttctggcagctcagctgtttagcagaaagtgcatgaggagctgattatcagcttggctttttataatcatttttccctcttgggatgctcctgggaaggaaggtggcagagctgttaagggaggtggccttggactcacaggtgtaacttcagatcctggttcagccccccaccagctatgtgccaggtggggcaaccgttttttattattatttttagagacaaggtctctgtctctctcccagtcctggagtgcagtggcaccatcacagctcactgtagcttcaaactgctgggctcaagcaatcctcctgcctcagcctcccgagtaactaggactactggcacatgccaccgtgccccactattttttaaattttttgtagacattgggtcttgctatgttgttgaggctggtcttgaactcctggactcaagccatcctcctgccttggcctcccaggcaatcttttaaccccacctaaactcaccacttactcaccacacctgggcctgccatccccacctctcaccccaatactgggacgtctcacttgtggcatataccacagaggtaattaaatccttaacatccggcttccctgagaggctgcacacaccctgagggccgggacattactgccaggcatctaccatatccctcgtgctagctgaaggatggacacagtaaatgcaataaatggagaggatgactgtctgtgggccttatgttcccccaggagtaaaatagggaccatagaagtggcagcatagggttactatgaggtctagaaagctaataatagctcaattactgtatctcaccatgtgatgacattcttctaagcgatttacattttttaaattattattattttttgagatggggtctcactctgtcacccaggttggagtgcaatggtgcgatctcgactcactgcaaccttcacctcccaggctcaagcgattctcctgcctcagcctcccaactacaggtgatgcccagctaattttttgtatttttggcaaaggcagggttttgctatgttgcccaggctggtctcaaactcccgagctcaggtgatccacccaccttggcctcccaaagtgctgggattacaggtgtgagctactgtgcccagaggactttttttttttttgagatggagtcttgctctgtcacccaggctggagtgcagtggcatgatctcagctcactgcaacctccgcctcccgggtccaagtgactctcctgcctcagcctcccaagtagctgggattacaggtgtccacccccatgctcatatttttagtagagacaaggttttgccatgttggtcacactggtctcgaactcctgacctcaggtgatccacccaccttggcttcccaaagtgctgggattataggcatgagccaccttgcccggccagcctacatgttttaattctctaatttttgcatccatcctatgaagtgggtatagttgtcatttccccctagtttgcagattaagccactgaagcacagagaggtcatgtgacttgcaacgccaataactggcaaatatgggctagaacctcttacctatcctacccctcaatgaagcttggcaagggcttagcatgctgcccagcatgcagtcttaatgaatggtaccagttgttactattgttgttgccgaaggggctgtgccagaggctggctcattagcgcccacaaaacacgactcatctctcagctacgtgggtttgcagtttctggagtcatcggagcagcctctccttccatccttgctgtgtcccagtgagaggcaaggtgggagggtttgcccctggtcccaggctttggagctcagttccccagacatcatccagcccagcctttgcaggttgtgcagtccagagaagggaaatggttgcctgaggtcagagaaactggattagcaccaggatttttggctccaagtccagtgctctttctggctctcagaactttcccagccgatttcaagagcaaccccaggcttggagcatttggagcatccctggtgcggtgcctgggagggtgcctggaggcctgagttgagcccttgagaagatcccagtaggagcctggctgatggacagggagaagggactggctcctctgaatggctcagaggcaggagcttggctgtggccaggtctgatttaatttggcagaggcaggctgcagcttagaccaggctgtgcctgcaagccagggaattgaaggttaattgccaggggcacctcttcctggcccccaccccaagcaggagagggcacccatgagcctgtcacctggtctgagacccctggagaactgcagtgttgcctcaggagccagtggatgggggacatgcattatccccatgctggccccctcatgtgctgggcacggtgctaggtcctggcagccacgaggatcttaataggcacgagcaggggacactttgtgctgcccaagacaggaaataattcaaggaaattcaggcatcttggtttggaatttcccagaagcagatctgaggctgaggattgcggctcaagcagtttggaggtgacactagaaggcatcagtaaggtgacacagggcagggaagacaaggctgccaagcgcagtgtcaacgagcttcatctcgcagggactggcacctggctgcaggctgttccctgggggcaggggtgctggggcattcatgcaccccttttccctccctccaggccatccccagacatagccggagggagctgtccaaaaagcctgtgtttcctactgtgcttagggtgactgcctggggtttcctggtgcccttctcctggggaggcctgggctccaacctcccactgagggagccactggttggtgctgcaggaaccagaggaaagagcctggcagccgcagggaaggtcaggaagtccccaccaccacccaccccagcttggggacccgagctgaggccctttgtcactagctgagtttctgtaacgagtgtggagacaggactgtgattcactcaaggcctgaggtcggcgccaacaaaggttatcaggaaggcctgcagggaggaggccaggctcatgtgtcccttgttccagaagagccagatcagggtaccagagacagtcattgagcttaaggaggccaggcaggtcccacacaggtgctcaagccaggagcgcaggaggacactggaaagggagagagactgtgggggctgtgggtgtgcagggaaggctgccagggagctgggcctccaagtgaacttgggtgctgagggagggtttggaggcaaaaggagagggagacagcctgggccagggtgaccttgagtgcaggcttggagatttcccagcagaggagggcaggagggtaggaaggtagagagagacacacacaaaagctcacgatggttaggagtcagctggcactggagtcaaatcccagctctgccactgggctagtgacttaactgactatgcctcagcttcctcttctgggacatgggagtaatgatagcatcttcttcttggtgggtggctacaaggattaactgaaataatgtacatgaagtacagtgagcagctgggccgggtggttcacacctgtaattccagcactttgggaggctgaggcaggagaattgcttgaggccaggagttcaagatgagcctaggcaacatagcaagaccctgtctctaaaaaaatgttttttaatttaaaaatattgaaatacagcctggcgcggtggctcacgcctataatcccagcaccttgggaggctgaggcaggcagatcacgaggtcaggagttcgagaccagcctgcccaacacagtgaaacccctatctctactaaaaatacaaaaattagctgggcatggctggcgggcatctgtaatcccaactacttggaggctgaggcaggagaatcacttgaacccggaggcggaggttgcagtgagccaagatcgcacctctgcactccagcttgggcaacagagctagactccatctcaaaaaaaaaaaaaaattgaaatatatagtgccatggctagcacatagtaagcacccagggagtatcacttcctaggtacaagactctgttttcagactttagccctgtcagggagaggggtgaaggaggccatagacactgtagtccaactgccagaggagagagacacacgtgaggcaatagtgcaggacattagcaagagcatccaggctccactgtgatgccagggtggtttccatgacaaccaaggtgatgtcacagaggacggagcacaggaggccgcgggctgctgccattccgtcctcataaataggcaggaaatgtactgtctgcacttgctgacccatctgtgacaatcagggatgacctcctggaggaagtggcacttccactgagctctactcgggggggaaaggaggggagagcagagatgcagggtctgcctatcctgccaggcagggattgagaacaggtggaggatgctcgggatggtgttagcagcgtctgaccagcctcttgagaccatccggcagccctgagcttggttactggttgtcagggaattcgtgcatttattcaggaaacacgattataaccagccctgtgctgggcctggcaagacacacacagttcctgctctcagggagcctactgttgaggggaagaaatagacaacaaacaaggcaatggcaaaaatataaaggcaatggtgacagccacacaggaaaataatccagtgctctgctagaacaaggtttgggggggtgccagaaagtgtattaggctgggagctggggcccaggacagcattggtccggcatcactgcccccagaacttaaaaaacctctgctgagaggaggctgtaaaaccagccctggtgaggccaggccatcctcaggctcctccagtccagccactgacccactgagcagccacaccagcggcagaaccaccaggaggcagcccaggaagcttgacagctgcaggtgctctagaggggatgctccatcaccatcggaaaccacagtgcatctcttgagcatgtggtcatggacgctgtgacactgtgacccactgtgcgggtcaccagccaggtttcttcctgttggacattctcatgccagccctgaagttgtgacctccctaaggaagagtctagaactcagtgatgtcatttgggtatttctttctttctttttttttttttttctttttgagacagagtcttgctctgtcacccaggctggagtgcagtggcacgatcttggctctcactgcaacctccacctcccaggttcaagcgattctcctgcctcagcctcctgagtagctgggattactggtgcacaccaccacacccagctaatttttgtatttttagtagacagggtttcaccatgttggccaggctggtcatttgggtatttctgaccctgagtctttgccttcgttttacctttctcttcaccacctactcctcatttagcttttctgtctggattttatgtgtccttcttagccacaaggtggtaaatgaacagtgtggtggttaggatttgagcactagactgagccaggttggcctccaatcccatctgtatccctcacaagctgtgttactttgggcaagtcacatgctctctctgatcctccatttctcatctgtaaaatggggatagtaagggactctgccacacaggcatgtagtgaggataaaatgagctgatgtgtgtcaagggtttagtttagcacctggcataatgtaaatgcttgacaaatgtagtgctcttgtcaataatagtattaataataataagagcagcactaccactcccacctttgggtaagaagagctcactcacggtggggagaactgctcagtggtgactcccaccaaggcctggcccacgcccgcccttccctccccctgtttgccaccatactttggggttcatgggcacaagcctgctccgggacctcgggggctttaccttggtgtagaagctcaggagaggttgcttggtggaggatggaggtggcggcccacggctggcctgctgggacctgtagtggacaggctggtgagcaggcagggccctcactgtagttgcagctgagctggcccaggagcattcagggttgacaggaaggcagctggagaaggctgggagcatggaggtattacctaggtattacctagggttcctggatggcccccctgctacaagcaggacacaggcttgtcctgtgagcctggagctggaggcctctttgcaaaagcccaatcagggaaactaaggcacagagagggctgccaccacccaggtcatgctgcctgctcagacagccaggcctggaacccatgtctcgggcctcacaggctgggatggccctggtttggcatcttacaggactcctccctagaccccgtcctttacatgtatgctctggcagaccctggggaagcccccaggccgccctgcacccaggctagcccaggagccacccatccctgggcacacaggcccttggccaggagcccgtttgtcctgcgttttgagtgcctgctgtgaggagcatggcagccactgccctctgtggaacaggctcattaagtcagcctcttggtccagcatcgagggggatccagacttggctgtcactcctgtcgcctctggggagacccgtcagcctggcagcagcaagggattctgggggaatgtgaaagtgataacagtcattcagatggacctggaagtccccagctctgccacccccagtgctgccagccaccagccaccagtgtggtctcagcaaagtggctttaccctgcagagcctgggtttcttcatctctgtacagacaccccaagccttgctcccccctccccctgaggccagccaggcccgtgtccctgcttcttcccatgctgctcctcctccagtggccaccgcccccaccttcctggctccttctctcagtgccctcctttggccaagcccattctgtcccaggtggttctgtcatttcccctgcaagtcacagctcttccagagtccctccctctcccctctcgagggtgaaccagtgctggcagcagggccctgtgactggcaggtggagctggagcaggtggaggatctgtgtatgcgctccctgttactgagcctgactgtgcacgggggactttatgtgtattaacttgtttatcccccagcaatccaattaggtggatcatttcagtctctgcactttataaatgaagacagagaccctaaataatctgtctggcagagctgggatttgaacctaggcagctacacacacacagagagacacatacacacacatgcacacacgcaccatgggagccaagcaaaccttctggccataccatgtcagagtctggactgtactgtccaataaagtagccagtagccacggtggctctttaaatctaagtcttaattaaacaaaatgaaaaattcagtgtttgagtcatactggtcacaattcagtgtttgagtgctcagcgccactgtggccagtggtaccatactggacaggacagatagagactatttccattaccccggagaattctactggacagctcctttgagggcaccactgttggggacagaattggaacattcagtgctattgggggtcaaaatcagagtgggctttctggaggaggtgccccttccttaggccttgaaagttgtgaaacactaggcagggcaggagggggcctgtggtggttgcagcacagacaaccgagtctgcagccttgcctcccattgcaagctgtgtgacaccaggcaagtgacttaagctgactgaggtgcatctgtaaaatggggctaacgcagctgcctctgttgggctgggcacatctggctgcttggtgcttgtgggtttgtcacatggtgtctaggaaagtctgggaggttcaggttccttcactgtaagaggcgatcacccgggcctcccagggccatgcaggtgggctaggtgtgtgggaggagtgtggggccctccgagtcctctttcccacagaggccaaggcagaaacaagcacagcctgactttgggtgggctccttggcctccatgggaaatagggagctccttggcccaagctcccagtctcaggtcgaaactaggccagggctggggagttaggggccatcagccaaggatcgacccaagaggtctgtgctctgcagtggggccctggtatctgcccgtgtgtcacacacacccatacacacacgtgacacagagaccaggcacatgtctgcagatggggccagtgtagcttgaggggcaaagcagtcctctggctcccccgacacaagtcctcaccccaccacctgaacaagggaaaccagaaggagctagaaatgtgatcctcaggcacagagctggtgccacagccttcagggagaatctctctttaggaatactgccgctgggttgttctcagcaacttccttctaaaatctgagctgcttcctctggggctcagtccagccccagctgcctgtcctgctcccccaagacatacagccttcttgccctccgcacccagcatgcacacacacacacacacgcacacacacaggcttacatctgttcctgcccctgcaccgttgctcacaccatcccttccaccccaaatctccttcctgcttctgctctttttaaacagtcttcatctttcaagggctagctctagtgccccatcttccacatagccctccctgaccaccccagaccactctgatctccctgtcctggaaatttctatacagtgtttcctttgaccaagctttggggcacctgatcacaagggaacttgtatgttgtcttttcgtgggtgtttgccatctctttccagctagatggacaaaaaaatgaaaaagagggcaggacagtgtgtcttctgccactctcttacttcatacacaagactgggtctacaacagaccttcagtcaagatgtggatggatggtggatgaatgatggatggatggatggtggatggatggtgaatggatgatgggtgaatggtagatgaatgatggatggatgatggatggatggctggatgataggtggatggatgatggatagatggatggatgatggtggatggatagatggatgatggatggtggatggatgatggtggatggatagatggatggatggatggatggtggatggatgttggatggatggtagatagatgatggatggctggatgaaggatggatggatggtggttggatgatagatggctggatggtggatggatggatggatgatagatggatagatggtaaatggatggtggatggatagatggtagatagatgatggacagatggatgactggatgaagatagatggatggatgatggatggtggatggatggctggatggatgatggacggatggatggctggatgaatgatggatggataaatgatggatggatggatggctggatgaatgatggatggatggatgatggatggatggtggatggatggatagatgatggatggatggtggatggatggatgatggatggatgatggatgcatgatggatggatgatggatggatgaatggatagatgatggatgggtagtggatggatggatggtggatggatggatgatggatggatggatgaatggatggatgatggatggatgatggatggatgatggatggatgatggatggatgaatggatagatggtggatggatggtggatggatggatggtggatggatggatgatggatggatgatggatggatgaatggatagatgatgggtggatggtggatggatggatggatgaatggatggatgatggatggatgaatggatggatgatggatggatgaatggatagatgatggatggatggtggatggatgatggatggatgatggatggctggatggtagatggatagatggtaaatggatgatggatggatggatggatggtggatggatggatggatggatggatggatggatagtggatggatgatggatggatgatggatggctggatggtagatggatagatggtaaatggatgatggatggatggatggatgatggatggatggatggatggtggatggatggatggatggatggtggatggatagatggatagatggtaaatggatgatggatggatggatggtggatggatggatggatggatgatggatggacttggagagagtcagggaaggtctttaaatataggatatcctccttgaccttctcctcagggacttcattgttgaaccccatcaccccattttgtcactccccctcccatggttccctaggtctggcatgtagcccctggaagtccagggaacccccatagccaagaacagtctggcatttacacagggagcaggatctcaggtggcctgaggaggagctcctagcactccatggcagtgggctgaactggcaatcccctgccccattttgccctctaagaaatcaactgtgtattcctgccatcctccccacttcccctaaccctgcctcctcccactcccatggactgctgctcagtgtcaccatctaggtgggactccttggaatgcacctgatgggaacccaggcctgtctgtcatcatggtcctgcatcagtgccctgagtgacagagccagggtctcacacaggccacactgagaaggtaggcagtcagcacctcctgcattgcggccaccatccacactcctagtctagccccctgtgaacccaggctattgggctacgggtcctttccatgggccagatgccatttaagagctttgcacattatcccatgtaatccccacgacagctctgtaagatagcaactattttaacccccttttacaaccgaaggtacagagaggtgaagtcacttgtttatatcacaaagcactaggtggctgaaccagggttctaacccacctgcccttttaactccctgctctgaggcctggacatggtaaaacttgtcctgtggctgaagacacacttagggcctttgcccagaatagtggaacaagtcagaggagacagacagacagtgctttgttcttttgctgtggacagggcagcagcagagaccctctgggatgttcaggagacaaaatgcctggggggcggggttctggggtctatgatggccatagcatctggcctctctgggatgcagcctggggagccccaagaccccttctctccgcaggaattcagctttttcacccagggcaggaattccggcccctctggacaagccacatggtcacaatggggtccattctcagaaccctggaaaacacaggccctgcggagaaaggacagattcttgttaaacacaagggccctcagtgccacgatttagatcagggagcaaatgggggcagagaatggcctgcaggcccctctgtctgtcttgcctggaggttgctgcctctggaggccattccgtgcaaaggctctcaaaagccagaacaaaaacccagctaggggctaaggggtggaaaaaaaaccccaactctccagacctcagtgacccaaagccccttcgcccagccctttgctcagaccttcctcacttggtttctggaagaacatgctccatctcactatggaggtttcacagataattcgaattctcacaatagccctgtgaggacactcagagtagcctcctgttaggactggggaatccgagggctcctgccacagtgggaaatatcacactgcagctcgatacgcagacagacatctgatgcaggtgccacaaaacagccttgccaggggtgactcgctgatcatttctagtctgttcttcttaaaatgctcattgggaccattaaattgattctgaaactcactaatgggtcactgcctgtcatttgaaaagcactagtttgaagtggcttgtccagggtcaccagcccctgagggggcagagctgggcccagaacccgggtctgtggacattcagcactggactttgacagcccctctcctgcccccaacccccagctgtcaacctctcctcttaacaaaattttcctccagccaggatctgaccaaatcactccccaattctgcaaacttctggatttcacagccagacatcaaagccctgctcagccttgcctttcctggcccgtccacccactaccctcactgcccagtccacaactgtttggagctgcttgctcctgcttgtagagctttccccctgcatccctctatggatccaaacccccttgtcctttaaggcctcctcctccaggaagctacctgggatgttctgtagcccccaggacctctcttttctctgcactgagtgtaacccctcctgtaattctcagcgtggattgtctgagaatgttggctttctcgttggacttatgtcacatatatctcttctgcctgcctgcacaggccttaatgaggttgcctacagcgagagcttaaaaagtgcttttaggttgataacagcagtcaaaatcattatgtacctcaagagccccacgtcactcccctggccaaggttgcatcttctccagccctcatattctagatagtgcccatgtccccagtgactgctgggctctgaaggtcacccccaagtcagctgtctggcagcccagccggcctcttgagcagttcccagtggctgtaggccccgcagacaggcatcctgggcccagcagccaatgtcagctggcagacagaagggtgagaacatcaggctggaagtttgtgtgtgtgtccttctctgccaaggcacttgccagtgggagggagagtggtgaggggtgtggcgggcagtggagggtacaaccctgcagcattcagcagaactccacctggcaggtactcagcacccttccacagagccggcccagccaggcccagccccctttcctctctctcccgtgcctcagtggctcttcctggcttcacctctcactctgggaactctgaacggcaggatggcaatctccattccccagcgagggcctgctgcccgctgctggtgtgacctctccttgtggccaaatccctagtgggcctcagcgtggcccctttggagcattgtgggtcagggctgtctgtttagcttcaggagcctgggccagccactgaagcctcagacctcaatctcctcatccatgaaatgggtgagcacctgctctgcctacttcagaacaccaaagaataaatcctgggagttttcaaggggaaggcagagtgtggggagccatgtgtcaaaacaggggaacaacacatgtgaattgttcagtgcctttcctgcccccaccagcctctccctgtgcagtctccaacaccagccatttcactagagcatccggggagggagcacagcgtgtctggccaagataaaatgaaaggaaaaaagaaaaaccctttcgggtctacattagcataaaaatgcaagccctttacatctcttggttttggggctctgagagttggccactccttgggaggttaaatgtgtcctaatagaggggtccagaggcgtgcgtccattcctgtgggtcagggatgaacacacttcctggtgctcggcgctagacagagaccagtggttgttctggcatttgcgaaagcccaaaactctgaaagtggggctggaatcacacctgcctggcactgtctgccagcatcgtggtgaggtccttaaggagaagctccttttgtttcaggggctctgtaggacccaggtttaaacaggtctttgccacctgtgtagcaactgaggtgggtcagatgggcccaggtatgaaagaataacaacaaagacaatttatagcagtttctgtgccggccactgtgcgaagccctttctacacactgtacattgcatcttccccaaaccccaggggtttggtgctattattgtcctcgttctacagatagagaagtagaggctcaagaggccaagaaagtagatcaagggcacccccctgcccccactgcaagcagcagggatttgaactggaggcctccgtctccagaacctgctcatccaaacatagcttgcatcatcctatggggaggggccaagagaggaaccgtatcacccggggatggggcggggtgggagtagaggccccaggagtccttgtttagatggggagggatggagtgctggttggaggaactccacccctctttcccagccaggccagacctgtggaccacaggagatcacccatcccagtttgtccagtttgagccctgaaagtcccatgtccctgttttcctgggactgtgggtcactgtacctgtggtttgagtcacccctggaccagctgcagagaatgaatggctgagtggtctgatgggagctgttttaggacacagcttgggaggccttttcaattacattagcctctggcaacgctagagggagatgctagccccgcccttcctcccctcctcttcttcctgtggctccctggccgatatgattcagcagcaagtcggaagcaggctagactgtgacctaccaggagtggagtcaccggcagggtgggggctgtcagcaccagctcagggcaagacttggagcaaggacggagtgtggattggagaaggggactgatgggaagagggggggttcttgagttgttagggaactgagccccagcagagggccctgctgtcctgccagactggaactggttatagggcagtgggaagtggtcatggtgtgaagggggatccctgcctttgcgtcttgccctcgtatgtgagggatgggagagtcccagccactggatacctaaactgcttatcaccctattcagcagctaaaaatatgaaatggctttgctaaaggatgcccaactggaaacttccagaaggtctcctattagggcagcgcctgctcgggcaggccagacaccctgaaggattcaggattcctcttcgttcccaccattcagtcacagcctggtgacccccactgccaggacctcagcctccaccccattaaccccatgtgctgatcaggccctctgggctctgccttctactcctgcatccactactccaggaaggggtggtaagtgggcatttgtcttgagcctcagagcaaggcctgggttttctggtccccagtcctggtctcacccactcactatggccttgaggaagttgtccggcttctctaagctttggtcttctcacctgcaagaggagagcccacaccccctgcagggagggacccggaagtcctcggtggggaggactctgaactctggctgaaggacaggcaggccaagagatattttctagaggctccttcagcactacaagcacgttgttcttactgagcataaatgtttcttaggggtggctggaggcctgatggagattatgcaacactggagcagcctcagaatccccaggggagtttgttggagatgcagaccatgcagtaggttggggtggggccctgcatctgaattttaaccactttctagatgattccattgaatagcaggctgagaatcaccaaccagggcctggcacaaaggaggccctccaagcatgtgagttttgtgtcttccccactcttttttttttttttttctttttgagacagagtctcacttgtcactcaggctggagtgcagtggcaccaccacagcccactgcagtcttgacctcctgggcttcaagcaatcctcccacctcagcctcccttgtggctgggagtacaagtgcttgctaccatgcctagctaatttatttttggtagagatagggggtctcactatgttgcctaggctggtctcaaactccctgtctcataggaacagcctgggtagcctcaacctgctcagagctggagaaggcagccattcctgtgaggcagccacccctgcctgggctactggcagccagggggatggtcagtgggccatcagtcctgggcttctcctgccaggaccagcaggaaaattgtgggacagcagagggtagctcctcagtgccctcactccctgcccttccccagtagccctcagtgaaaaggcctgaaaagctaatttcctccttgggagtggaaagtcttctgggcaggacacagctacgatctaatactctcctcctcctctcaggaattccctgcacagttgagcttttggggggcacagctaggactcagtctctgcccagtcttccttctgcaaggggggcaagcatgcctttgttaaggccttccctggactgactggtgggagccaggggagggggcaaatggaagctctcccacctttctgtagtccctttccaaggcaacggtttcccagattctcctccacaccatccacgctgcagtttttattccttccagtgggcttataaaccacagcccttccccagattgggcaaccttcggcaatggctgaacctctgtttcctaatctataaaatggattaggatgataggaccttcctcttagtgtgggtgagaggattgaaggagacatggaataccaagggggttctcaaacaagatggggaaggaaggggagagagtcagaaatgcagatttcctggaccttgcccccagcattctgattaagtgggttctaagttttgggaaaggtcgatgcctaggagagggggagctccccactcctggctgtgcaggcaaatcaccttggagattaataaacactccaatgttggagggcacccctagacctcctggattggaatcttggggagcctccatgaggatgactctgctcctttccctgggagcctgctgcctcttcctccaagagaacccccttccaccgcatccccccaaacccccaaccccgcctttccagtggcagactagcgggctagtttgcttcgaccaaagatgggcagcaactggcattttctttggcccctggggaaaatggaaggcatttccttcggactccggagagagccccagccagcccctccactgttccctgagcactgaacagaactttcagcctttaggggcatgtgaggctcaggttaagggagccagctcacctttcccagtcccctgaggattggtgaatggaggggggtgggaggagtggggagataaggaaggcaggagcaagggcaggatttgggaaatctgcccatctttgagtctggactctttgctggagggcagggcaggtaaacggaggctgggagggtgcagtgcctaaggtcacagcagttactttctctgacagcatttgaacccacttcctcagaagctccacttccgttcctaccgttcctggcctcccagttaaccttgcagtatcctctgtcccccccactacccgctcctcaccccgactccccagctgtagcctttgagaaggaccttatccatggcctctgccattctcggggcgtgcagtgagaggaagcagccacagtggcccccagcgagtctcgggtctaggacaggggcagactttaatcaaaggatcacacaaatctgtgattacctggcgggtggttttgaggaagacacgttgaggaggtgacatttcagtagtgacttacgggctgagtaggctgggttcacctcccaattctttgcatcgctagggcaagccatgcaaagaattgggaggtgaaccgctccggtggcggggagagcgggctcccagcgctgggtaggggccgggttccggcgagcgccatcccggagcgtcagtttcccagtttgggaagtgaggagaacctgcctcgcccttccccgccaaggcttagggaaggtgagccccagttagcggggcgggctggggcggggcggggcggggcgggcgaatcgcgcctgggggccgggctggcagggggcccgcgggcgggcgggcgggcgggcgcggcgcgcagtgcgtgcggctgcggagcgcgcggctagccggccgtgggcatcacatgagcagcggcaccggggaccgaccgcagccagcccgagggcgcccctgcagctgcagccccgcgctcgcgcccggccctaaccatgtctatctgttgttgcttctttttcagggactatggcagttccaagaggaaatcaggtaagggagcctccgggcgttttcccttcagccttccttcccgcttcgtgcacgcgcccctccgatcctgcagaggacttcttgggggcggggaggggggggttgtccttgcacgccagcctacgggtcctgccgggccaggggtactcgcttcacttgcccctcctcagtccatggcccctgagacccttggtcctagaaccctcgttcgccttccaccgactcgctcgggctcccgctacctcgctgtccctagtgggtgtgggggtgggtgcatggggagtgcgtgggtggctcgtgaaggggctaggcccccgcacggtgagcagccgggtccttcacccccgggctgcggcggccgctgctgcgcagtgctaagacttctccggtccctctcgcggtgcagcggtgatggaagggttaatagagacgcggggctttcctgcgagaaggtgaaattgagaaccgggactgaaaaggggtcatccttgagtgacttgagtttttagcgcctgcaccacagaccttcttccctgccccaactctgagcgtgtccttgctgcggaggtgggggctccgcgttttggcagctgagacgcacttgggagggggccgacccgacccccccaaccccctccccgccccccgcattggcctgacaggtgccagggcccgcccagagtttggaagggggtggaggcagggagagaggcgggccagccctcggagctgtgggctgagggtagagcaggattgtctctggaagtgggaggctgggctccccaaatggcaaacgcctggatgtgggcgggctgtagttaactgggggagagtggtccctaggagttagggctgtgtgtgtgctgaagtgggggcggggacagactgctgcagcgatccgtgctgacacgtggattggccatattgacagggtggctgtaccttggggtacatctggcccttggggatgtaggaggtaacacgtggctcctgtgaatggctcctgtgcccaagtgccttggcctgtggataggttgaggggagtgcccctgtgtggtggatggatgtagagtggggtagatgtaattgtatgatatgtatgtttctgtgtgtacaagtgcttgctcacgtgcctattgggacagggaaagttgtgtcctggtttatgtgttgggggcgtgtgtggctgtggggttctgtgcacatgtgtgagtcatgatagctgtgtgctgtgagggtatgtttacttgtttgggtgcataggctgggggtgtgtgtgtggttgagatatatctggttatgggttggagtctgtgtttgtgtgtatttgtgtaccagtttgggacatgtctagctgtgggatgaggtgtgtgtgcacttgcctatcacctgggtctggggtgtctcaggcaggcacacccactggtgcagaaggccatttcctcctgtgaaccgtggggtgagcctggggaagagcattcctccactgtcactccaggcaggtctcaagtgggagaatggaaggcgcagcaaaatgggggttgtgttctgtcaccgcccacacaggaagcttgccctgggcctcagacgtatagtgtcctggttgaacctgggctcaaattctggctctgtgtgaccttaggcaagtttcataacttctctgtgcctcagtttcctcattttctttaaaacaaaaatgctaatgttatctgcctcacacatagaggattaagtatgttaatgtggaatagtcctggcaccgaataactactgtacaagtatcagttctcagcagcagcagcagtagcactttctgaaggcctgggacctagtcctgcctccattgccacttttctccctatgtgaccttgggcaaattccttctctatgctgggcctcagttacccccataaaggcaagagctggaacaaataacctctcaggtcccccgccacaatctctggggctcagcttctgtgctgcttcctaagcaatgcagggccacacccaggctgcctcccccagggaaagccaacccccagtttctctgtcttccactctcacgccaggaaaaggatggatggagaaatttaatttatattggtgtgcttatgataatggccacttagtgtcatggttgaaaatgccagctctgaagccagacagctggagttgagagtctggcttctctcctctgtgaccttgggtagatttcttagcctctctgtgcccattacttcttctgtacatttgggataatattcatacccattttgtgatggtttattatgtgtcaacttggctgggccacagtgcccagatatttggtcaagcattattctagatgtttctgcaaaggtgttttctaggtgagattcatatttaaataaatcagtggattttgagtaaagcagattactctccataatgcaggctagcctcatccaattggttgaaggcctcttaatggaacaaagactgacacacacacaccctccctcagcaaggaggagttctgccagcagctgcctttggactcagctgcagctcttcccttagtctctgccggcctcccccatcacattttggactctcaaacctccacaatcacataagccagttcctaaaataaatctccctctgtcttcaagctctctatgcacctcccattggttctgtttctctggagaacactgactaatacacacctcatatggttataacgaagattagataaactaatatatgtaagcatgtttagaacactgcctgccacctagaaagctcccctggaagtgctagatgctgttatcgaatgagcatctactatgtgcgaggacattttcacgtttcctcatttgctgatcagagccacagtacatgatgggtggtgggattcccattttgcaaatgagaagctgaggctccgatggggtgactgcccacacacagtccttggcaaactgaggattggagtccatgtttagggctctgttctgctctataatgaacctcacgaagcttcccagggtcactccagccagggacatttgcgcagaggaaatggatgccattctggggttcactgtaaatctcttactgagcatagagcttagacttgaggcaaggcttagggatggtggagtcaacagaagaagaaagttctcaggaactttctggaggaagcaaggctggtgaccttgaaaactgaaggacagtttggcctcaaatttatctgcatctttcttccctctattgaacctgctccttccagcatcttccccatctcaggaactggcaccatccaccccattgctcaagcccaacatctagaagtcactcgttttttgttttttgtttctttgagacagattctcccctgttgcccaggctggagtgcagtggcatgaccttagctcactgcaacctccgcctcctgggttcaagtggttctcttgcctcagcctcccgagtagctgggattacaggcacctgccaccacacctggctaatttttgcagttttagtagagacaaggtttcaccattttggccaggctggtctcgaactcctgaccttaagtgatccacccatctcagcctcccaaagtgctgggatgacaggcgtgagctactgtgcctggctgagaagtcattcttgactcttgtcttttacctgccaactcgagctgcagaaccaactgtctccccacctccaccatcacatgccttagaaaccccttcatctctccaggaagaccccaccttcctacctggtctcactgcttctctattagacctctatctgacattctccacaccacagctagagtgagctcttaaaaaatattgatcagctgggtgcagtggctcactcctgtaatcccaacactttgggaggccaaggcaagaagatcacttgagcctaggagttcgagaccagcctgggcaacaaagcaagatcctctctctaccaaaaaaataaaaataataaattagccggatgtagtggtgcaggcctgtagtcccagctactcaagtggctaaggtgggaggatcacttgaacccagaagtttgaggttgcagtgaggcataattgtgccactgcactacagcctgggcaacagagagagaccctatctctaaataaataaataggaaggaaggagggagggagggaagaagggaaagaaagaaagaaaataacatactttcctgcttaaattcccccagggactccatcccacccagaactaattccctaccctggctcacagagcttgtgtgacttggcccctggctgccttcctgacctgggctttacccctcttgtccccgcccatcacactgctcagccacaccagtcaccttctgctccttaaacgcatcaaacacattcttctacgtggcctttgtacttgctcttccctcttgcctgtaatgttcttccctgatctttcacatggctggctccttaagatttctgcttaaaactgtcaccttcttagcgaagctgcctgatcctgcactgtccagcctcccccgcagattactcctcttcttccctcctcatcgcttcccacactctagtgatcctgtgtgtttgcttgcttcttctctgtctcccaccacctcaagagcaaagaccttggctgcagggcttgcaccagccccagggtccactggtactttttgaatgggtgggtggatggaagaaagcatgcatgaatgagtgaaccttgtgcaggctcaggaaagaaaggtcattgtggctttaaattggggatcattgcctggaaagaggagacatttttctggtttgggagcagagagcgggaggctttggtaatccagagagagcacatgcacaaaggtagagggataggactaagtgtggcttgttgggagactgacctaactgagcatcaactatgccaagcactgcgcaaggtgtcgaggctataggaacgtgcctttctaccctagagaagtttgcagtctgctgtgggtgatgagctatatagaagaatgtactattagatggagggaagtgagggagcaacatggttacctgaggaagagcagtccaggccaagggcacagcaagtgcaaaggccctggggtgacggtgtgtgctggctgctcatgatgcagtagggaggcctgtggctgggatgaagaatagtggagggtaaagtggaaagaggtgagagcagagatgtagctggcagtggggagggaatagggtgaagcagcaccatgtagggccttgcaggacattctaaggattttgactttcatcgagtgagatgaagattcactgaggggttctaagtagaggcagggacatgatctggcttcaatcatagaatgatggggattgactaggcaggatgggttatgatgtgcaaggtcgcagggggctgctagccaggtgagataggatgtgggctctggcagcagtggagggggcaaggcactgcgggtgttggacagactctgatgattggatgtgggcctcaagggagagtttgtgtgggagctgggaaacaactgcatcaggttgcctggggtcccactcttaggccgacaacttgccagtcatgtgacttgggcaaatcccttcgcctctgagaacagattatctcacctgttctgttgtatcagccagggttcaactaaaggaacagaacgagtgggaggtatatattaagcgatgtagtgtaaggaactagcttacacaattgtgggggctggctaggtaagtctgaaatcctatggcaggtcatgaaagggggcaggctggacccccaggcccaggctggagctgctgtccgcagatgaaatgtcttcagggaaaccttcactctgctgaaggcctttcagctactgactcaggcccacccagagtgttttagataatttcccttacttaaagtcatccggtcatggtctttaataactataaaaatacattcccaaccaggcgcagtggctcatgcctgtaatcccagcactttgggagaccgaggcaggtggatcacctgaggtcaggagtttgagaccagcctggccaacatggcaaaaccccgtctctactaaaaatacaaaaaattagctggacgtggtggcgggtgcttgtaatcccagctactgaggaggctgaggcagggagaatcttgaacccaggaggtggaggttgcagtgagccgagatcatgccattgcactccagcttgggcaacagagcgaggctctgtctcaaaaaaaaaaaaaaaaaaaattccccagcaacacctaaattagtgtgtgattgcataactggggacagtagcttagccaggttgatgtgtaccacctgaccatcatacctgtcaaatggggttgttatagtagcagcgacctggcttgccccaaagtgcacagggttcaaggaggtgatgccctttgaggggttttgtgctgtgcctggcagtaggaagggcctgttgttgttagctgttgttgcttccccaaggtgggcactgctccaggagccccagtggggctggagcagactccccagagcaaggggttctcttgagacctgcaaagatctcatgcctctcacccagttctctaaaaagctgcatttcgccagggcacctagccgggaagttctgagatgcgccactagggggcacaggtggccacggagcctcgggattgtcagggccctggggctgttgtcaggagagcctgagggttcatccaacccaggagtcctgtggaagctccagctcgtttacatgcagatgaggttgctcaagagtgttgttacaagcttgttctcttaggcaagtgttgatgttcctcatgaaatcctgtttactttattcttctccttggaaaagtggtgagctcagccccacttctatctcagtgatcataaaactgtattattagctgagttcatgagatcagcattaatgtagtttcactgcagagaagcagtgttgcctggggttgacagtttaggttttggcaacaggaagacagggtttgaaccccagctctgccatttgttattgccgttttaattattgatagattaagaaagaaggggagaagttggtctttgagttgagacatttatttccattctgtgagacccaggaggggacgacagggcgtagactcagccattgctgagtattccgttgagttaaaaacgtggactctggagccagaatgcttagtttcatgtcccggctctgcctgctgtgtgatcttgggcaagtccttctctatggctcatttcttcacctgtaaaatagggataatcaggtttttttcatggggttgaggattgagtgaaagttcctgaagtgataactccagcaccgtgcctggcctagaggaagcactaagggtgaagcagcttttactatgaataggaggcagcaccggaggggttcgtctcaaacaggagagagcgctggtttcagcttttgccctttctccggagtgactcctcaatcagacagggggaaggtggggtgtccactatctcatcattgccaggagcctccctgcaacaaccagggtaggtggtcttgtcccattttatagaccaggaaagggaagttaaggaacttgccccaggtcagccagacacaggattctctttttttttttttttttttttttttgagacagagttttgctgtttgcctgggctggagtgcagtggcacaatctcagctcactgcaacctccacctcctgggttcaagtgattctcctgcctcagcctcccaagtagatggaattataggcgtccgccaccatgcccagctaattttttgtatttttagtagagatgggatttcaccatgttggctaggctggtcttgaactcctgaccccaggtgatccacccaccttggcctcccaaagtgctgggattacaggtgtgaaccaccatgactggccttttttttgtttttgtttttgtttttgcttttttgagacagggccccaggctctgtcgttcagactggagtgtggtggcacaaccacagctcactgcagacttgacctcctggcttcaagcaatcctctcacctcagccttctgagtagttgggactacagacatgcaccaccacgtccagttagtttttgtagagacagggtctcgctatgttgcccagggtggtcttgaactcctaggatcaagtgactatcctgcctcggcctcccaaagtgctgggattacaggtgtgaaccgcagcacacagcctaattttcctttttatgagtttggtttttaataaagtgaatttgcttagagcaagacccgcccataagttctggccactattaagggttagtctatggccgggcgtggtggctcgctcctgtaatcctagcactttggaagaccgaggcagttggatctcctgagatcaggagttcaagaccgacatgatgaaacctcgtctctactaaaaatacgaaaaattagccggatgtggtggcccgcacctgtaatcccagctactcgggaggctgaggcaggagaatcacttgaacccagggggcggagtttgcagtgagccaagatggtgccactgcactccagcctgggtgacagagtgagattccgtctcaaaaaaaaaaagggttagtctacctgaaaaagttcctctattctcctccttttatagaggaagcttttaagagagggatggccacttgcccagggtatggggtgggcagaacctggtcttctgctggtcagcactcccaccaagccctggaaccaggtggaagtgtgaggagggctgtcaggtggaagtgtgaggagggctgtcctgaagcacaggaagccggtctgtgaggtctctggtacctcccttccccgcaaggtaaatacctcagcagggcactagcagagctgggctctctggccctccctgggcctgccctgcccaaccagcagcagagggagatggagggagacgaggcagtggcagcaggcctcctccctccagagcgcaggctttgtgaggctttcacttctcttaatagtttgttggctcctggccccatggagtgcacagctcaactgagaaggtgggaccttttcagggattcattaatactaggcaggatggcttgggatctgcaaggtggaaggaggggtggctggccattgtgggagaggctggagatggccctgaaggacagaggagattgtgatgggctgaagggtgtgggtagggcaccctgcaggagggacagccaggcatgagtaaggatgtggagctggaatgagtttttgcttttttgttgttgttgtgggtttttctggtgttaatttttaacatggggtcttacttaatggcccaggctggagtgcagtggtgcgatcagggctcactgtggccttaaattcctgggctcaagcgatcttcccacctcatcctcccaagtaggtggaaccactggtgtgccaccatgcctggcttatttatttatgtaggagacagtcttgctctgtcacccaggctagagtgcagtagcccaatctcgatttactgcaacctccgcttctcagctctcgtgcctcagcctcccaagtagctgggactacaggcacccgccaccatgcctggctaatttttttgtattttagtagagatggggtttctctgtgttgcccagggtcgtcttgaactcctgagctcaggcagtccacccgcctcagcctcccagaatgctaggattacaggtgtgagccaccatttctagcctttattttttattactgatttgtttatttatttggtagaaacagggtctcgctttgttgcccaggctggtgttgaattccaggcctcaagtgatcctcctgcctcagcctcctaaagtgttgggattacagacgtgagccaccacacctggcctggcatgagcttgaaaagtctgagggaaggagaggggcccatcatcccggcaggagcgagggtagagcaggagatgagtctggaaaggaagtcatggagagtgtatcataagcaagaccttttaaagcaatttccgaggcgttcttgtcctcctgagctacccatcctcagtgagaaaggcccaggctacttagagaatgtggcaaagatcttcctgccaccctccaatggcccatttcaaaagtgagcgtgtcttttgaaggcgtcagcttctggcacatcttacccaggctcgtggtttgttttgttttttttttttttgagacggaatctggctctgttgcccaggccggagtgcaatggcacgatctcggctcactgcaacctctgcctcccaggttcaagcaattctcctgcctccgcctcctgaatagctgggattacagatgcatgccaccatgcctggctaattttttgtatttttagtagagatgggatttcaccatgttggccaagctggtcttgaactcctgaccttgtgatccaccctcttcggcctctcaaagtgctgcgattacaggcatgagccaccgcagccagcctctgggctggtgtttttaaacagtttttatttgcatggctctgggtcctcagcctgattttacccttggagttcaaagccatctaattggaaatgaaaggagcctgattgatttggcaactctgcggccagcccacgtggcggtgatgcgatggagaaagtgagtgctgctcacgtgtgtgtctgcgccacgctccctggctcgaggtggctgagccccactgcccaattggcctggacacacagagcaaggcggagcggggagggggcaggggcgtggcaagcgctccccggatcctggaatccccagaaggaggcagctagttggaagcctcaattccctcagccctgcttgcacagctgcctctgccccctcactcctatcacccagtttctcctgctaggaaaataggaagttggtccaaaagggaactgcatgggcaaaagtgaactgcagaatcttgagtctgctcattgaaatacagattcccagggcctgcccagacctactgaatcagcgtgtctggagtgacgcccaggtatctgcattttttcattttcttaagagacagggtttcaccatattgcccaggctggtctcaaactcccaagctcctcaagcagtccacccacctcggcctcccaaagtgctggattatagatatgagccaccgcatctggccgatctgcattttgtgtgtgtgcgcgcgcgcgcgcgggcgcgtgtgtgtgtgtgatggagtctcactctgtcacccaggctggagtgtggtagtgcgatcttggctcactgcaacctctgcctcttgggttcaagtgattctcccgcctcagcctcctgagtagctgggactacaggtaccctccacaacacctggctaatttttgtatttttagtagagacagggttacaccatgttggccaggcagatcctcctgccttggccccccagagtgctgggattataggcgtgagccactgcacccagccaatctgcatttttgacaggcttcccagggcttctgaaatcaagctagggttgcgtctttgatgggtcatccatgtgggttgatggccatgttcagggtagacaggcagcaagatggcagggggattggcatccccaagatgaatggtgcctggatgatgcctggatgggactgctccttgaagaacattcagttgtctcctgagatgggagggtgggctacgggggcaggaatggaggacaggactcccaagtctcttacccctgaaacacagcccagcatttggagtcttggagaatggctatctgaggggcctacccagccctgacctgatgagagacaccatctgcctttcatttccagaaggttttgttgctgggggaggaaatacccaaattgtggtccagcaaagaaatgtttcccaccgtggcccacggccagaaagtcactggttcctcacttcagcgtttggtttatagacacgtgacagaagaggcaacctttccagtgatgacaaagccggcggaaaaacaaagacatgggggaaatgtgcattacttattgttttagcacctttttctaatctaaagttacttttagaaacagaaaagtggtgtgtgtaacttagtcggcacgtggcatttttagaattggtctgtttcgaagtgtgaaagaaaaaaatatttttttcctgagtttccataaaacttagaagtttacaggaaaatcatgcttttccctgactctcttctttctgccttgccccctggatttcatcattgccatgtgtggcccaagcagccagcttgaaaatgtattttgttatttattgttagaataaagtcttgcaccaagacaactgggtcatgttagaaagtccctttgcttccttgtgctcagaaacagagtttgctgggtgtggtggttcacgcctgtaatcccagcactttgggaacctgaggtgggaggatcacttgagcccaggagcttgagaccagcctgggcaacctagtgagaccccttctctacaaaaataaaaaattagtccagtgtggtggcacacacctgtggtttcagctactcgggagggcaaagaaggattgttgagcccaggaggttaaagctgcagtgaatggtgatcgcaccactgcactccagcctgggcaatagagcaagaccctatctcaaaataaaacataaagaaggcaggccgggtgtggtagctcacgcctgtaatcccagcactttgggaggccgagttgggcggattacttgaggtcaggagtttgagaccagcctggccaacatggtgaaaccctgtctctacaaaaatacaaaaattagcttggtgtcgtggtgggcgcctgtaatcccagttactcaggaggctgaggcaggagaatcacttgaaccggggaggcagaggttgcagtgagcagagatggcgccattgcactccagcctgggtgacagagcgagactctatctcaaaaaataaataaataaataaaataaaagagaaggcagagctggccatctcttcaccatcctcccccttgtcactgcttctggatccctgtgagtaagggtgtcctcagctcagccctggagcaccttaggctctttgagtgttggaagaggatcaggtctgggtacataacttcccagctggagggtcagatccttgctatgctaagcagtgatgacaggctggtgacaacagaccaaactaagactgtctttgtatgttggcaatggcccccccagggggaccttgcaaatatgcagattttaacatccctcatttcagatctgtcagggtgggacaagttcttctggcctgtgagctcctgccatacacagtcctggagcctgctggctctgagttgctcatttgcatttggccacagggttctggtcaggggaactcccctctcccccacccttcctccatgacttggctcgctccttctgctccaagcccatggctcagtggacactaggcagctgtctcctggggcgcagggagggtacccttgaaggctagtggataggaagcaagtttctgaatggacactggtactaggtcttccttctgggatgaggtggctccttccagactaaagctggcttttctggctctggctgtgcctgccttctaggtttgtctactgcacatctgacaggtcttgtgatggaacctcagtgataccaagatggagacaatgaggtccttgtcctcagaggactcctggccagatgggggaggtgggcaaggaaacagcagttttaaaacagtgtcacaagtgctgcacggggctggggccacgccatgtaggggtctctgagcaaggcacacagacctgcatggctgctgagcctaatttactgagctttctaaatgggtcagctgggtgaagaggacagtacctgtgcagaggacatctgttcagtggtaggagccactgtccccatgtgccacgtcttccatgtggggcatctctttcatagccctggagcacctactgtgtggttctgtttcagaggagctattgcagattgctacttgttcaataaaattattgaagtttaaaatgttctaattaatatgtgttggcccaggagccacctcccaccttttccttattgttaggaagagcccagccgtttcctgggagacaaaggaggccatgaatcttgactccttgtgattccaggatcactgtcctgcagccaggttcctgacactaggagatgcacatgaaatatcctccatcagggaaggaatctccctccagtgagaactcccgagaggctgatgattgaccaggattgacaggacagggaaagagcagccctttcacatcccaggtcaagaccagtgaggcccagagaagtgtcccaaccttcccacgctgggaaaggcaaccagggccagggctgagcactgagcaccaggcctccttcctggcttctcccctctctggaagcttagcattagacagagccgccgagctgtggtgctgaagggttaactcggggctccccagagagccgcacactcccgaccctctcatcttccaggccctctcagctgcagccttctgggcatagctgggtcacgtgagagccagatgtggggatttcccaagcagtggtgtgtgcgtgcgcactgcgtgcatgcacagctctgtttacgtggcatctcagcgctcaggggattggtctggacccacgcagaggaggggagggatggggtaaggaaaggctcaggggctcccagcaaacaccatgggaggctgcaccaagccctgctccccccagacattacacatgaacgggtcgttcctgctccggctcctgtttcctgtagcgtccatcctgccagagactgtactgcttaggggtaatttttctaaaaatctctttgaagggcattaaagcagatgctgggagccaacgcccttcagggtgttctgcaggctcggaggcctgcacgggagccactgtgcccagcacaagccaggcctgtatgcctgtatgtggttccggaggccaagcctggactagagagggcagagccgtgggtatcaagagggtcctggggcagtggggtagccgggcctcagttttccatgcacccttgggcttgagagcagtgagtattcatctttccatcagccactgagggttaattgggcacctcctgcattcaaggtgttgtggggtgctgacagggataaggccttgaaggaactaaaggtctgattgaagagactcataacaaatctttaataagcacctactatgcgctatgcgcttgctaggactatagccctaaccagacgtttggagccagtgggaacagtcagtgaacaaagatcctgcccagggcatgataagggagacagaaaaccttgaaaagtgggtgtcctcaacctcagtccaggaatgaattctcctcctacccctgaccccccatccccacccctgtcttgcaccagtggatggcagcgtccagccagatgtccctgaggctccgtgagccctaccccaaagatgggtccagttataccttcaaggcctccaggactcagccctgccgtctcctccctcagaccttccgggacccagcctgtctccccaaacctacatgactcctgaagcagacaggaatgctggggacggtgtctgtggttgtgtgtctgatgctttgagacagagggtggagagtcagatggtctcaaccaggggccgttgatgctcccgaaatagttggcggttgattcattgataatccgatagcaagagtccagtctggagagaaggagacattccacattttgttgtccggggaggggaatgtctgtcctgagtccgttgctattgactccatcactcactcgcggctctcagggagactgagccagggaggaggcggattgcaagactcggggctggagaccagcgactgctgacttcatcccactgcccagcctctctgctgctccttctctgtgtgaacgcaaatactggctttggctcgggcttctgggggagctggagggtgggggaattggagggaggatctcccagtaagtgagggaggaccaccaaggcaggccaccccagggagggaggtggctgggatcctggaactcagaacaaacttgagtttgtctcttctctgcacacaaatgccctggggtggggagaggtgagaacctgagaactgagggggaggccgcaacccaaggggctgccatgggttgggcagcagctgctgggatcagagaggctctgaacctgccagcctccctggccagcacccctctgtccacccacggcacctctcactaacccagcacctatctttaaccaggaagcttccggtcttctcagcagggtggagggaggtgacagaactacctgctactccctgccagggcagccccttctaggcagcctcagtgctcctagggcatccttggcttctccgtccacacccacttaggctgggctgacccttctggccccaggcttggcctaggcaggcacccttggacttagtccctaaggggctgtggagggtctccaggcccagcccccactgcaccccatcccccgcctgagcagggaaactgctccttgactgcataacccagggccagagggtcaatagtgcattcctaccctgggttgggctgcccccacacgtgttctggattccagggaatgaggcaagtcctttcttgctgcatttacgaaaagcagcagaaataaagaaagccttggccagtggccagggaggatcagaaaatgacatcccccatgaggaccctttgttcccaattcctggccagcctgcctgggcttaagtctgatgccatcacttcttgctgtagggccttgggaaagaaccttaacttttcttttttttttcccccgagacggagtttcgctcttgttgcccaggctggagtgcaatggcgcgatctcggctcactgcaacctccgcctcccggattcaagcaattctcctgcctcagccgcccaagtagctgagattacaggcatgcaccactatgcctggctaattttatatttagtagagatggggtttaacatgttggacaggctggtctcgaactcctgacctcagatgatccacccacctcagcctcccaaagtgctaaggttacaggcgtgagccaccgcacaaggccagagccttaacttttctgtgcctcactttcctcatctgtaaattacagactgttgtgaagattaaacaagaaaatgctcataaatgtttagcacagcacctagcatgaatgttaagtaagtggaaactggtataattattctagctccagccctacgacttatttgctgtgtgatcttaggcaagtctcttctcctctctggttctgagaccctaaatagtccttccagcctgtgggggtaccaccaagaagccaaagatgtagcagagagaggggacctggagacaaacaatggcctggctttccatttgggatttgctttctgtctttaagaagatatccatcagaaattcagctctactagatttcttcttgagtacttctgtttatttagctcagtggccccaaaccctcaggtcttgggcatagctagctacataatttgcaggatccactgcaaaatgaaaatgaagactctctcattcataaattattgatgaaacccctgacagaagagcattaaatcagctgcagggacccttctaaacctgggaccctaggccactgcccagatcacacctccacgaagccagctctgccttggaggctctgagtgtaggagcaggcctggggtccgagctgctgcaataacagtattcacccctcgccctccagtgcaagggcactcttttttcatgccatgggtatctctgaccagctggctgctgcttatcctggaacaagcttttgtagagttgcccacatcagaagcagctcacacactaaacaactgccccctggaccagacttccacccaggtgtgcttggattggaagtcatacctgaactatttgttttctgtcatcttaattggtgtttgtttttgtttttttgttttgttttattttgttttgtttgtttgtttgtttgtttgtttttaagagacagagccttgctctgttgtccaggctggagtgcggtggcgtgatctcagctcactgcaagctccacttcccaggttcaagcaattttcctgcctcagcctcctgagtagctgggattacaggcatacaccaccacgcctggctaatttttgtatttttagtagagacggggtttcaccatgttggccaggctggtctcaaactcctgacctcctgatctgcctgccttagcctcccaaagcactaggattacaggcgtgagccaccgcgcccagcctggtgccatgttttttaagacttttaaagaattacgaattggccatccgtgtttttcccagatgacattcacgtggctttcactgttacgcctcagcttctgctgctctgagcatgacaacctgtttcaggtcctctaaagtgagtatcacataggccaaactactttgtaaaggaccgataaccctgttgggctgtcgtaaagatatgagttgctgtgtgcctatacagtagtgcctaccacaaggaagtgccctgttcatggcaacaatgacaattactgttactactgaataataggactagcatctcttaggccctaattatttgatggcctgaaagtggtggccgaatttcctggtttcctaaccagaaaggaaaagaaacgtggagtctgcaggaaacctaagaaatctagccctgtacaaagtttagttgtatgggagaggaaaggcttaaactgcagcagttatttagaaaccagttcaaaactgcaatgaggtaagaacagtattcccaaagagagagagggcttgagtgctccagtgtgtagagatactgaaggatggaagggcatggagaagacagggaggtgttcattccatcgggcccctggcctgtcacccctcccctccccagagcccagggtggggatgtggaaagaaactgacaaggctagtgaccctgccctggtcccctgagcctgtggttctctttcattctccgtggagttttcgctgttggctgtactcattctggtctctcccacctgggctcatggcccactctggatttattagtttggatggatggaacttgctttacaccagggaagcattcctggaaacatggtttcagactagatttggataaattcaacccaattctcactgctctggagttactcaaggttaaaagaagccttactatgaatctataagtgcccttttaaaaattattttatacttatttattttgagacagggtctcactctgttgctcaggctggattgcagtggcgtgatcatgcctcactgcagcctcgacctccctgggctcaagcaatcctcccacttcagcctccagagtagctgggaccacaggtaggcaccaccacgcctggctagatttttattttttgtagacatggggtctcactatgttgcccaggctggtctccaactcctgggcttaagcaatcctcccacagtggtctcccaaagtgctgggattacagacgcgagccaccatgcccagcctttattattattatttttaagaccagtcgagtgcagtagtgagatggggagaaagagtggaagaagaagtttgacgtgtaattcactgggaacagttgagatactcaccatcttcagagcagccaaggaccctctcctaacctaggcctatccagttgttcctatgaagtccttggatgtatgtgtgctggatggggtgggttgtccttaaagtcaggggcacctgcagtgttgttctttggtttctcagcatcacctgggcctgtcaagaatcaggttcagcatctaagtacctttgggtccctgtatttggccggaatctccaggcccctggttttctcctggcctggcttcttgctggtattgcgagcaatgccaggacggacagccatggcagggacatgagcactatgggctgtgtgagggagggacatggcatacctgccatttccaggaacctactgcttttgctttcagctttgtccctaccacttactcctctttgtgtccagaggcctaattcccagccctccaaaacctttcccaggcattaggccatttcagtcttaaccctgcaaagaaggcagggcaggtgttttttccccgtttacagaagaaggaacagatgttcagagatttcctagctatcccagagtcagcgagctaagtggcaaagccagcacaagaaccaaggttgcttttattcttgctccagatctctgccctctgtgcctcctgaatcatccgctattttggactcgggttgcctcaattgagcctgcattcaagtggttttcccaggaaggacagtccgtttctctggaaagattcatttccgctgtggtccccttgtgttatggagactaccagttttctgctgggaaggtctagaacgtcagacaactgcctcaggcaggccatcagacaagagcaataggcccaaatgcttaactgtacagatgtgagcactgaggcccggagtatttatttatttatttagacagagtctcactctgtggcccaggctggagtgcagtggcacgatcttggttcactgcaccttctgcctcccgggttaaagcgattctcatgcctcagccttccgagtagctgggattacagatgctcaccatcatgcccggctaatttttgtattttcagtagagacggagtttcgccatgttggccaggctggtctcgaactcctaacctccagtgatccacccacctcggcctccaaagtgctgggattacagggtgagccaccgcccagccaaagcccagagtctttaagccacttgcccagggccacacagtgtgttctcagcaagagccagggtgcaggtttccagtctgatgccctttactttctagcaggccagtgaccctgctctgtagggccgttggttctggatcaccagaggagatgaaggcagggacaggaggaaggcaggaagcagttggttcatgtcagtcacagctgctcacttggctgcgccccccgcctcccccccactgctccttcacccctgtccctctgtctctccaactccccgtcttcccagcccttagccaacagccttgtctgcctcctggctggagggccagggtttgtgagccaggggctctcctctgttcattgtaatgagggagaaggggtccttcccacccctcgagagcttgctagggtgggctagagagaagggggagggactttgagtgggagcagcagaactggattaattctgcaggtcaggggactgggaaataaatcatgttttagagagaggtttctttttaaaaagacaggcttacttctggtctgcttcccattttcctttacggagagatacgggaaggcctgcttatggggactgaaggggacaggcatgagctccggttgtctgctcacaggccatgtccggcccccttttcgttttataaataaagttttattggaacacagcccactcattcttttatgtattgcctgtggctgcttttgtactataagaatagagttgagtagtctcaacagagaccatctggcccccaaagcctacagtgtttattctctggccctttgcaagcacctgtccagcaaagcaggtcttcttgggttctccaggcccaggcaaaacagctttccttggctcactgaaagaggttagtgctttcaggtctccttatgaagaacccaaaaggaacccaaagtagacaaagtggtcaagcaaactgaagtggagagtggcatggagagagggccagatggcgctgggatgggcctggtgctaggcctgttcaggggcatttcagggccttgcagcaggcagcccacttggccacatctctgggatgcagcagcagggagttgaaacttcagcaagatgtgggcaccaggcagcaacacccacattctgaacccagacctccttggccataccagcttaaatccttgtggaggcccttggtgtgtctaccttgtctcagccctaccagggcttgaaagctgggccagcattgctcctgctccccaaggaggctgctgactgctgaacctggggaggggctgtaacctcagattttgccctgtttgtctctgggtgaggtcccctggagtccctctaccttccattccagataacccggtgtctgagagtgactgtggggcagtatctctaacagggtgccagctttttcttggtgcatccagtattgaacactgtctagttcttgtccttgcaggccgggggcatgattttctgggtgtccccagagctgattgaacccagggaggcaggcttatgctaaccacgttcatgggagttactgccagtggcggctaaccattatcaagcactgactatgtagtaggcactgcactgggcactattacatattatctaatttaattctcacagcaacccagaaggtaagtatatcacatcatccagatttttacaagttcaggaacaggctcagagagggtaagtcacttcttcaaaggagcagagcctatatttgaacccaggcagtcagaccccaaaggccttgctagaccgctccaccaaagccccactctgctaatttacaatgagaaccagaagggggccaggctttctagttctacaccgggagccaacctgcaattggaaggtggcttgctgagtgagggaaagagtcaggtgctttaaatagagagcagcatcaagctctgattagctgaggtgtgtgtccctgcaagagatggacactgctgtactagctgtgtgatcttgggcaagttatttaacctctctggttcagcttcttcatctgcaaaatggaggggataatagtactcatcgttgtaggtttgttgggaaaaataccagttactatatgcaaagtgctcagcaggatgcttggcaaaggggaaatgctgtataagtgtttgctgctgtttatcagtactctctgaatgggtcaggctgctctcctggcaagcgcctggtgggcagtgcgagagtttgtctctcagacctgcaattcagcgttgccttttaattgtccccactgcagccagtgctctgctcctttggaggtgatgagcagcccagcagagaaagcagcagcctggggatgccaccagacctggttccatgtctgagagtcctccccggtaaaatggggctaaacatgcctacccacttgatggggttgccatggggactaaatgagtcactgtagttcgactgcatcaatgcttttgacatggtggccctcttctcttctattctagaaatacgcaaaccattgattagaccaagagctttctgcctcattcagatgttaatggtatcacatctcaatcataagttctttatgctgctttgattttgctccttcctcttggcaggaggacaactctaaatcccatttcacaggtgaggaaactgaggcccagattggacaccactgtctgagcctggagtagagccctcatctcttctggtcactcaaggtccctgtccttctgctttggggttggggagcaagactccctaaaacgatgctccctctgctctgctggggccgatctgtcttcctcagtgggtggggctgcagtaagggctggatgacacatcagggtctagtgggtgtggtgcccccaggcctagagatgggtcctgggtgctccaaccctgacatttgaggttctgggtccaggccactgagcccgctggcctttgaggatccttgcaaccatcaggccccgtgggacccagccacccacatggccagaaaggaagggtcaggctgccttgtacagggctgtgataaccacgggccccgttccagggaggatcgtgtgggattctctgtgctccgaaggagtcctgcatttcggcggacacctcattatccctgtcccagccggctgtgtcccagcgcctctgtaatcacacgggcccacgcccaacagccagcccagggccaggaaatcactctcctccctcctccgccttccgcccgcggctggccgagcgcggcgcctgcagccactcactgtggacctcctgcctgcctaaccgttctctctctctggttctcctctcctgctgccgcttgctctcggggactcggaagtgtggctgtccagctgggctgagtcgcccaagaaggacgtgacaggtactgcccagcgtgcatgcatgtgtgtgagcatgtgtgttccaggtccgtgtgcgcgggagccggtgcctgcaggccctgcgcatgcttccctgtgatgtgcagcagctgtttgccagcatggcagggggtctgccacttgctgtgccctctgcctccccagtcagatctgaacatggggccctttgctgagtgatgaccacgtagctcagcgtgtaagcacgtgtgctctggacccagggtgtgtgggtctgaattccagctctgctacgtcctggccatgctgccttgggtggggtgtgtaacctccctaaggggaagccatcccacctcgtggggagcctggcacacagaaagtgctcaggcagtggtggggctttcgccatcttcagccttatctcaattggccgtctcagtgagagagcccagccaaagatggttcatctcactttaggcaggtaaactgaggcagagagcagcgggccctgacacccaaccctcatttccagtgatctcactggggagctgcagatttggggcagggggtggggcagttctgtgactgtgactgagggtgggtcacagcccccatgcccagcaatccagagcttggcctgcctggctgagatggccctcagggactagggccttggcctgtgtctgggaggagctgggcaggggtcagggacttgccttcaacctttagtcttatgggaccatggcagagaatcccggacagcagggttctcagctcctggatggagatggtcggaggagggatggaatttccagaagggtcttctatgggacccctccatttttgaggctgttacacaccctgaccctctagccccaaacctgagagcagaggttcaggctgggggaataggggacaaagcagaagggtgggagctgagtggggtggtggggctgggccagccccagtgtttagagcccaaagcccagcccctactgctgcagctgtgggcggggaatgggaggtaaacgtgttgggaggagtccagaggagaagagaaggcagtgggtcggagggcgttgcaatctccttctggagtttcctgtgacgagggcctgggcctgagctaatcactgggctcctgtccctttttcccctctccacacgccagtgagccagagcccacttggcccacagcaatacattttattcaccaaacgtatagcggaggggccagcagtcccagtccagcctgggaggaaccagttataaggggctagagggacttttgtaggatgcccagggttggggagtcgtggggagcctggggtggaggccagcacagggccttactagctctgtgaccctggggaggacacttaaccacgtctcaagatgatcccagctgtttggagtgagaggcccaggggaggcagtgtgggctgggggaaaacccagccagactgcgagtccagggccagagtctctctgggccttggtttctccatctggagggttggagggttctttgagatatgagacaggaaactcagaggtaagggctgatgttggagatccttatagatcaggggcctcaggttgcttagcctggcatccccccagagtaggcccagggggctctgagctgcctctcaatccagctggcaagtacccgttacctgctgaaggtagggtctgggaggggcatgttgcagggacacagcccccggcctcccttccccacccttctcctggcacctgcagccctggcaccgagctgcctgctggtgagcccacgaaggaaccaacagctttgctgctcctcagatctcccattccctccacttgctttaaaatgaccatctatgatttccataggacttgaagccccgtcacttcattccgtgctcagaacaattcccatgaggtaggaactgctattgttcctgtttccagatgacactaaagctcaagagaggttacgtgtcctccccaggatctcagagctagtaagggcaaagcaggactggacctcagacctttggactctaattctaagcatttccatcatgaatttcaggtaattactatgtcccatgtcatgtcctgaggcaccagtcctggagtgtcgagagactcttgtccaaggcacatactttggttggggagcaatgcccaacataaagtccaggagggaacagaaaagagggaacaagagtgatcaggagcctcctggaggacagagatgcttggggagaattgggaaactgggattggtagagagaagggaaagcattccagcagggggcagcagctagagcacagacttggaaagtaagaagctgcatggagcagtggtgttgggtgttggcgcctagtgggtgctcgatacatgtgttgaatcatgaatgatgtattgaatggtggtgtgggggacggggatcaaggaacttggggagctcagattggcaagaaagactgggcttgaatttgtcctttataggcaagagggagccgtggaaggcgttggagcatgggactgacttggcaaaagcccagttgagaagtttaagttggcagccagggttccatccaggtggtagttgaaggaatgcagatgtgaggcaagggtggggcaggggtccaggggacccctgggaccccagcaggtccagccaggggctctgtaataaagcacaagggtccatctctggatcagactcatgcaaaggccccttccaacccaggagaggctctgctgtctagaagaggtacaccccttctccatgctcctgccaagcactcctcatctaaagacaccaggctccctccactgccccctccccactcaggcagactcctccagcccctagttctgcaggccttggctgagaggggatccagagtggcctctgtgggatgacatcaccgcccactgcctgcctggcctgcaagtggtttctcatctggatacctgctcgcagctcccgcccgcccggctgccctggccagggaacaccctaagaggcagctgccagagggaagagctgggagcctgcctgtgcaacgggagggaagggcagccagaaggacagagtgtccgtgtgtccatcccacagcctttggagcagctcctgagagaggccatagcctgtctgtgctttccaatgcctagagaatatttccttaacttttctacctgtgtcccagagagtcagccttcaggaaggtcaggccaattttccaggaaagtggtggggggaaggggtgtgggggtgtggatttaactctgctttgaaaccctgcctcagattttcttggcttggattaaaatgagctgatgtctgtccactccccagcacctcctgctcgtcctccaggcatcttctggccacaaagctggggcttctttctcctccttacctcagtttccccatctcccctttctcccttcgagtttggctcattttcccatattcccatatcagagtcaaggtattcatattgacaccacaaaccaatgagtccctctgttcatctttctgccagttcacgcgtttcactggttcatttcacacttattgagtgcctgccacctaacaggcactgtggtctggtcagtagaggtggcaagagtcaactagaaacccatactctaggccaggcgtggtggcttatgcctataatcccagcactttgggaggccaaggcgggcagatcacttaaggtcaggagttcaaggccagcctagccaacatggtgaaactccatctctactaaaaaatacaaaaaaaaatttagccaggtatggtggtgggcacctgtaatcccagctactcgggaggctgaggctggagaattgcttgaacctggggggcggaggttgcagtgagccgagattttgccactgcactccaacctgggcgacagagcaagactccgtctcaaaaaaaaaaaaaagagagagaaagaaacccatactctagtctttattaagcagccgctgtgtcccaggtacctgggatgtaatgggcccttccctagggaccaggcgccggtggcccattataggccacatacagtgcagaagttaagatcataggcagtggtgtcaggtgggcttgggttcaatcccagctgtgtgaccttagagaattcacttaccctcatgaggcttgctttgcccatgcgtgaaacggggccatcacaggacctactgcatggggttgctctgaggattggacgaggcagctcgatgctgttggatgcctccaagtcagcactgatgaaggcttgctgtcactattgctatgatctggccatactcaggccttgcgggctctctaacctgccacagaactctctattcttgtttgttgctggagcctttctttcccactcttctcatccagtgcccccacactgggaaaggaggccccatttctcgtagggcagggatggccctttttgtgccgggtgcgcttaagaagtgctgttggccacagaggctccaggcatggaacaggcactgctgttcccctaggggcacagtgggaggtagtccgtcagcgcagcacccggcgctgcctctgcccagctggcaggggcaggcacagaagctggcatgcctaagtacagaggcggggcaggccctactgcccggctgttggttgcatttctgcctgaaatacaatcccggctttagcagggctgctcgggactgtgcacgtgcgaatgtatgtggcacactcagctgtgcagggtcccttctgcttctccaaagggctgagatgggcctgcagggcccacacctcatgggagaaaactgccggggggcagtgggtttctttccctggaaggaggcctccctttgggatttcctagagttctgtggccattgccgtctgccctaggttggagggagcctccccctacagaaggacccaaagatctaagtagtgcttcttgcacctgggtgcacacaagcaccatagggacacaggggggatgtccaaaaactactcatgcctgagtcccagaccaaagaaacctgtctctctggagcccagcatcagtacttttaaaaagctccctgggtgattctgtgcttccaagttgaggattactgtgctagaagaaccagactgatggaaacaaatcagaggcagttattctgcaatggaaagacagatgggcttgggcctgaacaaaatcatactgaatgaatgtgatgctcttcatagcagctgtgggagctagagtcgtctcttgcctgctgtagaggggcctctggttagtcttttgtgaaatggaagataagggggatgttgtgggcatgaaatggggcggttaatgtgcctggcacatcacatttgccaagtcaaactcaggcgtgtggggaatgtggctataggctgaggcaccaagggggctgtgtggaacttggagaccctcagcaatttttgtagccaggctagtgacatgaagccccctagccttcaaggagattggcagacatatagtttatgccagtcgcagtggcctatgcctataatcccagcactttgagagactgaggcgggaggatcacttgagcccaggagttcaagaccagcctgggcaacaaagtgagacctcagctctacaaaacataaaaaaattagccgggtatggtggtgtgtgcctttggtcccagctacatgggaggctgaggtgggaggattgcttgaatccaggaggtcaaggctgcagtaagccatgattgcaccactgcattccagcctgggcaacaaagaccctgtctcaaaaaaaacaaaagtatactaggaattccctttgggctgggggtggtctgagaaggcttcctgtaggaggtgactagtccatttctggctagtggatccttttcactcctagctaaaagcacatcataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaaaaaagcacatcatattttaagtgtcttatccccccccgcccccccccccgccaataatggtgatgggaagagttgaagtgcagaggtttaagcagcatccagtgccactcagctaggaagctaaaagggcacccagcctgtctgccttcctgcctggtgcctgcttagcaaatgtcgtgctggtccagtggctgaggaggacagagaagctgcttgctcctgggagtccacctgccctccctctgctgcacccagcttttgacccctcaagcccctcaaactgccggggcctgaccacaagccccggcactgaaaggcagagagaaactgagtcagtctctgcagccagagggccctctctggaagcagggctgggggcaggcctgaggctggtccgactgtacccggcctgggctcggtggcagcgcctgggtgagcccgaggggcaggaacggagcgaacttgaggaaaagttggcggggggcgggctgggctcgccagccgctggcgcggggactttcttcttgggtttcaagtaaacagtctaggcctcctccccctcccctgcctccacccccggctcctcattcgacgggtctcatgtgtttctatttaagggttgcgagtaaaccccagtgattggcggcctcaaaccctcttgactcctcgcctgggcctgggccgtggagaagctctctcccgctctctcctctccctctcccgcccgagggagcagggctgccttttctctcgggtttgcaggggttgggggcagaggctggagcctcctgcttgcctttcctttgcctctggcctcagccctcatgggccgcccacccgctggctcgccgccctccccgatgcccctgccggcccgagagggaggccggagagaccccgtcggccccaggcctccccgcaggctccctcatgccgggctgtgactaactcatcgcagcacaaggcttctttctgagcttccttggcctccgcctccgctctgcctctctctttcctcctcctcctgcccgtcccctccccggccccctggctccccatgtcccccggaccccgcggtgcagcgggccggtctggggccttgctatatggcctgtccttggcgccctgtgagctgcgagccccggctgcgggctgcccctgggagcggcgctggcgacagagcagccacccccgaggaggccgatggacagggggcgccctggccgcggggccatggctggccgctggctcaccgcgtgctttctgccctcgccaggtgccgacgccaccgccgagcccatgatcctggaacagtacgtggtggtgtccaactataagaagcaggagaactcggagctgagcctccaggccggggaggtggtggatgtcatcgagaagaacgagagcggtgagtgccctggccaatggccgtccactggggttccggtctggcccccgggccgagctggtttttgttcctccctcctcccccaccgctgcagctatacgttatttccatctggcagagagagggccgaggcggctgaagtttccccctgttggtttgggctgcaggccagcagtttgcctggtggtggaagaatgtctccttgctcggggtaattaaccagcctgtgttaattgcacgtttcaggcacagcgcgggaataaatggccagccctgctggggtccccgtgccctcggaggcccgtggggcagggtgctctcagctcagggatgcccagcaacaaccacgttctgagccagggtccagggtccaggcaggacagcccagccagctggtggggaaggcaggccctgctgtcaccatggggtccagggtccccgggtcgctggcaagtttgtggaagggccaggcctgcgggcgttggttggggtctggttggggatctgactgccccctgccgagctggaggccccaggacctggaaagcaagcgcagtgagggggatgcagccaggcctgggccaggcaaggtccggcactgacaggggccgtactgacagctgcccggggcagctggttctcagggtgccacggagggggcaaaggtaccttggtgtccctggcagcaggagtcatggcaggtgaagagaggagagcccaagcctgtcagtccaggcttgttcggcccccaacagggccagggctgggactcgagcccaggacatccatcagcccacagcctcccagggcttgcatgggtttctggggtgttttgtttcagtttcggtttgctgcagggaaggcccctgtgctcagagcctctctgagtggtgtttggtggatacttccagaggggaggagcctgttctcctctcctagtcccactctatgccttgccagtgtttaaacccggaaaggaaaggcaaagcataggacagcagtgcctgctccgtagagacaggaatcgagacacagggaggttgcggggaagggagtctcctgagatccaaagcagaaccctgtgcctcctggtggccaggagctgtggagatgctaaggaaatcccagtgggcctcctgggggaggtgggtgcaggctcctgccaccagtggctccagagaacagggctgtgatatgcgtatagggtctgacttgtggccctcctgctctgaggtcttcgaagtgcctgctcccctctcaggtcagactgtgtctgcccttgtgcctggagtcatcaccaaggtggtcagcagtgacagtcctccctggcagagccatgtccctgctgtgaggcctcaacctttcgtcccaggtgcccacactgggctcctccctgggcagctttgtcctcagcctttgtcatgctcatggtgccacgtccctgcccgcaaagtaagctagcaatgtcatgggggtctggctctggaaacccccagtacctgaagacccaaagcaatggatctctaatggtgacatgggagacctcaggcgagggagatgtttgttgtagagcttgcatcaggaaaggtggttggttcttctcagaacttctggctagggaagttctgagcaaaccaatggttctcccaccacgcctgcctgtcacaccatagccgtttaacccttgagcagcaggaggtagtgagcccccatgtctttgggggctgccagccactggccaggatggctgaagatgagagcacacaagaggaagtcatcctgctggaagactccaggattcccagggcatgtgcgccctctcccctcctatcccatctacaggaccctgggacactggagtcctaggattgggggaaggagccttgacaaagggggagatgcctgctctcctgaggagctgctgatggctgttagaggtggcccaggcaccccagctccccacggccacccgtggccagagcaggccagtctggcacgcagactgtgtgagggagctgctgttcttagaagccgcattctacctgccactgcctgctggggggcttcatgtcccttaacttctctgggcttcagttattccttccataaaatggagatgaccttgtggctggttggaagcaggggctggagcaaatgacctccctgagctctctctcaggtctgaactccaaggctgggaaacttggtgggactcaaggtgtcgggtagaaagagtttccctgaacatggcttttctacttctgggagtttcgtatctttaccgttggtagagacagctgctcagctgcagatatttgcacaggacctgcagtgctgtgcctacctattcaaacccgtctgttgctatctactaggaggcctggagtatacatccagcctaaccagagaaatgaagtgggtggaggggagaaaggaagagggccaagctgcagatctctgggatggtcgcttcccagttcagggaagctggaggcctgacggtgggggagaggaggcgtcttgtgcaacctgaaggagtggtgagtgaggcttttgaactcaggaacaaagacccaattgtgaagcctttgaccttgggacacagtgggtgtgttgaggcatttccatttgcgttgttgggcaatggccccagccagcaccatccccacctccctgggccttgccttgcccacagggtgccaggactctgcctttgtcccctctcacttggctgggagtgcctcaagtagagtgtccacagggggacccagccacctctggctctgcctgctcatcagagcccctctgtgctctcattggtctaaagagagatgtgcatggaaggtgattctgagtcagtaaacaccaggtggcaggccacatgcttcacatacatcattcttttgggatatcatggaacaacaccatgcagtagaagggagtttaaccaatttgtggctgaagtaataggctaagaggctaagtaattgccttagagtccaagagctaagatctctcccctcaacagaggtcatgcagggaggctgagaatgggcccatcccaggtgggaagggtagaagtccaagttggcaatgctgtaggttgaggcgagatgcaggctgggtgagatggctgtagagctccctggaacatctgtggggaaggttgtctctgcatccctccttccagctaatgggaattcatgttgttcattgatccattgaacttagggacaagaaacagctgagagggtctgaggaaggtgatgtgtacctaggactgaggacaaacctgttccagagaacaggagtcaaacccaaagtgagacttgaatagctttaaggaaagcatttgtgatcaaccagtgggcctagggccagaccagaagaggactctttttctccattgatatacagggacacatagagcaggaagattcatagctttggtagctttgccacccagcaagccataccagggcatgcagccgccattgttactttgtctttggaaacccctctacccttgacataagcaaaagtgcataaggcgcctcctctttaggacattcatttgcctcaaatactgcattggcttccctctccagcaggcataatttctggcagcgtggtgacatcagggtcctggtcactctgatttgtgtgttgagcaaagctgcatccaacttcctaggattgtttcttcttaggactgcaggccaggggaagaagtggggagatgagtcaacaaaatttttcctgcctcacctttcttctctgagtctttgcttacttcctggcaccgggcatgatacattgggagttcttatacttccatggaagcaagaaattttgagctcctggtccatcattttttttacaagtgagaaaaccaaaccttgggaagaatttgagaatttttactcccctctagggtcaatgctttagtcccagttgagttgtgagcggagaacagaaattcactcagactttctcaagagactgttgaagcaataaaggaaaatctcaccaaacccaggggtgagaagtaaatcagccttaggaggctggaactgggaaccaaaagtcagcacgagccaaagcagcttctctgtctctcttacttaccatgtagattttttttttttttttttgagatggagtttcactcttgttgcccaggctggagtgcagtggcatgatctcggctcactgcaacctccacctcctgggtcaagcgattctcctgccttagcctccaagtagttgggattacaggcacctgctaccacggctgactaatttttgtatttttagtagagacagggttttactatgttggccaggctggtctcaaactccttacctcaggtgatccacccgcctcggcctcccaaagtgctgggatcacaggcatgagccaccgcgcccagctaccatgcagatttaaagcacagctatgctcttctaactgtagaccagcctgccttctcctctcatccgaccatgacagcagcttgtttgagtggcgttggtttctcaggaccagacttgcatgacttttcagttgagatctctcccgacaactgagtttgacctctggttctctgagttcagaattcgaagtttgaatctgattgttttctcaccagcaatggattggcaaacgttagatcgggtgtccagccctggtccaataagctgtgtcctggagaaccatcacagagtataaacatggttacctaaccaacctcttcagcagaggctgttggtgggtaggttttaaagaaaagttacccaaaaacatggtggctacagccattttacttgttcagtacctgtgcatgtggtggagagggtgaagaatccagaattccagtacggggtttaagatctaagtctatatactgtgtgatataagtagaaatcaatttgttttctgatggttaagaggggctagtgatacatactacatgggctttctgtaaggatgaagtatactgtatgtaggagtggttcatttattcactcgtttatttcaccattcttgaatacttgaatactttgtgctaattgtgtatacatccatgaggttcctgcctttatggagcttagagtctaattgatgtgctcattctggtagactgtattgtgagcctgggatagccttacagactttgcttgcttttttttttttttttttttttttttagacagggtcttgctctgtcacccaggctggagtgcagtagtgcaatctcggctcactgcaacctctgtctcccaggattaagtgattctcctgcgtcagcctcccgagtaactgggattacaggcgtgcaccaccatgcctgcctgatctttgtgttttcagtagagatggggttttaccaagttggtcaagctggtcttgaactcctggcctcaaatgatccacctacctcggcctcccaaagtgctgggattacaggtgtgagccatcatgcccagcctgcattgtcttaaacggattttatgtgtatcttctacatcttgcttagattctgtgcttactatgtaaccacctgattactattataattcagacttccacattcgcctgctcctagaaaagaagtgtcccaacaaagataggctaggctgtttctagaagggcaggtttattgtagtctgcattgcggaaaactgaactaacatgcttatttctgcaacagtcttttaagagtttggctccagtgaaccagactccatttagatgtggtgccacagaggtggtgcctggccccacgaggtcctgtcccagccatcagaaagccttgtgcactgacagcccttctcttcagagtgcagcctgtgtgtgtgttcttgctatatcaggctaatcagcagagtcccttttggcccaagacgatctccagtgtgcagccgttacccacttcacagagctggctggaggggaaagggcctgggagcataaagccaggagcagaggcaggcatgctagcccagtcttgggcccttccactcagctttattcactccaggatcaagattatgttgagaaggagactgcaggatagcctagcagttaggaacatggacttcgtgttagagaaggctgcttttcatcttgatttggttacttcctgtgctgatcctggggaagtttcttgggtcctctcagcatcagtttccttacctgtaaaatggggataattgtacccacagctatagggttggtatatgctaattctaaaggaattcagggccaggaatggtggcttatgcctgtaatcccaaaactttgggaggttgaggtgggagggtaacttgaggccaggagttcaagtccagcctgggcagcatagtgaggccctgtctctacaaataatagtaataataataataaagacaaaagaaagttagtgcttcatgcagggcctgacacacagtgggtgctcaataagtgacagccactagaaagaccactgattggggcagctctgccacagatcgaccctgggacctgcagggggccagtttctctcttgtggcctcaatttcccccatctggtcatagaactgacttggtggtatctgaggactgtcactcctgagggtctgtgaggtggctatagcagcagaggggtttactgtcaggcagtgaggccaggacaacccattctggggccagactcactcccctggagttcttgcttgggcagttatccttgtcccagcctaatcaacagagtccagcaggaagaagggttggcgacacaagtcagggtcccattggtggcctcatgggattgggggctttcatgacaaccccacgctgatggtccctcagtagccctgttgcatggtgcagagctgaagtgtcaggggtgaagacaagcatagtcgagaaggcttcctggaggcattgagcagggctgggagaatgaagggattagacaggcagagcgaggagtacagggcgtggtggggctgcgactgcaaagcaggcatgcatctatgtgccccaagcagaagaaaagcgggagctgggcagcaggaggtgggagggtggggcctcgggaagctggtgagccggagaactccctgagaagggtgagccttgaggcaagccctccgggctgtgtggggaggagggtggcaggcacaggtgtggcaggggctgggcagctctgcaaatagtgctttcttccagctggatccacagtgcctattgtcagggaggcatccaagggcttgtcaatgccaagtgctgccagctacctgcgtggagccagctgccaggcaggcaggtggggcagtgagcatgggggtgctccctccaccatgctgtcaccctgcccaggttggacaggcctggtgtccagttgctgtggcctgactctgtggacctactggctctgtggacctctcatgtcccaaactcctccaaggccattttccttgaatagttatttctcagcaaaatatatgggttagtggtggcctcggtgtggcatgcagccctggaaatcccacagaagtgccagagtgacaaccactgctcacccgagttgtagcctcagggcaatacctggccgccttccctttgggggacaaacaggtttctactgactgagcccatgagcatctccaaaatgttatttttccaagtttgaacaccaaggggcctgtgaagctggtcttccgatggctggtcggtcggtcatcagtaaatctgtacgagctgactaagtgtcaggctgggatccagaagtgacagaggccaacaaagccctcatggggctcaaatattgcgaagagacatgtgacaagtaaaccaaggaagtaattctaggtgttgacaagtacaagtcaggaaacaagcaggcgctgtggagacgtcagcagcagggagggggcaggggtgtggtcaggaaagacaccactgaggtgttgttaaagctggggacaggtgggccttggtgaatgcagggaacagcagaaggcccgctggttctgggagggcaggagtgagcaagggcagagacgggtgccgggccaaggagtattattctaggtacagctgtcactgcctgcctactcgaagccccgcagcggagctgacagaggtgacttgcctcctctgactcaggtgtacctttgcacaggtgtcctgtgagtgggcaaccctggagatcctctgcctgcccccaacacacagacactgcctttgtcctcagtggaaatgacaggtctctcacccccctccccggctgaagtgcagggaaaagatcaccccacacattttctccactgttacgtaacagatttcagcaaagtgtaaagcaaacactttctggggagtataatttttcaggaccttggggaatttgggttgggaaattgccccttcctcattctctccccagcttatcctgtggccatgtgatattacacccttcagcagttgggttttctgtaattgttccggtgggagtgggggatagctgccctcatccctctcagcatcttttcagattccataacctcatcctctgggtttccagtgctgacctagaatcctggcctcattgtgggggtgtagctgtggtgacccagttcacccagatggcctgcaaagtctgggggagccagggctcagcaggactccccatcctgggagctgagctgtggaatcccaggaaactgacggaagcttctggctcatagaacccccgagttcatttccctctgaaatatgccgtgcatgattatcattggttttgtttcatccaactgtcttagccccagctccacactccccttcttagctgggcatctctcaggctccggctaaagttcgtttgcctcccctgagtttttattggatcggattgtggggaagtggcccaggagcaccatgggaaatgagcaaaggccaaactcagagtaagtttgccaaggactgtccataaagcaagtgaactgtgggtgggttttgagactggtgtgcgatagcagatccctctctcctcttgtgacggggcccgttggcagtgccacaggttgccctgggatccccatgtcctggaaagctctaaggacagtggccagaagcctgcatgttctgttcttccacactcctgccaggagggttattggggaggtcaaggccacctggagagatgcctgctcgtgctagctaagagggggggattttggacttttttaaaggtgatctctttctgaatcacagtattttatgttttacaagatataaaaccatgcagtctataaaacatcttggcaagaggcaggatggatgttggcattctgtctttccaaggaggaagttgaagcccagagaggtgaagtgacttgccccaaggttgcacagctgggaggtggggcatgagcttcagtcactgccatttgaccagggtttggagatctggatatttgcattgtagatttcacttctttgcaaagccaaactccagagtgcttcaccacatgagttccctggccacagagcacaggaaagcagcggtcagttgtgctaaagccccactggggcaggagaaaggccaggggcagcaggtcagagggaatctgaaagggaagagaagcatgttgactcttttcccacaagagagttgcacgagcattcccacctttggcttaccaggtccttggggaggggctggtctgtgtgggtaggtcagtctgcttacctggtgggcagcaccaagggtgtgaggtgtgtagctgtggggacccagctgccgggaggctggtcagcactccagcctacagtgccttcttctttccactatgcagacccatcctggccactcccccaaacacaaaccccctaaggaagacctgccacctgccaccctctctccttccgcacccctaccccagcattcatcacatctcagccctcagtgaaatcctatatgcaggggctgcttccataggatgtggtttgctcattcagtcaacaaacatgagcatctactgtgtgccctgtggcatggccagcactggggtgcacgtggacaagaggcagctgtccctgtcttcccattgctgaaggtgacagcatcctagggctgtctctttacctgcaaggtaaaaagcccaggtgtagtgagtcagtcattttcactctgcacctacagtgtgcaaggcagaaagcaaagtgtggctgaggactggagctaggactcaatctgctctgggcaccgtgagctttcatgaatactgtcaagtttgctcagagacagggacagggcctggactgggtgggtccagaaggcctacttctggagaaggtaggccttgaacaaggggcaggccccaggtggctggcaaagctgaaggaggaaggtgctccaagcagagtgaacctgaatgatgcatgtggaggtgtggagggtgaagtggacaggtggacaggtgtgatccagccacagtgcctgggggctgcctgagagaagctggaggaactggtcaagggctttgaagggccttaaatatagacaaagagagcttttcctctgttcttccccattgcgctgaggggctgagggatagcggaggcctggaaaagtgaagccacgtgcccagcatcatagtgagtttgaggcagggctgtggcacatctgtgggctgctggtgcagtggtggctgtctctgaggtcccaggaggactggggagtgatgcggcaggtgccaggtgaggggaggagggggagcagggctctccagctgctgccgctgctgagctgctgccgctgctgagctgctgctcacctggcctgggcccttccgcctgttactagggctagagcctggagccaggcaaaggcacctccccatccctgtgcatttaaagagcctgtttttctaactcccctctcctctccccacaagatcagcttcacgtgccccaactggagaatgcaaactcccccatctagcaaggcttctgggggccagtgtcaggctgggaaggatgcatggtgtgctccagggaaggtggggctgccctacagctggctgagtcccccctcaggtccagaggctctgcctcctcagccccttgtgttcctcccttcccccaggaagggggtgaggttgctgttgaggttggccaggcatccagctctggtgtttctggacatgatgtctttctcttttgttttctgtacttttaagcggcattctcacaggccccagccttctctctgctcagcgtgctcaccatcttttgattacagcagcatcttgagctgctgcgatcaggggtagcatacaggttggcaaggatacaaggcttggggtcttgcgcttgagactgcaagccagcacctgaagcactggctacttgagtctcccatgcctggtttggccaaatgacctttctgtgcactggtggggctttctgccagttctagacactcacttcttgctcgaggcattgggtcaaggaatagccacttggcatggtgctcagagtgtcatgttaatgggcagagcagtggcgtgccatcgagggaggaaggccaggctttgcgtaagaggagcttggtcaacccagactctaagctcagccaccaaacagccaagtgacctcaggcaagccacttcacctctctgagcaccggctttgctcatccacagcatggaggggtgattaggagtggagacagtggccatggttgctttccagataccaagcttccccattcccctgacgactgtgctgttaccaagctgggcaagaagcccactttatctctgcagttctggagctcctaagattccatcttacccctagggacctgaaaacgggccagtttcagctcagagggagcaggcgaggggaatttgaccatgttggcaagccttcagccagctcttccccgcagccaaatgggtcactggctacaaacgtctttgggtttgtaatgatgatcacagggatcgtggactcctgaacacctttggaatgggctttgtgcagccaaatgcatcacagattaaatttctggagaaggaacagctgagacatagtcttgagcttccctgagccacttctgtactatggcagccaaagggtgtgcacacgcacgcgagggggcacgtgcattttctcccctgacaaaagggtgggaggtggggcaggagcaaaagacgatctgatcttgcaatttgcaatagccagtgggccagctggtgcttctcgtggtttttaggatagtgccgggaacagaaagaatatgatgaatgtcatggaatttcatgataggagtttggggtggcttcccctcctttttaaaataatgttttgaaaagttgccctggagaactgctgaaagcagagaggctgatggacgtttttggttatgtcagatgaggacaagattatccaagtgagcgagggtgtctctccctgtcggctgggctgcggggttccagggccgccctgccagaaagcaagcaaagggcccgtaatcacaaacaggctgggatcagttacaaccagaagtattactttagactcttggctttgatggggaagaatgcagttttccttggccccctcccccgtccttctcaagttaaacaagagccatgaaagcaatagctctggcgcttaaagagaggcttggtgcagggatctcaaaagccaaacattggagggctcccctgacccccactggtatcggggtagggatttgcctgacccttttactaccccatttcttcttgtgtgcactggggaatcctgtttttccatactctttcttgtctacctgggcccttctcatcgcctcacctgtgtcgtgcccaccagcccgtgtcctggcattctctgagtgcttgccatgcatctttcctgcgtggatatgtgggtgggaaggaagtcgggcagggatagcaaagaagtggctagcacgttggagcagaccttaaccagctcctgaagataacagaataggagattctcatccctccgggctccaacccacccctaggggaccctcttctcctcccctccccctgccttaaccagtgcctcctgggcaagcatctgattgactctttcgtgcttgggcatgaacgacgctgctccggagcactggcattatgtggagtgtgctttccccagcattgataaccggagcagaaccagggtggcttgaacctcattgcccacagggtgggattttaactggctgctccttgtaggagagagaggatagttacctcggcacctgggctttgcatggggagaatgagcatccagggttcctgtctcgctggctccctcaggagaatttaaccctgttcttctgtttccaagcaccatgtgcaagcaccaagtgaggctccatgtcccaggcctgactgcacaaccagacacaaacttgcctccttggatttaaagggcctctacattcagtggagctagagcatcttgttggtgctcatgtgccaggtgagaggagcatttggacctcaggggcctgacctgccctccacaccctggtctctccactcccaggaggtcatcctaccacctcaaggcccttgaaggagaaaatccattctagaagtggttccagggtaaggggctgggtggaatcatagccaggttgggcaggaactctgacccagagacaggacagtgagatttgagggacggagacatccaaatccaatctaagggctatgccagagctggggagctggagctgatgccatgatattgcagtattgcccgcttcctggggagtgaagctgtggctcctcatgggtgacagctgggactcattgggggtatcttggcctgccacagccagggtatatttaaaggggcaaaataatcccctacctccatccccccacccctgactactattatctgactccgtctagacctccccatagaggcctccctccaagggaggtggttggaggaccccatggaggctgggagatggcagtgtggcaggcaggccaggtcagtgacttcccccagctttctacccatctctctgccctcaggtacttggatcttcctgttaaacagtggtagaatattgatcaaaggctgggccttattcagagcggagaaaaccagaacccagcaaccaagcaagggtatagtcaggagctagagatcagacatttgttcattcaattcactcattccccagcctttatctcctgctgtatgccaggcactgatgcacagaggtgaacaggaaagacttgatctccatctttatggagcagacagtctacaggggacacatacagttgcccgctctgacccagctgaggggactgtggttgctggttggttgtgggacaaggtggttggctctctgcaggcctctcccctgtgggtgctgggggtgggaggcaccagagattgacaggtcagtgtgggaagagctgtatcactcactggtactcatgggtgtcagtcaccactgcctgaccagtcactgtaactgtggcgagtctctagaatgagaaacctggtctgggccagtgttgtggggtatctggactaggggagtatctggtttgagtgtggccttttctccttggattggggtgggatccgtactagaccaattcttgggaaccaagaagacaagatggttcccagaggcaaaagagacaggaagggaatggggcaggaagccgctcagtgagagaacctaatcctaggtcaccacaaacctagctgaggccccaggatggttatcccaggacaaggggatttagggctcaagttagacccatttgctgctttctggagacttaatatcagaaaccgatgaaactgatgggaaagacaagaaagagattattaaagcacctcctatatgtcaggcagggaacgaaacaccttttttcttataattatcaccactgccctgtaaagtatgggtattgtgatgcctattttacagttaagaaggccaagggccagacggttcaggtcatccacagttctcccctgtacactctgctgcctcttggtgaatccactggaggcttgtgccatggttgtggagctatttttggtatgcctctctccccactgtcctctgggagttggggcaaacaggtctctggggctgcccattccagtgccctgagttgcacccaggaggactttgtttgtggtccctggatgagaggcagtgccaccaagattcccagtagaggcctgcaaacaacctgtggggctgccttgaatgggcttgggagatgctgctagtggcaccccctgcattcctccaggaatgtcggcccgttcctggtgattagcctgtggggcctccctgagctttgatcttccattcctgtaagcggagaggcccagatggaaatggccgggtcaggtatccaagcagactacatgagctgtcaggactggaagtattagctcactggatgatcctgggcaaattatgcaacaagcaacaaaaacctctgtgccttgggtccttgaagacagatcctcctgggtaagctagagatgcttgctgtgggtcgaagtcatttccccaaattggggaactggaagaaggaacattgcccagaggctgagtcaccgcacaggattctagcagagcagaagttgcgggggccggcaggaagacagctggagagaagatgcccagtgctgatcccgcattggccccaggagctgggcttcagagagtctgagcttgtcaggatgccaagatgagcaagattcggcctatgtcctcagagagctcttggtctagctgggggactggccaacccaaacctaaggtcaaggtgatgggggagccttgagttaggagagcagaacgctggctggcaggggagtcaggggaacatcacaaagttagtggctttgaaggacggggcctgggtactacagcaatgaatcaaagacatcaacacatttgggggcttctgaaccctgctgcatgtgcattcaaaaagcaagacggggtacttctcccaggccccaagaaaggcttcgaatcctactctgccactgaatagccactctgtggccagcatgtggccattctgctcctcagtttccatatctgtaacatgaggataatattggaaacccatgtggctattgggaaaggccagctgtgaaagaaaattgtcaagtggcatattcaccctcctatccttttctctgatggacagggatgggctaccatccagtttaggcagtaagttctactggggatagttaggagtccgtcgggtttctgaaatggcttagaatagtaacccctctgcccccaccagcctatagcctggagactttttttttttttttttttgagacttggtctcactctgtcgcccaggctagagtacagtggcatgatcacggctcattgcagctatgacctcctgggctcaagtgatcctcccacctcagcccccgagtagctgggaccacaggtgcgtaccactatgccccgctaaattttttaaactacatttttagtagagacaaggtttcaccatgttttccaggctggtcttgaacacctggactcaaacgatctgcccacctcggcctcccaaagtgctgggattacaggtgtgagccaccgcacctggcctatccttttcaaagcatttttctcatctattatctcagagtaactctctaagggtaagtagggcaggtggctttgtttccatttttcaaaggaaacagttgagacctcagagcttgcttgtggccaggcttggatttgaaccaaggttcggcagattctttttttttttttttttttttttttgggatggagcctcgctctgtcgcccaggctggagtgcagtggtgcaatctcagcccactgcaagctccatgtccgtggttcacaccattctcttacctcagcctccccagtagctgggactacaggtggaggccaccacgccctgctaatttttttttgtattttttagtagagatggggtttcaccctgttagccaggatagtctcgatctcctgacctcgtgatccgcccgcctcggcctcccaaagtgctgggattacaggcgtgagccaccgcgcctggcctggtctgcagattctttaccccaagcttcacctgaagaagatcagtggttccccgagagtgggtcgtgcaaacatgtgctgggcggacacagcattgagtggcattgaatctcgtcatgagaagtttctttcctttcagttctctttcactccacattgggtcaaggggagaatctccatttggggctcctgtgctgttaacatctgtcagacgctggctgatgtcatttgtttgtttgaccaagagcaaatctgacccaggcttagaatcttgctagaacttgccttgctctcttgttgaacttcatggcattgtttcattgtatgtgtttttccggaatctcccgtctatacctaggaatgctggttttccatccactgtagcataggaaaatgtctttttgaaatacatgtttaagttttaaaaaataaagtcaacttaaataaacacactaagatgacactagtgtaggtgttactcaggttcattggttcacctggccggagggcttggggaatgcagagttaaacgaccccaagtgggactctgtctcttaggcacctagggtgccctctgcctcttgtctcctagggtgacaccagtggctcccaaattccaactgggaaaggagcctggaaaagcatcggcattcgtggtggctgctccccacaccaagtagaagaatccacgttgtcagagagctgctaacgtcaggcggtactggatttttgcaagccctctatttaaaattccccagaaattaaataaggaggctttggagggaggaatgccctagacaaattgtggagtgggtttgttttgtttatggagatggtctttaaagtctaaattgtccccgttttatttttgcccaattgaagaggggctgaactcagctgggagggaggggatggttgtcagcctacagcttttagttgaaaccaagtccattctggggccaagaagcttccatttttagcaaagagagaaaggggaaaaatatacaaactcgtacatgtacgcatcttaggcactggagtaagccagttaaatggataaggataatctttatatttcaagtgaccacagctctcttctccaggctgcaaatagatctattaagcaccaggcacatttctgggcactttccattcttttcttttcttttctttttctccccacaacactggtagtaaatacatgctgtttcatattcccatctcaccaatgagaacttaagcctcattcttcagtctcttccttcagccaatctgaaggaccaggcaccacactagtctgacgttggcttcctaaagctgtagtccacccaacaccatgatacaggggaggatcttaggtggcagagaggcaatatcaatccttctgcatcacacagtgggaaaagtttgtctcattgcagttctcttccaagccttctgacttatctcagtttgatgttcgatgatctttaacccctgtctagcaaatctgtgtagcaaagaaagagcgggccacaggctcagcctcttcatttgtggcacggttcaaatgtactacatagctttgttttcatcgtgtgtgcttttctggttggagccagtggtcctcgttgtttattcatggtggcaatctgaagtttccttagcaaatttctttcttgaagttaaaaaaaaaaaaaaaaggcaaattgctttaaatatacagtccatttccagacttatgatggtgtgacttacaatttttcagctttatgatgggtcattgggggtattaagtacattttgaacttgggatattgtcaacttaacgatggctttatcggaacgtaaccccactgtaagtcaaggcacatctgtatatgttatatgaaccacagtatatgtaattcaaggatatagcaaaggttgtgtgtggtgtggaaatacctgaggtttggggaaagcagattcagagtcactcttgcctggcaaagcccttgggtgagatctcgtgccagaacgctctttcagcctgggtgtccctgcctcgccctaccatgtgggcttagaggagaggcaacttggaggcaagcctgaaaaccacctctccatgaggagtgggaaaagccacaccctcgactcttccaagactcagggcttcgtagacaccagtggagtggaggagaagcagatgagggactgggtttcttggctcatctgtcagatgggaatttggggcataatagagcaggcatttggggcactaatagagcaggcattgctggtttccttctgcaagacaatgaacagctgagctggagtggttttaagggtcgctgaatgaatgctgtactgggtatgagacctgagtgccaatcctggcacctccccttagccacacactccttgggtaagtctcccattctgagtttcctaaggcagcctaagatttcacggacctggggacagacttctgccccaagacatactgaacacatggtcctcagaactcctttctcatcctcactgccaggagggggacctgcacaactcaggctgcctggaccctcccagcttgcacctaagattttggcgtcatggttgttaaaattgatattgcccttccatttgctccaaaaagtttgaacagtaaattttaagatcctcatactaagccatgtccttttgtctctccatttaagactttgcatcttgtcagatttgagctgtcattaccatctgttcagacctcttttttggctcctaatcctggcacagcttttgctaaatgagatcgtgctgccagtactgtgtctctgtcctcatcctgggttgattaaaacatccaacaggacaggttcccattggagccactccgtcctgctgggttgtgccagccctcgagctgtggatctgtcagtgcttccctgtagcccccagggccctgggggatcatgagggacacaagggcctggaggtctcagctgtgacacatcccgggcccaccagtccagtagctcactcactgccaggccccctttcttcctgttgcacccttctgaccgacactgcctgggtgagtgtgcagagccccttcccaggctctcccagcattccttagggagtccatgttttacttaaccacgaccagcatgaggctgcccttctctactctggaattcaccgccttcttctctaaaagctgggaccgttgcccattttgtgtccttgggtgttgctcccatctccatgtctcccacgattgctgatgatgactggagggctctttgtcaaatgctcttgggacccttctctgcggccagctggtgagagtgcattgaggcagcctgtccatgctgtccctacctctgcctggggtctacttaccctctggggatccgtgtgccaggctgagacccttccttctgagagcgaatgctgagctgcagacaggagcccaggagacccctcctccctgtgccacaccctcctcaggaaagagacttagctctttctttttttttttttaatttttttagatggagtcacgctctgtcacccaggctacagtgcagtggtgcgatcttggctcactgcaacctccacctcctgggtacaagcgattctcctgcttcagcctcccaagtggctgggattacaggcatgtgccactacacctggctaatttttgtatttttattacaaacggggtttcgccatgttggccagactggtctcgaactcctaacctcaggtgatccgcccgcctcggcctcccaaaatgctgggattacaggcgtgagccactgtgcctggccgacttagccctttcttactctttctcttgctggaacagcagggaaaacaccctttttgttcccctgagcatgtcctcagggctccacctctgagaatgtaagtgtcttgactggattcttagcaggccaccccttcccgccccactctccttccctgactgccactcttccatcatcttccatcgtcttgcctttgacagcaggtctctctcaccatccacatcatttacagttgtgacattagagtttaccttcttgcatcttccatctttcctgagcgcctcatgtttaggaatctgggcacaggctcacacctctgtgctctgcttaataatggcactgagagagggcaccagcttgaggtgagtgcctcattttctttttttcttttttttttttctttttcttttttttttttttttttaagacggagtctcgctctgtcgccaggctggagtgcagtggcacgatcttggctcactgcaacctccgcttcccaggttcaagcgattctcctgcctcagcctcccaagtagctgggactacaggcacacgccaccatgcccagctaacttttgtatttttaatagagacagggtttcaccatgttggtcaggatggtctcaatctcttgacctcgtgatccacctgcctcagcctcccaaagtgccaggattacaggcatgagccaccatgcccggccttgaatgcctcattttcatctggaataatcccctatgaagccattagagtgagcccatgcagcctgtcactctgaggttcaattcaagtctcttctcctctaagaattcttttctgcctagtcattctcatctctggatatctctggttccttggcaagcattgtatcacccaccgccatgtccactgcatggggctgtctgggtcgccctgccgcacccagcacaagcagtctcgtgccaagtccccctgcaagcagccgcccttctcatccatccactgctctgcagctcctggagaggcctcatgccatcttataatctccacctcaacctgtctccgacccccacccgtgccaggcacagaatcagacccacatgttttcagtagagaccttctgaggtcaagggtaaatgacactgacaccacgagggtctctctctccccctgaaactccagacacccaagacctacctgcttccctggccatccctggccccagtcacccaggcgcattgaggtcttggttccttctttagaatttcacttcatgtcagcgctttgcgacttgtgctcgtctgaaggcactattctgattccaatcaggcactattctgaaggcttttcaaggattagctcctctaatcctcgtaacaacactgagatgtgggtactttgggtcggttttgcagatgagaaaattgaggcaattgcccaaattcatgcagctggcaagtagcagagctgggcctcaatcccaggcagcctggctctggcgccctcgctggaaaccattctccgctacctgtcatttaaccatgtgtccctctctgcctgcgttgcttgttagtcaggcctccttctgggtgcctcacccatgaccttggtctgctcagacacaccagagccctgtgggcttggcggggacccagcctagcactggcttctgggcctgttcggtgaggtgggcaggctggagctgagtgggaaggtggcagcagcccaggctgtcttgacacggactccacggagccttccaaatggtgacgtagcagcctgtgctaatggtcttggaatccaggccccaggtgcccaggggaggttctgggtccctggtggcctcagagcccgtctaggggagggaaggccctgggcaacggagcagggtgggcacaggtaggacccgctgagtggctcatgaaggcaggggctgtgtgggtgcacgcaggagggactggaggagtttctcgctcgctcctgtttgctttggaccatggaggcgcgtgtcttggcaagagctgcagtgacagggctttctgaccaggggaggcctggccgagggtgggcagcctttcactggtcttaaaggcacagcactcgcagacagcctgcatttccagcttctctggttccacaaaggcagaagccttagctctgcctggaggtcatgggaaaggggtcaggctgggtccaggacagcagcactcacttgggcccagccttgtgctgggtgtggtatgggtaggtaggcagcgctggtgccatgcgcctggccaggatgccctcagccctttcttcctctcagtgtctccccacccgtcgccacttggagctcgcaaatgccctattcccttctccaaacccgcaccaagcaaagaacttggaatgcctaggaagatcacccttccaaagggtcaaggtctgagctcaggtttaaatcatgaatagaggtgctttgagaagcaggtcagggtgctggctgagggttctggaagtgggctgctgctgttcacccaccccgagcctatatgaggaggagtttgaggcagggcctgtcttcctcttttcctagctccaccatgcacccttccccacctggataccaaaacccttacataggcctgggcatggaatgagtgcagcccacattctgagctctgaattacctggtgttaagccagatgtgaaggaccaagagtaactcacggggaaggaaaacatgaagcctggaagtcatctaaagcctcctgggtttttccaaactccaagctctgagtctcatcctgccttgaaatcctctgggtttgtgcccagagcctgaagcccagccttctccagcaggcctcagggccagggcacaggcggcaatcgaaccccgcgtgtgccatgcctgggtgatgggggagtagagcatgagtcccggatgcgtgttgttcactgcagtgtcctcgtgcctggaacaggacctggcccgtaccaggtgctcgggaaatacttgctggtgaaaatctctgggtattgcatacaccatatgttcctgatgccactgggcatccccaggtacttagtattactctggtgtgccagtgaggctcagagagggccagtgacctatctcaggtcacgccaacagtgagtggtaaagctaggatcctaaccgaggtctgtctaggaagaagggattaagaagcatccttgggctcaatcctgggctgaacagggctgggaggtttgggagtcagagcgggaggacgagaggatttcagagggagaggaaggagtggggggtctcccctccccccaccagctgttttgtcctaggctgagctgtgacctcagaggacttaattaacatcctaattgtgtgcagctggcctgactctggccctaacgagctcattattctccctccttaaggaggccattgtggcctagtcaccctggggacagcagtggcctgggagtgcccgtcacttcctgccgccctcagtcaggctcccccattcctggagagtctaaggccctggtccctctcctggcctcttgctctgtctggctcactctttcatttccctctgtctctctgtgtatgtcaatctgtgcctcagtttccatctctactcttttttttttttttttcttaagatggagtctcgctctgtcacccaggctggagtgcagtggtacgatctcgactcactgcaagctccgcctctcaggttcatgccattctcctgcctcagcctcctgagtagctgggactacaggcgcccgccaccacgcccggctaatttttttgtattttcagtagagacggggtttcactatgttggccaggctggcctcaaattcctggcctcgtgatccgcctgcctcggcctcccaaagtgctgggattacaggcctgagccaccgcgcccagcttcatctctactctttccctccctcctctggtgtcagcatcagtcaatttgagagagatttgaaattggccaaacaggtggactctgctgggccggttcactgaagatgcttagcctggatagagggaggacctggtgcttgggccccagcttttccctcccggggctgggacatcctcccttccctgccctgagctggaagtgctggccagaaccccccatgttgctgcctcctctcctcagcccctgggtcattgcaaagtgggttgttacttaaggctcacagagcatggctggctgtaaatgccaggctacatgttcgttctttctgggcctctgccatctggaaagggctgggccctggcacacagacatggcccgatggaaggacaggccagggtgaggcagctttggggtattgtccagtttgggattctcctaaacaacttctccggtctaggggtttagccctgaaaaccagggctagagactccagaataaaggtttctgccacacaccgtgtgtacctggggtcctctctcagggttcctctaaaacaggctgcagtttcccattcaagggaatgagcatggtagcccctcccctggcccctgtctgggaggggtcatctcagcataagggcactccaggcaagaagacctgcctaagcaaggccctggcaggcatcaaacgccctggcgggtatcagagggcctgactgccaggctgggctgaagggtgcactaaggggtctcctagccagcccaggccccttgggagggtccccactatctcttgctgccaccaagctccctgccccacctcccaaaagatcctgcttcctttgtacctggaaaccagggttgacttctcagggaagaagccaggtgtggcagccagccagagaacagctgccccgaacctgggcacagatagggccactttctcagtccacttccttccatccttctgaaacccctgaaggtagccctaaaaccccagcttagagcagatgcataggcacacgcccacacacactcaaggcagtttccccagatgagtgagtgcctcctgatgccctcaggctgccctctgcttgtgcactgcacagatgccacctggccacccgtgggtgctgaccctctagtgattaacgaccaccgccatgtggataatagctcaacctaagctacctccctgcagtgtctcctttattcccctcaacaacctcaggaaatacgctccattcattcctgtcattacaaagagggtgactgagactcagaaaggtctagtaactttcctcaggtcacacagctaggaagcagcaagccaggacctgacttcgagtctttctgactgaatacccctaattacctctgttcccagaggaccctcagctgtacacattgacacccaggtacatgcaggctggcatctctcctcatggtgtgcacatacaagacacctgctcagagatgtgtccattctcaagtatctgtgtaaagtaccaatattcagggacatacattctcaaggagtcaccttatactcgtgcatgcaacagacctgtaccttatccgctgacagtggctaagaacctgggttctgcagctggactccctggttgtaaagcctagagtcctcatctgcaaagtgggatggatgatgacaagaacatttatttctcaagatcctcgaagtgtgaataaagtcatatatgtggagcaagtgcctaacacagaccgccctgctcagtgttcagctgtcaatgtgtgatacacacatgtgcagacacggcctcggtgctatgtgcatatcatgtccaagcacacagggcctttctccttggctccaaaggcctcctgatcccatatctgggtctcttctccactggaggcatcctctcctcttcttcattcttggggaagccttccatgtaagtcctgctcctttccttccccaggagccagggatcccggatggaggatgggtctgcactcacaggcagctggaagctcccgggggcggagcaggcctggcctccgctcctacctctgccacacaggcctcagcacacaaggagagctgggcaaaacttgctatggagccgaatgtacggcacaggggcccgctgggcagggcagcatgatggtctgtatctcagattgtgtgggtggcccagggatgtgcccagggttgtctctgagttcttcccatctcaacatctctgctgcaccagaagcttctatggtggctggaccacattaactgctgaccaggagctcctcaccctaagatatttaatagcaacttaggatcctattagaatcctattctcccgctgtgccgtcaagacttggagctgagtcttttttttttttttttttttttttttttgagacagaatcttgctccatcgcctagactggagtgctgtggcatgatctcggctcactgaaatctccacctcccgggttcaagcgattctcatgcctcagcctcccaagtagctgggattacaggcatccgccaccacacctggctaatttttttgtatttttagtagagacacagttttaccatgttggccaggctggtcttgaactcctgacctcaagtgatctgcctgcctcggccttccaaagtgctacagggattacagccgtgagccaccacgcccagcgtttttttgtttttgtttttgtttttcagacagagtctcactctgtcacccaggctggagtgcaatggcatggtcttggctcactgcaacctccggctcccgggctcaagtgattctcatgcctcagcctccccagtagctgggattacaggcatgggccactacacctggctaatttttgtatttttagtagagacagggtttcactgtgttggccaggctggtctcaaattcctggcctcaagcaatccgtctgcctggatcccaaagtgctgggattacaggcttgagccactgcacccagctggggctgagacttttatcctcaccagcctgggcttgccatgtcatctctagcatgtgcagagtggggctgtgtggcttcaggtctcaggtccttcctgtgtcagactctgtttttgttttttggttttttttggccggggggaggtttgttctttttgtttctgagacagagtctcgctctgtcgccaggctggagtgcagtggcatgatctcagctcaccgcaacctctacctccaggttcaagcgattctcctgcctcagcctctcgagttacttgggactacaggcacacatcaccatgcccagctaatttttgtatttttagtagagacggggtttcaccatgttggctgggctggtctcgatctcttgaccttgtgatctgcccaccttggcctcccaaagtgttgggattacaggtgtgagccaccgcgcccggcccaggctctgttgatgccaggggagatgacagctgcagagaagagcctgccactaccttggctatgggcactccactgagcaaagatagacaggctcaaataccacctaggtgggcacaggttaacatgagcagaggcgcccaccccgactctatgcagacctccaggaaccctggcgtgagtcacactgttgggcctcttggaaagattccctgcgctgaccccacccatggctgctgacaggcctctgccaggtgccagcagctcagacgtcaattgtggcaaccagggctcctgaccaaagtcactggtgcaccactgaggagcaagcaaaacctgaacccctggatgtggctcagctccccagaagggctcaggcatcagctagtgagccccgtggggcttccaggctcccctccaatgcatgcagaggcaccgttttctttcccacaggatctgagagtgcagtggtagagaggaagtgtgctgggggaggtgtggacaagggtatgtggttggttttttttttaggtggggtctcgctctgtcacctagactggagtgcagtggtatgatcacggctcactgcagcctcaacctcccgtgcccaagccatcctctcacctcaggctcataagtagcagggaccacagacacataccaccacctagggtggttagcgtgggaagtgtcaggatgagacatgggaaccagaaccgtgcgctattaacatttttttttaagagatgggatctcactatgctgcccaggctggtctggaactcctgggctcaagcagtcctcccaccttgacctcccaaagtgctgggattacaggcatgagccacccccacctgaccgctactgacattagaacctgcacctgcgaagccatgtgagagcctcagctttcaagagcctcctgtaagtgactccaagttgggaattgtggtgacagctctttgggattcttgggggttacatcctggtaagcagaaatttggggagtgaccacatgcccagaatggcttggtgggctccgtccttccctcctgaggtctgtggcagcaggtgcctggttgacttttgttcctcagatttggctcacgatgggggaccttcaatcatgatccttagtgattgttaggggtggcatcagcaaggactgtctctgttcaaatgattgaaacccagctccagatacagtagtccccccaaccatctgcagttttgctttctatggtttcagctacctgaggttaaccgtggtccgaaaatattacagtattttgagagagaaaaaccacattcacataacttttattacagcatattgttataattgttctattttattaattattgttaatctcctgtgcctaacttgtaaatttctatttattattaaatttataaattatttatttatttagaggcagtcttgccctgtcaccgaggctccagtgcagtggcacaatcatagctcactgcagccttaaactcctgggctcgactgatcctcccacctcagcctcccaagtagataggactacaggtgtgtgctactacacacggctaattttaaaatttttggtagagatagggtctcactttgttgcctaggctggtcttgaactcctggccttaaatgtataagttaaacttcttcataggcatgtatgtataggaaaaaaatgtatatataagggcttggtaccatctgcagtttcaggcatccactgggggtctcggaatgtataccatgtggataagggggattaccgtaaggtaaacggtgcaggaagttcgttaactcattgcagctaggaagtctaatgggatggcttagctttagcacatctggaaccaggagcccaaatgatggaaatcaggactgagtcactttccatctcctttttatctttttccttttttttttttttttttttaagagaagggagtaggggtcttgctatgttgtccaggctgaactggcctcaagtgacccaccttagcctcccaagcagctgacattacaggcacaagccagcgcttctggctctctatctcttgactctgctgctgctttattgacttaattctcaggcttctcaccccatatgccccctgcaattcctgagttttgtgggactcaggttttagatcatcaaagcacccacgtttgctcctaaaaaagcccctgagtggctttgcttggaaccatcaacagtgtccagagagatgacagactaatcaggagatgagtggccagatgtgcccacatctgtggtaaaggaggcagggtcacatgacatgcagcccagggagacaggaaagccctgctctgtgacctccagccagcatctgtgggagaacagctgggactggtgcttcctggcagaggctgctggggttcctgagagtactcccccagaagctcaagaagggggaaaaacatcccaggcagagccccttgcaaagtccatgccctctggctgttttggggcctccatcagccacagcttctgagcaaccaaaccatggtggcctgggcatcagggaggatggtggtgctgctccaggcagccctctcagtgctccatgctgggttcagaatgtgcaagtggctgtgggcaagatgagggtgacccccagccaccttcaggcaaaaggcaggggaattgacatgcaagcctcagtaatattttcccaacctgaatcaggcagagggaacgaaggcaggtatccactccaggcccagggcaatgaggcagctgaaatgctccctgcatccattgctgctcctcccctcctctccccagggggacaggcctaggccctttgcctctgctggatgtctctgtaaagggtagacagggaaaggttgttgggcattctcatggagacagagccctgggactccttgactagctagtgaaggttgggcttttcctgggtcaagggaagtagacagtgaaaccccttccaccatgtcaacaaatgggtcctactggctttcctcccaatagccgaatgtggaaggaatggcgcctcttgtttatccaaatgtcagaacagccaaggtgcaagtagaggtcaggtgggggctccctaggggccaaagtccacctcctccagcctgaccttggccccagtgtgggcatcccttgcccactgtagctagctctcaagggtactgcatgccccaagcatggtctggacccttcctgagttcccataattacaagccacctggaagcagtctcatcacccagaagttgagtgagtacagatatctggtgctctaataaccactgagccccagaggccagggaaatgatgataaattttagtggtgtgtccagaagtctctgacctgccagcggctgctgcccagtccccaactagtgggttccagcacctgcctgtcaccacgagctgctcagtgacttcagctattcgctcctaagaggtacctacctttttctgtgatccagagaactatccagcctgccgatgatgcccacctgccctcttccagcctcagaccaatgtccccagcgtaggaggtctcaggggtagagagtttacctgagaattggtgtgggtttctcaccctggagattgcctgcctatcctggtcccacacaggcagcagagtgtaggggttagaggccagcctgcttaggctccaatcaaggctctgcagcccctcagtgccacagtgtctcattcacctatgtacgtgtttatgaaataaacgtggcagtaagtggcccgggcacggacagtctgagaagtgggcaatctgggagacacagggtttggagcaagagcaggaggtacaggaattggaccagtggcattgcttcaccagcagtgggggcatatccccagttcttcctgactctgatggcttgtgactcactggcccaggcttccttttttcaggtgtgtatgggttgtgtcataagagaaggttgtggtctccagggttggcagagcctaggggagggagatgggcacagggagcaagagggcctgaccgggggttctccggaagtgatcctgttacctctcttctctcaccccaggcagagagggacagaatctgtgggctgtccaggcagcccacagggccctggatcatggtgcttgagccagtagctcagaggtaacccctctccagataggaggacaccgagaccgtaaaagggcagtgacccaactgaggcccctgagccacataggcctggacctcaagagtccagactcctggtccagggcatttcatgggctttgcagagctgcaagcagagggttgtggaactccccagaaagggtaggagacagagggcattcaggactagactgctggctgtttgcaagcccagacctgtcatgtggggcggtggggacctagttgaagacctgggagatgagctggggttctaagtccttgaggtcttcccgcgactgtgcagtggtacctggcggttttcccctcctctccgttgttttcacagcagccatcacagagccttctctacctcccagtgctgagcccacctggaggcacccgagagcctcctcccaccaacgtgccttctagatccttgggcggccacttgccgcggtggatggtgacggggcctccagtgctgcccggggagaagccttgagctctccagacaggaaatggagaactgggccatgagcagaaaagagaatcagtaccaaatcacttttgggggcaaagaagtgtcagggaagaagggatgaggaggaagacaggaccgtgtgaagaggaccttctcggaagggaccaaaggcagttagtggagtcccaagacctggggtgctcagaggactttgcatgaatgaacaaataagatgaatgaggctttatcacgtggccatgatcgtcaagcatcagctgaggatgcagtgcccacttaccgcgactgaaacgtgaacacacttaaagggcagctgtgagtggcaccaatgcgaaggtaccgctgacccgcgatggggaaaaggcaaccgttgaccgttagagactgtctgtgaggcacttagcttgaaagctgagaaggcagccaagctccaggcaaaccagtcatcctaatgggtttcaaagaccataaatggtctctctgtatggccggagctcccttggcctttcctgcaagatgaattttcacacactggacatatcactatgtctatttcattttccatcagacatttgttagtgtggctcacagtttattggtcccacttctcgggaagtgtgctggtcgtttctgccttagaacagacgcaggctcctcgaggctggagctgggccaggcatttgctgggtccccaggccatctggctccatgctccgcttcttgtgcctctccttccatccttgtcctggcccccgagccacccctgccaccctgcagaatctcacagtcctgttctctcttgtcctccctgcaggctggtggttcgtgagcacttctgaggagcagggctgggtccctgccacctacctggaggcccagaatggtactcgggatgactccgacatcaacacctctaagactggagaaggtgagggcttgcaggtccaaggggcagggagcaacgcggcctctggaggcagctctctcactctttccctagaaccaacagaacccctaaagtgagctgagccatatcctagcctcctcccttgggatcccatctcagtaaggttggcccaaaagctcacctcccaccccagtccgacccctgctgctctgtctcaggggctcaggaactgagggatggctcagacccctacacagtcagcctctctgattagctttggcttcatgaggtttgtttttccacccacccccctttttcttatttttttttatttttgtatttttttctagagacaggctttcaccatgttggccaggctggtctcaaactcctgggctcaagcgatccacatgccttggcctcccaaagtgctggaattacaggtgtgggccaccgcacccagcccttcctttttttttttttctttttctttttttttttttaattccaaacacttaaaaactactcagtgaggtttttcagggtctttctccttgcatttcaaagagtctgcccctgccctctaagccagcactggcctgggcctatctgtggcttctgtactccctagagcaggctgcctgagcccagtccgtttgcgccacccccagttcttggctgcctgctcctaatggcttccaagcctcccatggcctggctgcgggaattctttccctaacggttggtggggatggtccagatggatgtctgaaagccagagggattgaggccaccacccggtgctcgggccacctccaggcctgctttctgctgccaggccaaagtaagcagccgccaagtgccagctccttattcattcttcccctaaatgtcggttactcggcgggcagctggggcttcgcccttcctcctatgtcgaggctttacttcagccccttgaccagagcctcggcccctgccatgtgcttccactgtgtgacaggtttccagggacaaggccccattgggaagggcccgcatgttcaggctgggctgctccctgagccctggggctgagcctgcacctgtcttccctctggttccattgcacctctgcagcaggggagagtcttggcccctgagctaggtctggtctcatatgcctgcagtccccagcctcacctcctacctagttccacattctttttgttgttgttgttgaaacagagtcttgctctgtctcctaggctgaagtgcagtggcacaatgtcagctcactgcaacctctgccacctgggctcaagcaattctcatgtctcagcctcctgagtagctgggattacaggcacctaccactacgcctggctaatttttgtttttagtagagacggggtctcgccatgttggtcaggctggtcttgaactcctggccccaagcaatctgccacctcagcctcccaaagtgctgggattacaggcatgagccacagtgcccagcccctagttccacattctatagggcatgccagggcctctcaaaaacagcaggagctcacaaagtaccagatgctagaccaggtcctgaaatgcccttgcccccaccctgggaggaccctgtggctatggccatccccatccttccagctgtggcaactgaggcttcaagatgtttatcaggtttggaccctagtccacctcctttgtcccttggtcctttctgctgtgccacacacctctctgtgaagcattttgctcgtaagcagtacaggcagctctagggcagtgcgtgtatgaatcagagccccagttgaaaaggctgcaccaggaaggtcagagcggagctgttgggtcgattatggaggacctaggcactgagtggggagaaggccagggcaggaaagcgcacgagaggtgtggagcacagatgccagcctggttggaacagaaggcaggtgctttgcgcacagaacaagtagtagtgggttgggcaggattttgaccttgatggaggaagaatcaggcagccagtgcagattctgcgttcagaggcggtgtgggtgtatgtgtgtggggggtgggtgtgggtgtgtgtgcgcgtgcatgcgtgcccagggcgattctcctaaaataggttcctgcgcacgcctctgacagggcctgtgtgccaattctcctggcaacttctggatagctgtggattccaccgtcacatcttgggcatttcccacccagatctacagaagggctcagggatgggtcccctgggcctaaggccccagctgctgtggtgtgtccgctagtctctctgcacctgcagccacatggccaagagattggccgacactagttccctctccagccatctctaccccagcgctatggccatcccatcataggtgccctgagccctgtagacagaaattggaagcctgcatcctatcaaagctttcctaatagctcatcttcattactttaggaagaaaagatgattggctgttctggtgtgtccttatcatgagacactttgatgtatgttcatgctgctcttgaacccaggtgtgctgtgggagttcagtatggtaggaagggtgggagttgagacttccttgtccactgacagaggtgcgggtccaagcctgacattcgcagggtgcttcagtgaaccaggagaggtgtgttacctctgtcaagccctcgggttcatttgtgatagagccaagaccagaacccaagtctctgcctttgctcctgtgtcccacatctaccagtatggacctgcttcctccagagtgggcgcatattgggacatgcggaacagaccacggtcttctgtgctgctgtaccaaaggcgtgtaccccattagtgagcagatcccccagcacccagaccctgttccctccccacatccccttcttcccagggcttggcagcccaaggggcagcagagttaggggaacagcaatagctcggggtgcagagtctgtgctaagagtctaggctttggagccagactgcctggattcacatgctgcctgacacagagtgttctttaaagccctgtgcctctgtctccccatttgtaagatgccaaccacatagggcttttgtgaggcccaagtgagatgatctttgtacatggtttaaactgggcctcgcacacagagtaaatgccgacatcaacaccttactgtgaaagctgcctctggtctggccatgagctgaaccccttcatctctgcagagaagccctacacacctcccccacctctccctgccccaccaggaggccttgcacaggacctgattcatgtttcccagagcccattcagccccttgtctaggctcatgccagggcaggtggtgtcactgtaagacagatgaggaaagagaggcttagagatgggtggctggcctcctagagtgacacaggttgctggcagtggggcctggactggagtccacacctcctacccttttgtccttataagaagcaggtcagacaggtccctcttcttccaggaaagcaaatgctttcccagggcctcggtggtctgggacggttttattttcactccagccactggcccctctcccacccccagacccgggcagcctggcaccttctttctgtggtggcaggaagtgaggccagctggcaccctggagccctggtccagtatccattccatctgggagtctcacaggaagacagaggcatctggagctggggtctgagcagagggtgcagggggctcagagccaagcagcagccaccagaggagcagtgcaggatgctgctcagggcacggggtcaggagcagtgagaagctggggagggggcccctgtcatcagatgtcccgatgggtggcctgagaggaggagcagagccagggcctctggcacccacccttgtgtcattccgttcagcaggtgcttcctgggacccagctgtgtgcccggccctgtgctaggccctgggaatgcagagacacagggaagggttcccagaatggcgagagctctcagccccgcaaggaagggatccaagtctctcttgggcacactgattcttccaagcatggtgcctgtccaaggtagcacgttcacagtcagtactcagtgagcgagtggacataagctcagatgttgcaggaccccacaccctcctgggaatcagcaccgcccagcagtgagggacactgatctcaccatccctggaggctgtagctgaggggctgtcttgcactgggctggagctagggaccctcttttctctaaggtgctgggattctaaaggctttagcccactcctaggctcaggggcacacgctgtggagtttggttgaatttttccctgtgtgccgaccatgacctgtcatatctgccccatccaacaggggcgtgccctttggttcagtccaggtgatggtgactggaagtgtgggcctcccctccctgtgccccttcctcccacccccatcccatctcatcctcatctccattctctccgccggttgctgttggccgcatgctccatcgccatctcccacaccagtgtccaagagacgcaaggcccatctgcggcgcctggatcgccggtggaccctgggcgggatggtcaacaggcagcacagccgaggtgactgcgggagctggcttctcctccctcgcagcgaccgcctgtctctcgctaacactgctctttctttccgggctctgctctctgccctgtggcctccttgttcacccagattcacgggccaggctttcttctcacctactgcagctggtgtggggtgggcctgcttgggaatcagggtggcactgggggtggctctggctttgtcaacctcctgggtatgagggtcatggaacacagttgtgggttccctgaaaaggtacaggggcttgaggagggggacaagggggtttcgggtctttaagaaaggccacattggccctggaagctgcagattaaaggagctaagcgtgtctagccctctgctggggccatcccactcccccatcctccatggcccctgtcctctgagaaaatgctccctcggccaaagttgttctatcagtttcttgggaacaaagcagaaagaaggactggctcacattcacgctcctcctgccagctccacggaaactagaaagggagcaaagccagacccagcctggcatcagggtgcagcccaacaggctctgctgagggtcaggtccagccaggagcagtaactgctggggcttcaggaggggcctgatccaggggagtccagggagccccccaggcccagcacatgggctgatcagatgtttgtgggtttagagctttctcgcccaggatctttctagcatccaggaacctgggaggtaagggagtggaacaaagccccagggctgggctgctgaacaaacccttaaacatctgcagtcccctgggccagggcttggccagccccgcatggagcagggtgtgtgtgcttctcacagtgacggcacagagagaggtgtatcataaacactggcctttctggaagcggggacacccagtgacccccaccctcacagcttggttctaaatgactgtaagagcatgttttggtgtctgccccaggcccaaagcagcaggaagcctggacacaggtggctacagcctatggctggctcagcatcaggcacagagcactggccatgagaagtccagcttgtcctgagggcacagcctgggctggaccctgtgggctgacacagggctgggggtcaagttgtagaaacagcaagaacaggctggacatagagcaatggccaccctaaagctgggacgcagctcaagccttggcggcaaaggagagtgggacgtaagtctggaaatgcatggcacggatgaaggtttggctccaaacacccttgcacactgagccccaaacacgaccatctccacaaccccacagacatgcacagccctcatggccacagatacgactgtgcgccctgtcacatccagcctccctgacacccacatatccacagtcccaggcacacagccactcacaatacacatacacaattccaattatgcagccacgcatacaccgtgccatgtgtcttctgtttataccaccacaaatgcatcatacacagtcacaaaatcatcacacacacacatatacgcaacatacacacatacgccacccattcctccacagcaacactcacaagggcacatacagcttcatacacacaacgccttgcaccacatatatgccagtcacagacatacagtgatatgtggagacacaaatacgcaatgaaatgcctaattcttggtcacccatacctaagcaaatataagcccccagctcttgctctctctctctctctctcttaaataagagacctaaacaacataatgtcccagcctcagcctgatgggctaagttaaaccaggcagccaagaaaaacttgcagagagttggcttggagacgcttgctgcaaacagcagagctggtcggggaggcaggctgcaggttgtggaggagctagacaagagaaaagcggagcttccccacggcctccgctccccgttccctcagccagccaggcccttggaaccaaaaggcctctctcagtggggttgggtaagtcgtgggggcaggaagggagtggggagactgctgacagaggggaaagtgttggggaagaggaggcttctgtggtttggaaactacaggacatccagcccctgcctccaaaaccaaagcaggcctatccccctcacccacccggctgaccgcctggccagccctccccagggcaggctgccaccgtctcctggtggcgtggtcagtgttcacggccccagtgcttcccagaagcccggaggatcccactggagctcacagcctcccttccctcaaccccatttccgacgggacatctcttcccaagaccctgaccaccctgaatcatgcagctgcccgctgaggccatgtccgtctgtctgggcctcctcttgtctggcgcccccagatggggtttgtggcccaggcaagtctctcttccttgggacacctgtgagttggaaggcctgagacccacaaggcctgtgtccacatggaaagtccatgcctctgccatctgagccaactgggtggaaacccaggagctgggacggcctggtctgcctgcctagccctgccagggaggagggctctgggttctcatccctgcaacctgtgcagtgaccggggcaggacgagcctcccatccaggagctctcaccagcagcacgtgaactcctggacatctgtggttgctgcagccccagagtccccaagaaccttttgcaggagcagctcaactttaccggccagaactgatatccctggttctgcccccacccccaagaggtcaggagaaagcctgagcttacatggcccacgggattctgtcttccacgcaccccgggaggctgcgaaggctggggctgggccctagtggcccaggaggctgagcccacatgatgggctagaccttgttctctgccatgaagcagggcagggctcctctgatcttcccacgagaagggctgtcatttttccctgcaaatgcaaccttgcctaggaaaaccttaatgatggcttcctgctcgaaccacagacttttaaaaatagcccagctgaacaaaggcaaaatgtggagcccaggcctcgcctcatcctaacctcagaatcctggattcccggagcctggcgctgcccctctggccgccgctgagctgggatttgccatgcctcactggaaaatggagcagaaccaggagcaggcaggagagcagagagagttggactgtggagccctgaacttctcaaagggccgagtcagaatctggctgggcagggttctcaggccgccttggcagcagtctgaagcatggctgggttggaatctgaaagcctccagagtaaggccctccctgagtcgatgctgaccaagttctgcagcagagaagggcgtactgaaaaatcctgcaggctcccatgggtcatcaccctccttctgcttttgggcagccgtttgaatttggctagtagcccatcagttctgtcttcacagcctggcagggcagccacaaccacccccaaagggagctgctatctcggctcagcacagggctgcagacagggccccgataatccaggggagagtggacagatggccctcccacagctgggggttggggtggcagctgcctcccacccccacggccaccagtcttaggcaggctgcccgccagcatccagccaaggagcccagggggtggctgtcacagctgggagccaggaggggtgggtgtcccagagaccagaggccagcagtctgctccagcatcccgctgttttgagctcacagcacttcccatcggtacccttgctcagccttgcctggtcgtgatgcagtcaacagtgtctcgctgtctgccaggcactgtctcagcccctggggagcacccacgccagagaggacaacagtggctcagggtgacccttcagaagggcatggccagattgccacttcctcctcctgtctcagctcctgttgccccagaaggtgaggtggggagtgttccactctgagcagccctctacggagtgtctcaggcaggaggcaaggactctttagccagccagctaggagcagagccagggagtactcagctctggggtctacctatcaggggcttcctgggacagggaaagctgaaccccagcaggcatggaagaaacaccctcctggaagcctgatcaaggacccaagcgggtggcacccaggcctcctgccaggagagaggctgaaagaaaccaggggaggcaccatggtgccccactctccccacacctgccctcccaagccttcctgagagtctacaaggcacttctttcccagcacctcgggaggaccttgggcaagaccctgaagtgacatccttgaaaacagagcaggctgccctccagaggggctaggcctcggctgcgtggttggcacagcatgttctgcagaagccacttgggccagtgctgcctgattgtgctgtgcttggtgtttccaagctcatttggccatcgaacccttgtcttaacaaaacacatgtaactgcttccatgagacctgggttccatggactcctcttgggagattacatgaccaggtgttaatggatgaagtgggtgctcagggaaggcttcaccgaggaggtgtccctagaacctctgaaggtcagacagaggaaggatgcaagaggctgagctgggggcagggataggagagttcatctgggacacagatggaaacagggcacatttcgaggaaaagcggtatgccgtggggcctcaaggcatgcaaggacacctcatgaggggccggcttctcctaatcctgccctcggcccagcaagcttctgagccctgtggactccaaggtcccggcagcctggccgccattatcaggctgggagagccgactccctgctcccagggccttgcctgacaacctgggtcctggctggctttggcacacactgggagcagcagtgacctctgctcccatggtctccctgctgccacctctggggcctggtccttccctcccctggagaagccagagccaacccagtggaccttcttggcaagcagttgagcaaaagccaggccagggcaggaggaggggacaggaagcaggacctgcaccccgacctcaaataatcttgcttgcttgctcccacccccagaggagaagtatgtcaccgtgcagccttacaccagccaaagcaaggacgagattggctttgagaagggcgtcacagtggaggtgatccggaagaatctggaaggctggtggtatatcaggtagggaacccttacattatgaacgagatgcctctcgcccacctgggccctgggcagagtgcaaagtggccatggccacctgatggcaggtagatactgacagctttgtgcccacggcacagggctgggctgctgcacctctgcacagctgaatagctcaaccagagaatgctcatcttgcaagttttctcccgggacgcgtaaagcagagcttgagccacagccagcggggcacagaggccccgggtcagcttgcaggctgtggtgcaatcccttcccacgtatctgccaagagagctcagcacatctgaatttggttttgtgtgtccggccttggctgcctggtgtgctccacagctagggctgcctggagcactggcgtccgcaggccttgctgaggtcccagcaggcaacctctgctgcccaggctcagtactcagggaggtgggctgggggcgggggcgggtgcaggtgcaggcctcttgcagccacgtccctggtggatggggactggctgtccaatctgcagggctggctgcaagggctggagcagaagtcaggcctcggctcaggccatcggaggcttcttccttctcttgcccctccctctcccaggcctaatcacagttcccagcgtagaatcctattgaatggtatgggtagggaagtggggtctttcctgacctgctggaggcaaacaatcccgtgggtttcactcaccattacctggccaagacctacccttccaggacccctgctctcaagaaatgctccaggagacttgatctcagtaagtgcttttggtgtccttggaactggctcagctgtgatgactttgcccaccttctctcttctctgccagttacccagctgacagggatagtcctatatccttgggctctggggaccccagatccactgtgggcaggacatgcattctaggtggtctccgacagaggggacaggattgtgcagtggcaccaatgtgccccaggggatgtgagtactcgtgggacagttgctcagaacatggtacaacatgatggcattaaaggctagtccatgctgaggtcactggccatatggagattgcaccttagtctgacctgatggaacatggctccatggcacgcaccacaccccccgcccctaccccgcccccaccccgccccaccccggagccctggtgcatatcagtcaggagggctgagatgtccctttctgtcccattgggtgggatgggactgtgcatctggatgtgtattgtccaaagccagtgcccctagacttttatgttctctgagcaatggaaactagagtcaacccaatcacccaccagccatgagttgaacatgggaaagccaggaaacattctggcaggctggtggcctagctcacttgcctggagcttatctacaaggctgctttattattatttttttgttttctaaaatgaccaacaaagtcactctgagctgcttctagtccgctcctatccccatggcctagtcttacagccagcaggagcttggactgagaaaacccggctgaaaagattccaccttaaaaaggctgccagacacccccttaaatatgccatttcccaacattccaggctctacgttgatcctcatttcctgtctttcttctcctcccccaacccctacacacacacacacacacacacacacacacacacacacacacacacaccctcgcactctccatcgcgccctttccagcttgcttcccgctggagtcatttcattctccattgctggaaagcagatgtgagcagagctggacccagacacacacaggcactcctgattcccttgcgtttctcctcctggaatcttaattttacccatgtagtgctgaaggaacacaaatacagcactcggggccctaagcaggcctgaccgtcacctccatgagccccctctccccatagctctacagtgtccatgtagaaaaatcgtcagtgagggccagtgggctcatctttgtcttttctctgagatgcaagagcaccaggctctgggccagatgctgctaagcgctcactgtgtgacccccttgcttttctgagccgtagttgttggctcacataagattaggtatttttactcgttgcttccatccacccttaaaattctgtgcttctgtttgcacccattgcatcagggagccaaagacaggcccctgactcccacccacgtgttaactcacctctgcctcccaatccctggggaggcgagcttggctcagcctgcctgcatgtttctgtgacagaacgtaaggagccacctcctacctgagctttctcgcaaagctcagacatgttgataggaacttcagctttcatattccttttctcccacctaatgagcgcccaagaacaaggtcagatcaggaagacggtgggcggggcggggggggaggtgttcagacatctggtgtggaggagccattccaaagagccagatgtgtccagggagcagatggggacattgcaacccagacttgggggcactggccagcgactactggaccaggaagtgaagtccccatgggtttgggtgaaaactcaacaccacgaggaaaaaaggaaaagcttgttttcagaagtcatcgaatcaccagaaattaagtcagccctatcatttgccttttgcctttgtttatgagcttttggttttgtttccttttgttttgttttgtttttgttttgctttggttttagttttatctagtcatgtgcttttgtcttttcacttatggtttctgcttttggagccccacttagattttctcaacccccaacattatgtcaatcttctatttgttaattctgctatatggtataaagccagtgtctgtcttacttgtttttcctaactgggtcatcagttttccccaaatcactttttacatttttggaggcagggtctcactctgtctcccagagtggagtgcagtggtatgatcatagctcactgcagcttcaaacttctgggctcaagcaatcctcccacctcagcctcccaagcacctgggactacaggtatgcaccatcacacccagctaattaaaaaaaaaaaaaatttttttttggtagagatgagatcttgctatgtagcccaggctggccttaaacgatcctcctgcctcagcttcccaaagtgctgtaatgacaggtgtaagccacctcgcccagccccaaatcacttattgaataatgcatctttgttccactacagtaaatttagcctggtttgtgaacttggtctgtgacagtctatagaggatccacctactctccctgcagtggcaccacagctgtcccattcagtcatctggcatggaggagccattccagctaagatgttggagacagcttagttgatctcaacatgtctgtccttctgggtacatttttagcagcgactctatccctgcatcttgcaaaagagacacaaactgagctccagggaagggacttgtgcaaggtaccacagactagaactcagactgcctgactctcaccttctggagtcaattccctctctaataatacctccccttcctacaggccatttacctctacataccacatccacaccttcttcttatctctctaattatcctcaactgactgggaagtagcaggccattatgaagtcctcctttgggcaacccaaaagttgataaatctgatcccaagctcccacatttgcctgactttgcagaacatgagagcccaccccaagagggatcaggcaaagaaaaaggagcatggtgggggggcagtgggaattggtgttctgggtgtcttttccatctaccctcggtgccatttctctccagagtagtgggattgccaagccttgcagaacatggtagggaaggctccactgggcaaggccagatggatcctagggcctgggagtgggctgtgaggtcagagtgctctaatgatagcacatcctgctcctccccacagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagtaagagcctcgctgacctctaggtcctcactgcaaagctccttagagaatgggcatgggtgccgtgaaagccaggggggtgcacaggacccccatggcgttttcctcctgggctacagactggcctttgaccctcactctgtcaacttgtgtcatgctcatcacaggagtggagaaggcagaggagtatgatgactcaactgctcccagctgctccacggaagctagatcacatgaggatgtgggtggtagcgttccctcctctagtggagagccagcaatggtcactctgcagatacacgcgttccaagagcaagaaatgttttcttttccttatggtaaaggctttataaatcaagatagatgatgtgtagctgacttttaaaaaatcaaaaaaacacatttccctgggctgttgaatgtgggtgctatatgcagggctgccctatggagtgacagtctgtagagaaacgtctttctgggccttagcagctccttccctatgactttccactcgttactggaaacctaagagacttgggagctaaggctttaccactctacacaggcagtttcaacagggcgttcttcaagaatcatcttcatttctacaggagactccaggcagtctggcaccctccatctctggcccaataatgccttttgttgaggcttaaaacttccatgttataggaacctagcttttgtttgtgtccagccattcttaaaatctggaggaaagctgtttctttagtttagctccactgggttaagttagctctcgtgcctgaaatcttttagggaaccagctgggaaacagttattgggcacctcctcttgcctggcattatgctagcttctatggatttaatagtaagcaaaaaacagacatggtctctgctcctaactttgaaaacctgataaatctatacacccgttaccctgaaaaatgcccacatagctgcacattttgaaaagtgcacataattttagagtgttcatagatcccctggaagcacagccaaggtaaaggtctatagtttccccttgaaaaagcccaaccacagtgcccatagtgacttagagtgtcaagtccttcataaaggctgagctaaagcatgaacttgaaggatcaggagttagtttcacctagggaaggcaggtatgggtactgttgcccatcgtctgactaggatttctgaagccatgtctcttcctctaggctccccgaacctacggacaagacctccaccacgcagagaatccagcctggtatgtgtactgaatttcttctcccctttccttccttttctgtgaatgcgctatagccacccgatcaattggctatcttgcggcagagcctcttgatccaggggttttccagagccctgctggggcttctagttttgtggggctaggggcagggagggaagcctgcagatcccagccttcctggaggcctggctggacagtttataatcggaaacacactgcactccaaagctaaataaatccatcccagccactgcattggcagacataaacatttagactgcccggcaaaagtgtccagccagggcattgccagaggctggaaatggggctcctgtccatgctagcctggaagcctttcagctttccctggtcaggaatgcccagtggaggtggtggatggcagagtctgggagggcagagggcagatcagtgaacgtcttccagggaggagtgtgagttgcaaggagtggctcacgccccagctttaagaggttaacactgccagggtccctggttcatgtgggtggggtttcctggtgtccagaccctcgggcaggtagatacgcatcaggggccagggcttggggtgcctgcgatgctggtggcaggctgagagccttggaacaaagaactgttagtaagcgcagtgggatgtagtggaaagagtgtgtcttcaagtgccaggcatggattcggattccacttctgacacttagaggcggagagactgtaggtaagccagttgccctctacaagcttcagtgcccttatttatcagacgggacagtactagccatctcttagggctgttgtaaggatgaaatgagatgatttatgtggggggctagcaaacaggtttccatttcctatgtcagctcttgcctgcttggtaatactacctggtgcactgggttaaggaggattctgaagtcacatctgggcttagcaacaagagttactgtggtcagtgacatcagccctggctaagggagatggcaccagtctatggaagagtaggccctccataaaaatatggtttttaaagatttcatccctggagatgagaccttccttgccttggccatggaccccagtggagtttctctttttcctcctgagttttacacacccaaacactgaattctccctctcaaccatctctcctagccacggctaattattttcaggcagacttgattttggcaagaatggggtaattccttccacacttaccaaatgtggggattgctgaggcagggctgctgtttccagttaggcccagctgcatcccacctggccagagatgtggcctgggctgagcctgggctgtgtctgctcacatgcacggctgcacagccaggccctggggccaggaaaggtggcagattctcactcaatccctcaaaaccagcttcctcccacccctcactcactctgcctcagctcagtttcaactggtggggttaggacatgcagagccttgaaggatgaggaaggctgggaagaagagaagttcagaaggagtgctgagttccagcttctatttattgagctctccctatgcccctcgctgggcccaaagtgatgtatgttatctcagggatcctcttcaggatgctggtattagttccattttacagatgagagaactgaagttcagagacgtcaagggctttgcccagggccacacagctggtaaattgctatgattggagtccagccccaaggttgaggtctttccaggtcttcctgctacaccaagcttcttcccgtcccctcatccctcccacctttttttcccaattgctttatttgaacccctttgcatgagggaggacataaatagcggggtacaaagtccattttagctgagtagagacaagaccattgaagcaaaaatatacaatccacaagggcagggggttgtccatttggtttcctactgggcgctcggtgccttagaccagtgtctggcacccagtagacacacaacaaacagttgttaaatgaatgggtgaggctcacaaaccatgggccaaagccagcttctaaatgtccttgaatgtcatgcttagatgctgctgtgccagtttctgaaaagcattgaggatctccaatgagttctaccctgcccacagaatattgcgagtttatttagtgcttgcctgcctatctggccttgtcatgatgaccagccaaagactttgctcactcaaccgcactgccttcttacacacacaccccagactagagaccactgtgctccattgccttgcctgtgctgtcagaagtcccacctgcagccctcacccctagactccaggacagtggctttccttcctctcccacagggcagtgtgcaagtgctttgttagaatgatttctctgctttttctttctttctttttttttttttttttcagagacagagtctcactctgtcagttgggctggagtgcagtggtctgttcatagctcactgcagcctcgaactcctgggctcacgctattttcctgcctcagactcccaagtagctgggaccacaggtgcataacaccatgtccacctaatttttgtgtgtgtgtgtgtatgtgtgtgtggtagaaatggggtctcactatttgcccaggctgatctcaaactcctggcctcaagcagtcctcccacctgggcttcccaaagcactacgattacaggagatttctctgctttttaattttcattttgagattcagctattgaggcatctgaaaactagacctccagagatgtaagattagaaattactgcattaataatgagcattttgtgctgggcacagtggcttatgcctgtaattccagcactttgggaggctgaggcaggaggattgcttgagcccaggagtttgagaccaggcaaaaccctgtctctagtttttttctcttttttttttttttttaaagaatagaataatttaattaaaatgtgcaatattttgatgaagaaaaatcacaaaaatgaattgaaggcctggcagaatggaaataaggtacatttatggatgagaagactcggtattattcaattttatccctaatctgtaaattcgatgaaattctaatttaaatcccaacacaatttttcttttttttttttttttttttcttgacatggaatggtgtctttatttttgggggctgctgtaacaaagtaccacacactgggtggcttaacagcagaaacgtgttgtctcccagttctaggggcgaggagatcagggtgccgacagggcctcgttccctgggaaggcgtgggaggaggacctgttccccgcctctctcccggcttccgggactccggaagcctgactccaggcttcacgtggtgttctccctgctggtgggtctgcctctgtcctgtgttcttttttttttttttttttttaaattgatcattcttgggtgtttctcgcagagggggatttggcagggtcataggacaatagtggagggaaggtcagcagacaaacaagtgaacaaaggtctctggtttttctaggcagaggaccccgaggccttccgcagtgtttgtgtccctgggtacttgagattagggagtggtgatgactcttaacgagcatgctgccttcaagcatctgtttaacaaagcacatcttgcaccgacctcaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacgcggcaaccatccgatttctcaatcttttccccacctttcccccctttctattccacaaaaccgccattgtcatcatggcccgttctcaatgagctgttgggtacacctcccagacggggtggtggccgggcagaggggctcctcactgcccagtaggggcggccgggcagaggcgcccctcacctcccggacggggcggctggccgggcagggggctgacccccccacctccctcccggacggggcggctggccgggcagaggggctcctcacctcccagtaggggcggctgggcagaggcgcccctcacctcccggacagggcggctggcctggcgggggctgacccccacctccctcccggacggggtggctgctgggcggagacgctcctcacttcccagacggggcagctgccggtcggaggggctcctcacttctcagacggggcggctgccgggcggaggggctcctcacttctcagacggggcggttgccaggcggagagtctcctcacttcccagacggggcggctgggcagagaggctcctcacctcccagacggggtcgcggccggggagaggcgctcctcacatcccagacggggcggcagggcagaggcactccccacatctcagacgatgggcggctgggcagagacgctcctcacttcctagatgggatggcggccgggaagaggcgctcctcacttcctagatgggatggcggccgggcagagacgctcctcactttccagactgagcagccaggcagaggggctcctcacatcccagacgatgggcggccaggcagagacgctcctcacttcccagacggggtggcggccgggcagaggctgcactctccgcactttgggaggccaaggcaggcggctgggaggtggaggttgtagggagccgagatcacgccgctgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaacacgaaaaccagtcaggcatggcggcgcgcgcctgcaatcgcaggcactcggcaggctgaggcaggagaatcaggcagggaggttgcagtgagcagagatggcagcagtacagtccagcttcggctcggcatccgagggagaccgtggaaagagagggagagggagaccgtggggagagggagagggaaggggagggggagggggagagctttttttttttttttttttttttttttagcaaattcttccagatcctgagagagcccatctctaccaaaaaaaaaaaaaaaaattaaccaggtgtggtggtgtgtgcctgtagtcccagctactggggaggctgaagtgggaggatcacttgagcccaggagatggaggctgcagtgagctctgattactccactgcactctagcctgggtcccaaagcaagaccctatctcagagtaatgatgatgatgatgatgatgatgatgatgatgatgatgatgatagtaatagtaatgtgagaattttgatagctcagacaagtcttccgtgagtcctgagtattattagaaagcctcatcagagtagtcccctggcgatatataccctgagactcccatgatagatacgtactcaggccagctgctgtccagctggtgtaaacggccatccgcaccccctggggactgagtggggaccaacccttggccaagttactcttctgatttaggcgggttttgcccactgtgtgttccttaaccttaggggttccaactgccaaagccaccagagcccccttctgttgaggtggagtactacaccattgccgaattccagtcgtgcatttccgatggcatcagctttcggggtggacagaaggcagaggtaagccttgggccatgaggccgagggttttaactcattgtggtggaaaacctactgcatttcccattttaggccttgctagtaagattcctgaggggcaggcaggcaggaaaggtacagaaatgagccccacaaagatgagcatctgcctggcgctggccagtgccatggcctaaactagatcccagctctcacgctccaccctgagctcacagggcttgtctcacaacatttcccagagcatgtgcaggagcttgtgacaggggggccttgaaacaaagggcttctttggtcaaatgagcttgcaggacagtggattaaacaaaatccaacccatttgttgttttaattgcagggcttcccagagcctaggatacaaggatgtcactgggagtgtcacctacaaggggtctagaatagacagcattgcccaaccccacaagctttctctcccaggaacatctcagggccaggatcctgcagaagccacatcaggaagtgttgttaggaggatgtggaccaggcaggtagactgagatactggggacctgggctctggccaagtccacaccacatgacccctggcctttgatgcagtcacttctctcacccgccacccccaactttaagcatttctctctgcaaaacagggtgatagatcctgggacgcccctccaccccccagcatgtcttccagcattcatgccactctattttgtggctggggctgagcatggtattcccggcagcagagaagagctgtaacttagtcaattctctgagtggctttgtgtagtaattgagttaactccatctaatacaagtgaacctgtcagactcattgggcagtctctgcctctaaagcagtgacattcccaatgtgaatgttttaaatcacatgcctggaacttgcaactaaatttccaagaaaaatcattctctctgtactgaggtttccaggagagtctgtaaagagcataatgtggcagaactgtcaggctcaggagccacctgtgcttgaactgtaggtacagggctggggcagggtgaaggacagaatgtaggacccaaagaaggagaaaatctttctcttctagtgggggatgcagaggactggtctcttcttgcctttgcattcttcacctttccctccctccttggccctcttcccatagtgccagtgttttcacgctaccccttccccaccccaggaccttttcctccaggagtgtcccacaatccccagttatctgccctttatgttccccagtccaaatggaccccagcacaaccagcagccacacttttggccattggttgatctccagaagttaaggaagaagctccttaaaccagtttatactaacatggaaatgactgaaagccccctgcccttcctacaggaaaccaatcaacccaaagaaatctcttcagctagtgggatttcagtgggattccagtaagatgaccacagcgggtggatcctggggaaaggctctgcagagaggctctggcctcgggcctgtacctcccaggtcacttcatctgcatcttcccatactcttctgaccctagagaccctttcaaggaactcaaagggaggacctagcaacatcgagggtacgaggagggaaggggcagcagaagggcagtgttttcttcatacgtgtccttagtctactggcaggattgtagggactgggaacagtgcagtttagggggaggcagagtgggccagctcaacccggctgttaacacagacatggaggatcagggagggaacttggcaagtgggaacccaccaaccatgagatgatagagacctaggtttgaattctggtgcattatttactatattgggttttgggccacttactcagtggctcggtttattatctgtaaaatggagataatttatcccagagccaaagtatgatactcctaccttgggatgtcatagggttccagatcctcccaactcactggcttgtctgcactcgtaccccaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 37875 - DNA, 1662 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttga

SEQ ID NO: 37876 - DNA, 23809 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgaccttggcggggacggtgctacccggccgccgagacgggttcctctgcgccctcagtcgggcccaggcgcggccccgcggcgtccctgggggccggcggggagccgggaccctcgggactgtccctgacgggcgggctggggtgggagtccgcgcgctccgaagcgtcggcgagaaaagcagaaaacagctccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcacccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagctgagatgcactctctttgaatccaaacgttcaggaacgtaaggcgaagaggcctaagagggcgttggctggctctgtctctcaggctggagcacagtggcgcgatctcggctcactacaacttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgcccatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaatttctttttctttcttttttttttttttttgagacacactccctctatcgctcaggctggagtgcagtggtgcgatctcggttcactgccacctccgcctctcatgttgaagcaattctcctgtctcagcctccctcccaagtagctgggattgccagtgcccatcaccacacctggcttttttttttttttttgtatttttagtagagacgggctttcaccatgttagccaggctggttttcgaactcctgatctcaagtgatccgcctcagcctcccaaagtggtaggattacaggcatgagccaccgcgcggtggaggggtaattttcttaaatctggtaatgagttgtggttgtgtagagtaacataccgtcctttcgagatatggactgaaacattgagagggaggagttacaggtatgtcgattcttcttttctctctctcctttttttttttgaggtggagtctgactctctcacccaggctggagtgcagtggcaagatctcagctcactgcaactccgcttcctgtgttcaagccattctcctgcctcagtctctcaactagctgcgattacaggcatgtgcctccacactcagctaatttttttatttttagtagagattttttgtctctcctaaaaaaatccaatgtaaaaaaatcccaatgtgggggttttgccacgttggccaggctggtctcgaactcctgacctcgtgatccgcccacctcggcctcccaaagcgctgggattacaggtatgagccactgcgcccagtctgctgcctcttttcaatggtctggcctaaggaaattattggaaacatgtgcggttgagtgatatttactgggcacttccacatggtccatgtaaagggagatggttggggtgacaggcagttgagtctaggggaggcatgtacagatgtgctgtgcctctgggatatcagggtggcaggcagcagtctctacgtctggtcccaggctgcctgagaaagagcatgtgggaggcaaaccttgcgccctggcatggttgttaatgtttatatttaccctagcttgtgtggggtaggaggtttagggatcaaattccactctgtgtttagacatttttttctttctttttttttttgagacagtttcactctgtcacccaggctggaatgccgtggcacaatctcagctcactgcaacctcacctcccaggttcaagcaatgttcctgcctcagcctccggagtagctgggattagaggcatgcaccaccatgcctggctaatttttgtatttttagtagagacctcaaatgatctgcccgcctcgcctcccaaagtgttgggattacaggtgtgagtcactgtgcccagccatgtgtttagacttttaactaatctcttttttagtttcaagccttatcgtccgcctctgtagaccactcctgtgcctgtttcctgatccttccaagggccattgtattccctgtctgctgcccctcttttggattcttctgcacatttttttgttcatgcattcattcatttattgtttgattaatgacagggtcttgctttgtctcccaggctggtgtgcagtggtgcgaccacggctcacggcagcctcagccacccagatgtaagcgatctggttcccacctcagcctcccgagtagtaagtagctgggaccacaggcggtgcccaggtttttttttttttttttttttttttcgttggtagagacagggtctcactgttgccaggactgctctgaaactcctggtttcaagtgatccccttgcctcctcccacttaggccttccaaatgctgggattacaaggcatgagtcacctccaggcctttttgtacttttaaaactctgcatcagtgtataaacaatgttattaaagtttatatgacttcagttacactacatggatcctttttcactcacggttgtgagatttatttctgttgctacatccagttctagtccatttgtgttaagtgcccagtgtgtttatctactgagggacagttatgttatttcgtgttcactattatcccatgctacaataaatatcctgtgtctcccagatacttagaagagtttctgcagggcacatgtgggagagtttgtttctgggtcatgaggtgtgttcatcttccatcttgctagatgctggcaaagggttctccagtgtggttgcatcaatttactcgcccagcagtgtgcagagttcctgttcctcacatttaccaacactagatagtaccagactttgatttttgccaatctgatgggtttgaagtggtacccctgttttaatttcatgaccagaaattcaaatttaatctttgctgtaggacaacagtaacccacttatgcctagtgttccattattagaacgctaagcatgtgggagtttttacatcatactgctcaaggtcatcgccaaggtctgatgtttttactcgtgcaaaaatttaaaaaattgcaacctctggcataaatgggttgagtgacacttttcctgtttttattgttggtcagtgatggcatatttgctgggtttttttgttttttttttgaaacggagtctcactgtgtcgccaggctggagtgcagtggtgtaatctcggctcactgtaacctccgcctcccgggttcaagtgattctcctgcctcagccccctgagtagctgggattacaggcgtgtgccaccacgcccagctaatttttgtatttttagtagagacgggatgtcactatgtttgtcgggctggtgttgaactcctgagctcatgatctgcctgtcttggcttccctaagtgctgagattacaggcctgagccaccgctagcctatttattttttattttaaattttaattttctatatagagacgaggtcactatcctgcccaggctggtcttaatctcctgggttcagtcaatcttcccaccttggcctcccgaagtgtcagaattatagatgtgagccactgtgctcagcccagaactgatgttttctaaatgctgggtgctgagaaggatgtgtggctggcagtcttgactgtgttatctgtctttaccaggccagtaacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcctggcttgcgcaagtcccaggagggcggtgccagccacaggcttttcccattcgagggttggaagcgtatcatcaaaccacatcagagtgctgggggccacctgccacccattcccaacccactcagccttcctggtgtttgggacatgctttgctttggcagtcaagacagcagaacaaatcaacttttaaggccttgtcactgatagtacaatttccattatttttcatccaaattaggatacttctgaaaatagaaatgatgactctgggatgcaaacgttggctgtcctatgtataaggagatggcttttcacgctcccagtgactgaggaagtttctcccagatggcgctgctctgagcctggtgcagggtaggcactttcaaaagagtgtctccttgtatcttccatcagccttgcgagatgggtatctgttcccagggccccaagggaggaaaacaggacctagctggatccaagagctaggcctttctttttttttttttttttgagatggagtctgactctgtcgcccaggctggagtgcagtggcgtgatctcggctcactgcaaactccgcctcccgggttcacgccattctcctgcctcagcctcccgagtagctgggactacaggcgcctgccaccatgcctggctatttttttgtatttttagtagaaacggggtttcaccgtgttatccaggatggtctcgatctcctgacctcgtgattcgcccacctcagcctcccaaagtactgggattacaggcgtgagccagcatgcccggcccagagctaggcctttctgtggctggccttcgcgtcagcctcaactaccctggtgtaatctcgcctgcggttgaattagggaaccgccgtgttctgcaagctggagaggcagaacactaatgagcagaacactaatctcattgcaatctcaaaggatctctaaaagcttttataaagcaggcccaaggtcctttggtatccgatgcagacgtggtgaatgcattggctctgtcagcatctgagcaagtcagtaacagaaatggggagtaaaagctttcagaactttccagaatattgactaaattgtcttgtttacaaccaacaacgacaacaaaaaataactgctgagggccttcgtagtgtctgctgtttcaagtgtacagtagtcattttgtctgcaggatgtggggttgctgtggctgaccttgtacaatattccactcataggtgtcttcaggcctatggagagcagcttgcgtgggctgggcctgcagtacctggtttgcatagatgattggcaggtgggcagcacggggaaggacctgtgagtggccaacctggttcaggtgagggaggtggagtggggcttctctgcttcccctggttccctggaagcctccaaggctggtgagcatcactgctgcctctgcacacctgtgtgctgggtgggttttctgacaggttttcagttgcttcggggctacagctgcagggagcctgctccatgggacagatgggcctctggtgcccgttcatcaggggactgatgagaccgaggcctgagagccctttggattttgtttttgtccttaatttaatcataagccaagaatctactaaacacagttccattaggggcaaagacgtaacacatcagaggccacagcaaggctgtgattcatactcaaaaaggaaaggtctctgggtcacaacagagcatagttgaggtcagcacactcccacccagtgcagggctgctccagcattgaggtgtgtctggcaggttgaagtaggggaagatgaaactcgccgaagtcttgttttgtggttgcacttaagtggtcaaaacttcaggagcaactgccgttattagcggtgagtgccaagactagtttttatagaagagaaagaaacaaagtactctgggaaggtcttactgagccttcacagtctccccacctttccactgttcccgtgctcttagccgctctgctggcctataaggcacagtcttcatttgtggcttctggcaaaatgtaagcacttgacttttgtttttgttttgttttgttttgtttttttgagacggagtttccctcttgttgcccaaggtggagtgcaatggtgcgatctcagcccactgcagcctccacctcctgggttcaagcaattgtcctgcttcagcctcccgagtagttgggattataggtgcacaaccaccacgcctggctaattttttgtatttttagtagaaatgggatttcaccatgttagccaggctggtctcgaactcctgacctcaggtgatccacctccttggcctcccaaagtgctgggattacaggtgtgtgccactgtgcccggccaactttcaattctttagagctgactatgagaggagccagcagtatagccacagcaccaacgaatgaggaagagcaaaatactgcatgacagctttgctaagaattctttcactttttttgtctatcagccaggagctagcaacttggcttatttggaaattttaagtgtacatatcctgtctccttaaatcctttacagatttaaagtgcagtctacctgagggctctgtgaccatgtaagaaagctttttctttctttttttttctctgagacagagtgttgctctgtcgcccaggctggagtgcagtggtgtgatcttggctcactgcaacctctgcctcctgggttcaagcaattttcctgcctcagcttcctgagtagctgggactacaggcagcaccaccatgcccggctgagttttgtatttttagtagagacagggtttcaccatgttggccaggctggtcttgaactcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctcagcctcccaagtaggtgggattacaggcacccaccaccgtgcctggctaatttttgtatttttagtagagacaggagtttcaccttgtttagtagagacaggctggtctcgaactcctgacctcaggtgatccgcctgccttgacctcccaaagcgctgggattacaggcatgagccactgtgcctggccagaaagccttctttattgagcttggtggcagcccaaaactgattctttaagggtgtcaggacttaacacctcctgtgacttagccgcacctcctctcctttgactttcattccacctccttccaggatcgcaaggtccctatttgtcctggaaacggcttcaaggtagtctagggtgccgtttgccgggggaggaaggtgctctggttgatagagtcgcctggccgcacactctttttggcacataacaacgttctacagagccggggtggagcgtgctttctcataagtgctctgcaggtttggagagagaggatatgaggagcacccttttctgttttttttaacccaaagattagcttggaaaaggggcagaggggtgcactggaactcaggtctgcctaagcagcacagcagaccaaggtctagagatgacatctgctcgcagctgttcttccaccagcccgcatcctggaaaggggtcttgtggcacacaagagttcacatccttccctcgtgaaataaggactttgtgttcatcatctcttgtaagaagcagagcagaaagcacagaattaagaaataaaagggaagtgggtgcctatataaagggaagtgaaaatgggttgctgtcccatgcaaagaccctggaaagctgttaacagctcagcttgtcactttcaccatctgcatttgtccagagtgattgagatttgcgttgttgtggagagaaaggcgcctgttgcacaatggagtgagattgccactgctgtcaggacctctgtgtttggcttgacactttttgagttctcagcagtctcgggaccctcaagagtggaagcatttttggatgttaaatgctggggttaattgaagttaagagcttgttttactgggcatggtggctcacacctataatcccgacactttgggaggccaaggcgggcagatcacttgagtccaggagtttgagaccagcctgggcaacatagcaaaaccccatctctacaaaaaatacaaagctgggcgtagtggtgtatgcctgtagtcccagctccttaggaggctgaggggagcagatctcttgagcccaggaggcagagtttgcagtgagccatgatcgtgccactgcactccagcctgggcaacagagtgagatcctgtcttaaaacaaacaaaaaaaacaaacttgttttcatttagactcttcctggcgttggggacctattggaataggtttagtgtgaactgagagctagaagtgttagaggagagagggagggaacagagcccgctggagcgagtgcccttcctaccttatcactgcatgccaggcatgtgccggcgctttggtcctcctcatttcattcttgactgccacctgagacacgatggttactagctccattttataggtggtgaaactgaggcttggggaaggtcagaccccaagggtgccatttagtcagtggcagagccagatccaaatgcaggtctcctgactccaagtgcagggctcattttatcgtccggttgcagcacgctggcggccccttgagccccaacctggataccataggggaggagcagagaagccaggaacaccacagccctgggccaaggtgcggggctgaaagaacttcccagcgctcagcctgggactagtggaatgggctgggccctggggctggcagcggtggccccggggagcctgggaatgagtagggagcacagggaggtgtgggagggcctgggaaccatgaaaaggagggcgggtgcagggaagtcgcctgctagtgaagtggcgagggggccctgtgggactccagggaatggccacggcaggttgtcctccaggagttgagagccactggacatggcagctgcctgtgttctcagccaccacagtaaccaaagaaatcttggttttaaaattcaagttgccatggaaacgctcccatcctcgacttggcttattatttaaaataacatctctacagcacaaagcccccgggtacatccaaggacactgctgtctgcccacgagacatgctaacctcacagtgtggaggctgtgtgggtcactgacatgcatggccacgtgagacgctgcctacccacgagtcacggaaaaggggaagattattaagaaagtcactaggggccaggtccagtggctcatgcctgtaatcctagcactttgggaagctgaggcagttagatcccttgaagccaggagttcaagaccagcctggccaacataacgaaacacggactatactacaaaaattagccaaacgtggtagcacaggcctgtaatcccagctactcaggaggctgaggcacaagaatcacttgaacctgggaggtagaggtttcagtgagccaagattgcgccactgtactccagcatgtgccacagagcgagactcccatctcaaagtcactagggaggaagcctcattggtgggaaggaagaccaaattggaaatgctctgaggaatcattaaaacaaatgtccttttatcagtttggtggctcagggcctttagtaatactgccaactatttttcctagaagaaacaaaactgaaataataggaacatactcacttttttttttttcttaaaagtaagggtatgttgtgaaaaaaagtctccccaccgtagtgaccgactgccgtgcatcttccttggcattttgcatgtagtggcaggagtgttcctacatgtgtagattgctgagagggtcagatgcttatggtcctcagtcacccacagcttgctttttccccacttaacattgggacttggggcatttttactctgttaatacaatagaattcacttcaactagttggttttttacttttattttattattattatttttagatgaagtctcaatctgtcgtccaggctggagtgcagcctctgcctcctgggttcaagtgattctactgcctcagcctcccaagtagctgggattacaggcatgcgccaccacgcctggctaattttttgtatttagtagatacagggtttcaccaccttagtcaggctggtctctaactcctgacctcaggtgatccaaccgcctcggctacaggcatgcgccaccgtgccccaccaactaattgcttttttaatggttgcttcatattctatttaaccacttaccgtaatttaacagttactctgttattggatacttgattcatttccaggacatgcagatttagaaactggtgggcgttgctggttgatgtctcggtggttgtgcccacccaccccaggcactcattatcatgccttccgtttccccacttcctaagccctgcaagaagtgccaaactgtccagcccttgccaatctgatacatgctgaatacctccttgattttatctgcacctccctgaggttgaacttattttactttattttattttatttttgaggcagagtctcactgtcacccaggcaggaatgcagtggtgaaatcttggctcactgcaatctccacctcctgggttcaagtgagttgaagcaattctcctgtctcagcctcccaagtagctgcgattacaggcacctgccaccacacctgggtaatttttgtatttttagtggagacggggtttcaccatgttggccaggctggtctcaaactcctgacctcaggcgatccacctgcctcagcctcccaaagtgctgagattacaagcttgagccaccatgccggttgaacttatttttatctgtgttggccatttgtagtttttctattatgctggttccatttttctgactttgaagagccttttgtggaaacgaagcctaaagtatatgtgagtactgctttgtttcgtcagtttttgttttaaagagacttttcagtgtaatgcaagcattttcccttgaaggctgtgtttcctgtcaatcctaagctttcctccagcattacctttttaaaaaactttattttctatattgatggggtctcacaatgttgtccaggctggtgttgaacacctggcctcaagtgatccacttgccttggcctcccaaagtactgggattataggcatcagccaccgcacccagcctgtttttcaaagggcattgatttttttcataaaactttttaaattaagatctgtgggcctggtgcggtgcctcacgcctgtcatcgcagcactttgggaggctgagtcaggtggatcacgaggtcaggcgttcgagaccagcctggccaaaatggtgaaaccctgtctttactaaaaatatgaaaattagctgggcatgatggcacatgcctgtaatcccgctgctcgggaagctgaggtaggagaatagcttgaacccaggaggcagaggttgcagtgagccgagatcatgccattgcactccagcctgggggacagagtaagactccgtctcaaaaaaacaaaacaattctgtgttgcatgtggtactttttgtgtgtgaggagtccagtgtgaagattcagacttcaggcagccacttgtacaagcactgtcctgtttcctctctggcctcacctaggtaacgctgattcctccacggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagcactttgggaggctgaggccagtggatcacctgaggtcaggagttcgagaccagcctggctaacatggtaaaaccccatctctactaaaaatacagaaattaggtgcgtgtggtggcgcacacctgtaatcccagctacttgggaggctaagaacctgggaggtggaggctgcagtgagccaagattgtgccactgtaccccagactgggtgacatggcccacagaccaagaccctgtctcaaaaaaaaaaaaaaagcttttttccagagccatcttgctgtcctcatatatttattctcctagatgaattgttgcttaagcaacaatgaagtttaaattgttcttcagatagaacccctaggtgccaggcagtttgttaagcactgacaccgcagtcctgtgactttcatgacgacctgtgacctgtgggaggtagaacacctcacccacccgtgggagcccctggagtgactgacaggaacccctgcctcacccagctccccgcgccgcggctctccccagccctggatgcaggcgcccaggagacatgtattgcttttgttgagctgctcacttaggagggtgactcagagttcaagctggaaagcactggcttgtgactcatgagccagtgcaagatcaaacggctggggcatcgaggtgagagttttccttctcagaagcctcatctccgcagccggaagcagagcccttggctgactggaaaaaccagagaggccccgggagtgggtggatggccagcccagccccacctctcagcctcaacctccaccagcccacaccgagcttgtttgtctgtgtcctgtcgaaactaggactcctggattgtaacttttcttacatttccctgtcccctgggtcctccacttagggtgtaatcacacagacaggctcttaactgtttcatatcactcacttgggaaagtgtctcaagctgttctacaaatccatgcaaaggccgtttaaaaatagcagcgaaggccctggactcggtctcgtccagcacagccccttggctctctctctgggctctggccgcctggcccccggggacccacacgaggtcatggcgtgcttcgggcaggggggcggggatcccatagacacctcagctccttaagagttctccgcctgggccaggacgagcatgggggtccccactgatgcccgagacggtgcccctgtgtgtgtgagccctcgacccacataacagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggtaggctgtggggctgcgtcctatgtatgtcccctcccaggtcggtctgtgcacactgactccaggaatgggaagccagccctcactgtggcccacagaacattgtcctggactgttgaaaaatggccctgaccctgagtcatgtcggctctggaccacgcctccctcctttgtcccataccccacgtgtgtgcatgagtgtgtgtgcatgtgtatgaatatatggttgtgtgcacgtggaggtgtgtgggggagtaagtgagcttcggaagtgttcaaaaccagctagcccctgtgacgcccgccgtggcacagtggcagtttatcagtcccgcccctgattccctttgtctctgcccagccctgaccctcggactgagaaccaagaatgaggagtgagccatgttgagggctggagagggtctctgattgtcagcaaatgggagcagatcaggggagacacccactctgcccgtgtgtcactctgggctgttccccagtgccccccaacccttgggcccttgaattgggtagggtctctggttttccctgggttgggcttcgtgtgtgggcagcgtgcccatccaccgccatcccgggagacccttcagtcagtgggtgactctcttccaggccgggcacaacttctacaacgtggacatgagctacttgaagaggctatgtggtaccttcctgggtgggcccaagccaccccagaggtgagtgcctgctcctctgcaccgctgtaatgtgagtggcaggcgttggtttggggcagtgggaagtgggagagtgaaggcctctctggcgtccgcagggctcatgctgcccagggctgccgacaccgcttgaggtacagtacttgtttcttttcatttttatattactttctctttttattttattttttccttctcaagttattagtagagaagatgctggtgcttttttttggtttttgagagagtctcactctgtcacccaggctggagtgcagtggcacgatcttggctcactgcaaactctgtctcccgggttcaagcgattctcatgccacagcctcctgagtagctggggccacaggcttgcaccaccgtgcacggctaatatttgtatttttagtagagactgggtttcgccatactggccaggctcgtctcgaactcttggcctcagcaagtcatctgcccaactcggcatcccagagtgctgggattaccggcatgagccacccccagtgttttctattgtgcttctccaaggtgtctcagccgcagatgtgacagacaaggtctgggtccccactatgtgggcagactcaatcttgagtaatttaagggaaatctaagaaaagccagatgaggccaagtatggtggctcacgcctgtaatcccagcactttgggatgccaaggcaagcggatcacctgaggtcaggagttcgagaccagtctgaccaacatgatgaaaccccgtctctactaaaaataaaaaactttgccaggcgtggtggcgggcgcctgtaatcccagctactcgggaggctgaggctagagaatcgcatgaacccgggaggcagaggttgcggtgagctgagatgatgccacttcccacgtgaggatggggtagttaagttgcacgacactgccttctgcacaatggggatgatatgagaaatgatgagaggatcctgggcagaggttgaggcaggagagcagggcaagaaacactatctggactgaataaacttatttaaaaatgagtttataatttgtggataaattcatcttaaaaaatccattacataagcctagaaagaagcgtacaatatcgcaagtcaggccaggtgtggtggatcatgcctgtaatcccagcactttgggaggccaaggcaggcagatcatttgaagccaggagtttaagaccagcctggccaacatggtgaaaccctgtctttactaaaaatacaaaaattagccgggtgtggtggtgcatgcctgtaatcccagctactcaggaggctgaggcacgagaatcgattgaactcaggaggcagaggttgcagtgggcagagatctcgccactgcactccagcctggatgacacagtgaaattctgtccactcccaccctcccgtcccacccaaaaaaaaaatcaaaaggtgcattgagcaacagaatttccttttgttttatgaaattaccaaggacacctgtctgcagccttcttcggcatgtcttgtgctcatttccttgttaggggagtgtggcccagccaaagtggcctttgcagggattggggagggagttgtgggatcagagcttgtaatgaagaccttcctttatccagagttatgtttaccgaggacctgaagctgcctgcaagcttcgatgcacgggaacaatggccacagtgtcccaccatcaaagagatcagagaccagggctcctgtggctcctgctgggtaaggccctgctggctggcggggaagcgctggagagaaagtgggagcaacactggagagtcttgggggattcggggtggggacaactctgacaaggcaagttatagaaactttctgagtcccagtttccatcagtacaaaaatcacaatccctctggccatgaatgatggcgaggattaggtggagtggcgggcagagcatccagcagattgcaagtccacgtgtacaggtggcgaagcagctccctttccctgacatgctggcccgtccgcaaataccaggagctctcactgctactctgcttcaagaaagcatccctttagtgtcagtgagctgtcttaattttgtcatttaattgtggtaaaatacacgtaacagaaatgtaataatcttagcaatcttcttttgttttctttttctttcttttttttttttttttttttttggagatggagtcttgctctgtcacccaggctggagtgcagtggtgggatattggctcactgcaacctctgcctcctgggttcaagcaattctcctgcctcagtctccccagtagctaagactacaggcatgtgccaccacgcccagctaatttttgtatttttagtagagatggggttttgccatgttggacagcctggtctcaaacgcctcacctgttgatctgccttcctcggcctcgcaaaatgctgggattacaggcgtgagccaccgtgcccagcaactattttcaagtgtacagttctgtagcattaagtacattcacagtgttgctcagccaccaccaccatctgtcccccgaactctttttcagctcgcaagacagaaactctgtccccattaacaccaatattgtagcccctggtaagccccactctactttctgtctctatgaatttgactcctagggacctcatacaagtggatcacaacagtatttattttctgggtgagctgtgttttttgttaagaaaaaaacacagccaggtacggtagctcacgcctgtaatctcaacactttgggaggctgaggcaggcggatcacctgaggtcaggagtttgagaccaacctggccaacatggtgaaaccctgtctctactaaaaagacaaaacttagctgggcctggtggcaggcacctataatcccagctactatagaggctgaggcaggagaattgcttgaacccaggaggcgtaggttgcagtgagctgagattgcgccactgcattccagcctgggcaacaaaagtgaaactccgcctccaggaaaaaaaaaaaaaaccacacacacacatacaaactaatactacacattttgcagatttcagaaatgaacccagtttccaggcagaggttcacgggggtgcttctcttgctttaaaagctgagttgggcaaatcgttgaggcaggagagtggggcaagtggctcatcacgcctctaatcccagcactttgggaggccaaggtgggcaaatcacttgaacccgggagttcaagaccagtctggccaacgtagcaagaccccatttctaccaaagaaaataaaagctgagtttgagccccaggagcgtcccctggtgttgagagatcagttgcctacaaggtctgaggtgcccctgtggccctttgaggggactgctgcagagggcccagcccggacatggcagcctcacccggtggggctcgttcctgcaggccttcggggctgtggaagccatctctgaccggatctgcatccacaccaatgcgcacgtcagcgtggaggtgtcggcggaggacctgctcacatgctgtggcagcatgtgtggggacgggtgagtcaggctgtgcttccacagcgggtttagtgctgagagaccctgggccccagcttctcagtggaggggactttgaggacttcctgggactgctgcgagtcagaagtgtttcggggagactccgagagtctggcaggcagggcctggcaaggctgctgcttcctgggaggtgcctgaaccaaggctggcccggcagagctgtctgaggggtggcatcccagcaaaacagtcagtttcagaaaatgtggtggaatgtctggcccctggtctggtttgtgtcatcgcatgttcctttttcctgcttggggaaccagtttggggcatttccttatgtgtagttagcggggatggctccaccttaacaacaaggtggtggcacagaactttctgctccagctgcctgcagcctcgccttggttccgcagtagcggtgttcactggcggctgcagatccgaaatgcctgagggcttaaaaaaatgcatgggcttctcccctaactagttaaatgggaatcactggcgattctcatttcagagaactggtggtgtttttaagtaccttagggaagtttagcgtctgctcagttgagaatcagtgttctacccggaagggcactcgtagcctggtctggtatggacatgaacaggagagcctcctgtcttctcccggatctttgtgggcaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattagaggctgtcttttcagctgtaatggtggctatcctgctgaagcttggaacttctggacaagaaaaggcctggtttctggtggcctctatgaatcccatgtaggtaagtgtgtccccttggccactttctggccagatggattgtttgagcaattaaccatcatggctttatttgcctttataaactgggggttgagacagaggggctgctgagaggtgctagccaggtgcacaggcctctggcaggacctgcctggcgtccatgctgcaggcacgaggcttgccttgccccaggtcttctccgtgggggctgtaggttgactccgctttctcccgcgtcccatcagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggtaaggggcctggggcctggccacggcgcacgtggaggctggggagctgctgcatccctcctcacgctgcagcgaagaggtcagggctgaggagccttggggtcccggaactctaggatagaggagggggagtgatgccctcttgccaggagaagcagcacactctccactttctgcctgttccaccctgaactcagcctcagcccttccaaactggaagggaccaaagccctccttttacaagggagtggcgtgtcctggagtcttgaggtatcctggcctcttccggggcctcgtgctcattgctccgttctcccatttctgagcttccagccccagccctgtccttagttcttcaggggagccttccttgagctcccctggcagggcaagtccccttagatgcagtcttcccctggaggccaccagaaatcagtgactggctgaccgtggcgtgccacgaggcacggtcactgccctccccaaccccgagctcggttcattttccaggatacaattcctacagcgtctccaatagcgagaaggacatcatggccgagatctacaaaaacggccccgtggagggagctttctctgtgtattcggacttcctgctctacaagtcaggtgcgtgctgatggctgatggcaatagagggtgggggtcgggaggggagcctgggtgccaggatggttcatgttgaccaatagggctggattgggcaggcaggtgaggggctggggaagagggctgtgtggggccttccatataggctcactcctctgtggaccagcctggcacctgactgtctttgtccaggtgttgtgccaacacacacaattccagaggcctctcccagagcctctgggctagttccttcccatccattagcgtccagctcatacatgttctctgtgggaacgcccccctccctggtggctggccacgcctgccctcgccttcctggctttgcattgctttaccagcatgtttctgttataatggcaggccgttcgtgtttgcactggctgacacattttcttcatctttctctttgcaaaggcctagatcgtgcctcacaccagtggatgaacacacagggaggaccttgccctgggtagtgccatagggactccaaccaaggaatctggacagtccccatccccaagtcctgtcttagaaatcccttgctccagatgaacagtctttgctgactgcatctatcccattaatattttgctagattggaaacttgtaaaacaacagtttgacaaaggaagatgattctggcaagaaaaagtttctgtgaagatggcacttcttagcatagtcctcgcccttattattaaaagatgcatttccactttgacagtgatttccccacccgagagcctggttgggcagccctgagccccttagccagtatctttcccatcagctagcattagctgccaccagtcctcccttctcctccctcacctcttcagggtgtacctggagcagctattaaaactctttaagccgtgtaacgcttttgacaaacccttacttacatggaatcccagtataaagaacagatgaatcagtcatctagcattaaatgttttatcaattagaatgtattagaaattctatttttaaagccaacaagcacattttgtaggaatctatttcaatatttactcaacaactttgagtgtgttgggccttcaaaaatatatttaattccccagtattgtgggaccccccctggagcctcctggtggagcagcaggttccctctggaagctgtttctccttcccggagcatgaccagctgagtgtggggggtgctgtggggcgtgggacagtggcccggtctcggtctcagccagttcttcccttttcaggagtgtaccaacacgtcaccggagagatgatgggtggccatgccatccgcatcctgggctggggagtggagaatggcacaccctactggctggttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtgagctcctcctaagtgccaggcagtcaggagttcccttttgctgtgagggcagactctgagcagcttcagagccaacgcctgcaacagttcccacagcatcgcgccagatcctgtgatgggaagggtgaccgggcagggggcttgcccgtggaggtgtgccccacggctccagaagccttgtggtgttgaggactgtgctagtgggccaacagcaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 37877 - DNA, 260684 bp, Homo sapiens
gcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctatagggtgtgtgtgcgtgcgtgaggtgtgcagcccctgtcaggatctggcgagagaagctgaccgggatggaggtcagaggtagggtgtttacaggtggtggtagaaggaaaacagccaggaaccccaggaggaccctggagctaggctgggcttcctgaaaccccccatcccatcctcgctccagcctgtgcctattgcaggaagaggagctagggaggtgggctgccggctgagaggccttgagggatctttgggagcggggcccgatttcagcctgatcctcatttccagaggcctggatgggtgtgggggtgccggccctgagtggggggtccagggcaggcgtgtgttcaggagacctcaggggtccgtgtagactgtcctctggctttgccagcaccaggtgctgtgtgtctggacctgggagctggctgagggatacccttgcttcctctcatttgttttctatagctccccctacatgcttgttaacaaacctgaagggcacttgtatgccagtggggtttgctgggatgtgccctgttgaggggctgtcatcagagaagcctccatggggaatgagagagttgtcctgagccaggtgccagggctcttgggttctttgcctgcgttgtgaccctggggccatccctcaagccctatacgcctcagtttcccatggcgctttgccctcccccttcttcctgttgcagggtggggagtaaacagcttgcacagctgccaggaggctgggaggctgggaggcggggaggctgggaggctgggaggcggggaggctgggaggctgggaggcggggaggctgggaggctgggaggcggggagtgactcagggtctgtgaggtcttgggcagcgatttttcaggcgaaagtcccagcacatcttctcgacttgggcaggagttgggggaggctctgccctcagctccaagctgtggtgctgggttttctgagtcctggggtggggtggggtgggcatctgttggatttggctgctcaggcttcaagaagctgcctctggtccctccttcttcccagatatcaagtagttggagagggatggggctggggggcctggtagctgggtgggatgcgggggcgggagctgaagtgctacagcagcctctcttggttcctgtgtttgatgttactgggcagagacagatgctaagcttgggtagggtcggggctggtctaagtgggactgctcagctcagcatgttgaggcaatttggtgggaggtggcctcagctccagagaagaggaccctgctgctggaggcacgcttgcagctctcctcaccctctttcccatgaccctgtctgatcaactctggctgagccaccatggctcagaatgacttgagccttgagggaaagggaccctggcatggatgggggtggtggcagggtcacatagtggctaagcatgaaggccctgctgtcactcagacctgggcgtaagtcccagctccatcacctactgctgtggccgcacctgcattcccctcaatgggagcccgagagaaaggcttgcaggctgtggcttatttgggaagcaatctcaggaaacaagggcgaggacatggggtttgaaggagagggaggggaagcaacaatttgattattcccaccactctcctgggcggtgttctgaggagccttacagacagaactgctctgttggggagagaaacagggaagcacttacccattagccccatcccctgccagacaagggtggctctgtggacattcgctcccgtgtggacttccagattgcacatgtgtggggctcaagtggttccctgtgggtactccacacggcagcttccaagaaggcccagcgtggcctgacatgaagcactgtcccattgcacctgtaagatgctgcttggagcctgtggggacctggtcattgcagaagtgtttggagtgagaggtggggccaagagggctggaagcagcacactgaggtgcctaacactgcgtgaccttggccaaattacctgacttctctgagcctcggtttccttagctgggtgttttaagtgttaataaggcatttattgaatttttgaacatggtgatggccccatagcaagggcttcacccggggtatttctgtgtggccaggaagaccacatgcccagggtggctcagatagtcattcactcaagtggaggtgggtccgcataagaggacctctaaagacccctcccggtcataggacctggggctcaggggccagactgctgacctggtcagttcctctagggctgtggcccagtttcccagacctcctgaatgcttccatttcacagcctatgaattggagtcagcgatgtcctgctcctgggctggccgctcagatatacctcttcctgggctctgcctcaggaggacacagaggccagcactgggcagaggagggcgaggggagaggacagctcagaagcaggtgcttgaaggaggagtggagggagggtggatgctggcatttctggcattgggagctggcatacggtcatgggcatgggtctgggccatagtcagtgggggaggacaaggcagggggctgggggggggcaggaaaggaaggtgagcgggttggcagaaggtggccaagaagcatggaagagacagggacagggagtgggttgggcagccttggcgtatggggattcacagcgtctggggtggtggtaaccaaatgggagggggatgaggtggcaggaaggaagggagggcattgggtgaggtctagctgggccttcctagggcgtaaactggggcagtgttcgtagttcgtggtacagcatccacaagcctcctcgttccttttttttgagatggagtttcgctcttgttgtccaggctggagtgcagtggcgcgatctcggctcaccgcaacctccgcctcctgggttcaagtgattctcctgtctcagcctcccgagttgctgggattacaggcgtgcgccaccacgtcctactaatttttgtattttcagtagggacagggtttctccatgttggtcaggctggtctcgaactcctgacctcaggtgatccgcccgccctggcctcccaaagtgctggggtgacaggcgggagccgccgcctctggcaaaagtctcttcatccttttttccacggtgtccacctgcccctcccaggccaccgccccgtttgacaggggaggagttgtttgcaaacagttcctgttatgagcggcgattggagaaggtccacaggtgcctttgccaaggcctgttgccatggtggcatggtgggccttgtctgcctaccctctcccatctctgagcaatgtgcaccccccccaggagaggtcacagagtggggaaggtgtccagctgcctctttgctcacacatggccagctcaggctggccttacaaaggtcactgcgttcatccctctgcctgcaggcagggtcacacccagcctatgctgggagacccagcagccgccgtcttcattacagccatttaaagtctactccgatctctgcaatttgtttttaataagtttaatgaaaaataaagcaatgatactagcctattcatctgctccccttttaaagcgggcatctcatggatgatactcttcttgtccacacctctctcagtgctttggtgcctgtccagtaggaagttctgcctcatgtctgatctcagcctgacatgctgtactgtttttgggtgtgttttgtgtttctgattttctatttgttgcaacccttcagggattccagatggttctaagggcattcctgtctacctgctcatgatctggagcagtcgcaggggcacccaaggcaggtgtgatgccaacgatacaaggctgtgccgagcccctggccccggccacgctctggttctggacttttgcagcttgctctcagggccagctggttcccactcctttccctagttcagatccaggattactggcctccttcttggaccatgctgggcctgctggctgcgctctgccaggtctgggtcagcaagcagatggcagcaggcatgggcacttgggggactctggcacagtcagggccctgccgattagatggctggtggagagcaagagcaggaggggagagacagggagtgacaggcagtcgggaacactgaggtgtgcctgtgcatgtggacacatctgtgcttggtgtgcacgtgtggccttggagggcttgttgctggattgctgtgtctggacatctctgggtggttatatgtggttcttctgagcacacccctgtgtgtgcaccgtgtgagcacgtctctgtgtgagcacgtctctgtgtgtgcacgtctctgtgtgtgcaggtctctgtgtgggcacgtctctgtgtgtgcaggtctctgtgtgagcacgtctctgtgtgagcacgtctctgtgtgtgcaggtctctgtgtgggcacgtctctgtgtgtgcaggtctctgtgtgtgcacgtctctgtgtgagcacgtctctgtgtgtgcacgtctctgtgtgagtacgtctctgtgtgtgcacgtctgtgtgtgcacgtttctgtgtgtgcacgtctgtgtgtgcacgtctctgtgtgtgcaggtctctgtgtgggcacgtctctgtgtgggcaggtctctgtgtgtgcacgtctctgtgtgtgcacgtctctgtgtgtgcaggtctctgtgtgggcacgtctctgtgtgggcaggtctctgtgtgtgcatgtctctgtgtgtgcactgttgtgtgctctgggttgttcatgggtactttctctggatatgtgtgccagccacctactgggtgtctccagggttctcaagagtgtgcccatctggatggcaggtgatactttttccctgcaggatttcctgcccccacggaggctcccttgagtcttctgccatgccccatcccgccctctctccaggcttccttatcctgtttctccctctgtctgaggaagttgcttctccccctctggctgtgtgggcgtccactgccttctgggcagggcctgaagagggacggcaagtccagcctccagccccatcctcccgagctctgagctgagggtgatgggctcaagctctgagttgaggagatgagtcagggatggctgcagggggtgggcagaagtggcctgtgtgtcagcatgctgtagggaagtgtgtgctcttgcccccctccacctgacccgccctcagtggcttgggcaccagtgcagctgtgatgaggctcccttaccttcatactcttccccagtagccttggttggcacagtttctgatggggagcagagtggtctctggggctccgggcatccaatgggggccttggccttagcataatttatctcaccataatcactggtactaatggagctcttcctgcaccaggccctggactacacactgtacatgtaatcagctcatttactcctcagaacaatcccatcccaggggatagtaggtcctattaggtgggttcgaaaacatccctggccaggcgcggtggcccatgcctgtaatcccagcactctgggaggccaaggtgagtggatcatctgaggtcaggagttcgtgaccagcctggccaacatggtgaaaccccgtctctactaaaaatacaaaaaattacccgggtgtggtggtgagcacctgtaatcccagctactttggaggctgaggcaggagaatctcttgaacctgggaggtggaggctgcagtgagcccagatcgtgcccctgcactccagcctgggtgacagagtaagactccgtctcaaaacaaacaaaccatccccattttatgaggaagttttcccattttatgaggaagtagaggctcagagagcctgggttacttccacaaggtcacacagctagtaagtgatggagccgggttctgaacccagacccgttcttctgctgttccctccgctcttcacaaagctgtgaagctgtgtccgtctcgtcttggcagtctccctctcagagaggccatcccagatcaccccctctacacaggactccctagccatctggtcccatttggatcggatcaccctattgtaaatacctgcataaaggtagccctcatttatcctctacttcctaaccccctcttccccacctagagcagggacctgtctgtcttgcttactaaaatattcttagaactggaagacagcttggaacacagtagggatgcaataaacatttgatgaatgaatgaattaatgaatgaagagaggactgactccagacctaagcttgaaatccctcctatatactgtctcttacacaacagggactgttgcagagtggcaggagcacaggctctggagccagcttgcttggttcaaattctggtcctgccagtgttctggttatctaatgctgcttaataaaccacccaaagcttatggcttaaaacactggtgacactgattttgcccatgaatctgcaacatgggcagggttcagtggggataacgcttctccactcagcattgtctggagtgtttcaaggtctaggggctgaagccatctgaaggcttagtcgctcacacgtctggcgtttcttgctggctgttggctttgggtcagttcctctgcacatgggcctctctatgtgctgtctccacatgctagattgggcttcctcccagcatggtggctgagctaagggacaagcatgcccagaaagagagccaggtggaagctatttcactttttattttatttgtttatttattgagatggagtcttgctctgttgcccagggtggaatgcagtggcgcaatctcggctcactgcaacctctacctcccgggtttaagtgattctcttgtctcagcctcccaagtagctgagactacaggtccatgccaccacgccaggctaattttttgtatttttagtagagacgagggtttcactgtgttagccaggatggtctcgaattcctgaccttgtgatctgtcctcctcggcctcccaaagtgctgggattacaggcgtgagccaccacgcctggcctatttttatttatttagagacagagtctcgctctgtcgcccaggctggagtacagtggcgtgatctcggctcactgcgacctccatctcccggactcaagcgattctcctgcctcagcctcccaaatagctgggactacaggtgcctgccatgacacctggctaatttttgtatttttagtagagacagggtcttgccatgttagccaggctggtcttgaactcctgacctcaagtgatccgcccgactcggcatcccaaagtgctgggattacaggcgtgagccaccgcgcccggccagcagtttattcttttagcagcagctacacttttgctcactgatcccctggccacaggtgaggcttgggtctgtccccagatccccgcctactctcatgtagtccaggaggcatcttactgtgcagagccctgctgagggtggggcccgtaatgagagaagggggaacttgaatgggaaaggccttttctgtcccagtttattatctcattacaggtcagccctgctcccttcaaggggcctgggacacatgttgctgatggagataccatgagggtggggctcaggcagaattgctctgggcttggggctgggatgaaccccaccagacccccatctttatccaggaaaaatcaagatggtgaggcctgaacatgctgtgtttgagctgagggagctctccgcttctccctgtccctgccgcctgcttccacctgagtcactgttcatctgcctgcggcatcatccccctgcggcatcatccccctgcctcgcttgctggcctcagggaggaatctcagggtttgctccttgtggcccaggttagggctgctcctgagcagagcgttggcagggggcccaggaagaatctgggggtttgcacgagcccagcctggcagtgtctcccatctaacgcagccctcatttagggcctgctctcctctgagccttccctgaaggaatggcagaagggctcaaagggggactctgggtttgaattctgtcaccttccagccctgttaaggaaggagaccactgctcctcctgctgccctcctgcccccaccttgcctagttcacaagataggaggagagaaaaagcaaaaagttggaaaaaaaaaaaaagtaagataaatagccagacaaccttggcaccaccacccggccctaggagttaaaaaaagtgataattataacatcaacccctgacctaaactacttttgttatctgtaaattccagacactgtatgaaaaaagcattgtgaaactttttgttctgttagctgatgcatgtagctcccagtcacatttcccacgcttgcttgatgtatcacgaccttttcacgtggacccctttaagttgtaagcctttaaaaaggccaagaatttctttttcgggaagctcggttcttaagacgcgagtctgccgatgctcccggccgaataaaaacctcttccttctttaatccggtgtctgaggagttttgtctgtggctcgtcctgctacactgtgaccttggacgagtctcttaacctctctgaggctccagttacttaccaggagggagactgtggtatggtaaagatgaaaggaagtaaaaagtatgacttttttttttttttttttttagacagagatttgctcttgttgcccaggctggagtgcagtggtcagatctcggctcaccgcaacctccacctcccgggttcaagcgattctcctgcctcagcctcctgcgtagctgggattacaggcatgtgccaccatgcctggctaattttgtatttttaggagagacggggtttcaccatgttggccaggctgatctcgaactcctgacctcaggtgatccgtccgcctcggcctcccacagtgctgggattacaggcgtgagccaccgcgcccagcctggagttattctttacagatgaaaaacctgaggcagagggagtttaagtggtttcctcacagctacatttaatgtcaggactggggctggaatccgtgtgttctgacaccaggtggtggttgcttatcttttgcaggaggaggatttccccctcccttcaaccccttccgccagagggcaacatggctgccatcctagaaacaagcccaggaagacgctccctttcctcctcgcaccacccaagcttgcctgcagagggcgcaaacgcccaccttctggccggtcctgggaggcgccaggtgccccgccttagcaggggagggcgggagtgacccagctgggtgggtgtgggcagagttggctgtgtgttctcctttagtgagaagctccttcagacagcccccacggtccaagcctttcttttctttttttttcttcaattttttttttttttaatgttttgcgatggagtctcactctgttgcccaggctggagtgcagtggcgtggtctcgggctcactgcaccctctgcctcccggattcaagcgactctcctgccccagtctcctgagtagctgggattacaggcaggtgccaccatgcccggctaatttttgtagtgtttagtagagacggggtttcaccatcttggcagggctggtctcaaactcctgacctcaagtgatccacccaccttggcttcccaaactgctgggattacaggcgtgagccatcgctcccagcctttttttttttttttttttttttgagatggagtctcgctctgtccccaggctggtgcgcaggggcgcgatctctgctcactgcaacctccgcttcccgggttcaagccattctcctgccccagcctcccaaatagctggggttataggcgcatgccaccatacctggctagttttgtagtttttagtagagacagggttttaccatgttggccaggctggtctcgaactcctgacctcaagtgatccaccccaccatggcctccaaagtgctgggattacaggtgtgagccaccatgcccagctttggtttttttttttttttctttttttttttcgagacagagtcttgctttttggccacactggagtgcagtggtctttactgcagccccaacctcctgggctcaagtgatccttccacatcagccttctaggtagctgggaatacaggtgcacagcaccatgcctggctaatttaaaaaaatttttgtacagatggggtcttactatgttgctgggactggtcacaaactcctgggctcaagcaatccccctgccttggcctcccaaagtgctaggatgacaggtgtgagtcaccacacgctgagcctgtttttttgttttgttttgttttttttgagatggagtcttgctctgtcgcccaggctggagtgcagtggcgccatctcagctcactgcaagctgcctctcccaggttcacgcaattctcctgcctcagcctcccgagtagctgggaatacaggcgcatgccgccacacctggctaagtttttgtattttcagtagagatggggtttcaccatgttggccaggatggtttcaatctcctgacctcgtgatctgcccgcctcggcctcccaaagtactgggattacaggcatgagccaccgcgcccagcctgtgcctgttttttaaaacttgaacttttagcatatcttcatatattaacatatattaagtgctacctcgttattttcagtggctagatagtattccattgtacgcttattctgcaatgtagttaatcctcagttgatgatcatttagattattttttgaatttgctattataatgatatgattaacatctgtatacatagatcttgtcaagtggtatgagttaacctgtgcaataaatttctaaaaacaaaattgttggcataaagggtatgtgcacttaaacaattttgatagagtgtattagtcagggctttgcagagaaatagaactaataggaaatatatacatatgtatataggggtgtgtgtgtatgtgtgtgtgtgtttagatttattatgagggattggttcatgcaattttgtggggtttttttgtttgtttgctttgagatagagactggctctgttgcccaggcaggagtgcagtggcacaatctcagctcactgcaacctctacctccctgattcaagcagttctcctgcctcagcctcctgagtagctgggattacaggtgcccgccaccatgcccagatttttttttgtatttttagtagagacgtgggtttcaccatgttgatcacactggtctcgaactcctgacctcaagtgatccacctgccttggcctcccaaagtgctgggattactgagccccagccaggcatgagccactgcaccccatcaggttaatgcaattttggaggccgagaagtcccatgatttgccgtctattagctggggatccaggaaagctggtggtatgttctagtccaagtcctaaggcacaagaacgaggagcgttgatagctgagggcaggagaaggcgggttctcagctcaggcagagaatgaactctcctttcctccacatttttcgtctattcaagctctcagtggattggttgatgccggcccacattggtaaagcggcatcttctttacttagtctaccaattcaaaggctaatctcttccagaaacaactcacagacatacccagaaataatatttcaacagctatggagatatcccctagcccagtcaaattgacacataaatttaaccagcacagagatattgcccaatagctacacattaatgggacgcccgtttccttatacctttacacaattatcaattttttctttttgagatggggtctgggctctgtcactcaggctggagtgcagtggcccaatcatggctctgcttcctgggctcaagtgatcctcccacctcagcctcccaagtagctgggactacaggtgcctgccatcatgccccactaatttttgtattttttgtagacatgggggttccaccatgttgcccacactggtctcgaactcctgagctcaggtgatccacccgccttgtcctcccaaagtgctgggattacaggtgtgagccaccgtggccggcattatcaaatttttaaaactttatctgatgggtaaaagtgataccttgttattatttaaaatttttaactgtagtaaacttcgtagcttctttagttcagagccatgtgtggctaaaactctcttggcagatggaccttactgaacagataagaataaactgcaataattttgggaaactgaggcgggcagatcacctgaggtcaggagttcaagaccagcctggccaacatggtgaaacgactcacagacagtctctactaaaaaaaaaaaaaaaaaaaaaaacattagccaggcatggtggcgtgtactggtagtcctagctactctggaggctgaggcaggagaattgcttgaacctgggaggcagagactgcagtgagccgagattgcaccagtgcactccagcttgggcgacagagtgagactccatctgaaaaaaaaaaaaaaaaaaaaagtaaataaataaattgtgcaattgtggtatatgtctgggccctgctcttggaactcagtttttacaagccctccctttgcaatctgccatcatcttgcttttcagcacttgtgcaatgggaaatttagtctggaccttgagatagtgcaggtgggcagtgatctgtggactgtaaatcactatgcagatgctaggtgctgtttttatcttgaccctgaggcgtgaattcttcactaatgtggggttgctggccctgaatgcccactgtgccctgtttccctggagaccagcatctttctccatcatccttttttttttttggtggttttgagatggagtctccctctgtcaccaggctggagtgcagcggcatgatctcagctcactgcaacctccacctcctgggttcaagcaattctcccgcctcagcctcccgagtagctgggattacaggcatgagccactacacccagctaattttgtatttttagtagagacggggtttctccatgttggtcaggctggtctcaaactcccgacctcaggtgatccacccgccttggcaggtgtaatcccaaagcgctgggattacaggcgtgagccaccgcacccgacctctctatcaccctttatcttcatatggtttatgaaggaagcagaggccagtctaagtctccccttggatgactagtaggctgaagtctcaaaagagtaggtcacctgcccccagtgacttagaggtggatctgggatgagagctgagctccagggggttagtactggggctggaatgggtactactgtctggatgggggaggatctgggtcagaccacctagtgcctgcttcactcgggacatctgtttcctgagcttcctgtaactgcctcatccccatgcctggggaaggagcttgtctcatctttcagctcccactggtggctatgaggtctgagctgctcgagcagaggaaaccacattgtcccttcctcccgtcctgccccgagggccaggggacacagtggaggggctgctgctgacaggagcctgaactgccccctcctctgagcccagccagctttcttggctctacctgcctcaaaagcccgtagaggccgggcgctgcgagcgccgtggctcacgcctgtaatcccagcactttgggaggctgaggtggacggatcttttgaggtcatgagttcgagaccatccaggccaacatggcaaaaccccatctccactaaaagtacaaaaattagccaggtgtggtggcaggtgcctgtaatcccagctactctggaggcagaggcaggagaatcacttgaacctgggaggcggaggttgcagtgagctgagatagtgccactgcactccagcctgggtgacagaacgagcccccttctctaaaaaagaaaaaaaaatgcccatcgaactgggtgagttccctggagctctgccctggggttgggactctggctgggactttgccccaggctggtccccgagaaacacctacagcccttgtgaactgtgacccacagcaggctctgggaagcgttttgagcctgagagagaaggagcccgtccagccaggcattgggggtagctgggtacttgctctttccatcttcattattctctccccagtgatgagctgagttttgctttaggaccttacttttcctgtctgtaacatgggcactgatgcactgtgcatttctgtggatccagaattagtggggctgataatcatcaagctgggttaatttggttggattccttcacttccctgagcctcagtgttcctatctgtaaaatgggataacagggcaccctctcagaggggttgtgaggctgaaaagctaagcgctttggtccgcgctggcccacaggagactcacagatgccggtgctgccctggctctcttgtgcccgcagctcatcctcctctccccgctggctgctgagagtcagctgagctctgggaggaagctgggctgtgcttgatggggccaggagggctgggcctgcttcacagaccgcttcccttttctctcttttttttttttttttttttgagatggagtctcactctgtcacccaggctggagtgcaatgtcacggtcttggctcactgaaacctccgcctcccaggctcaaacgattctcctgcctcagccttccgaggagctgtgattacaggtgcccgccaccatgcctggctaatttttgtgtttttagtagaggtggggtttcaccatgttggccaggctggtcttgaactcctgacctcaggtgatccgcttgcctcggcttcccaaagtgctgggattacaggcgtgagacagtgcgcctggccgcttcccttgtctcttgactcacaatccttcccagggagcccacagtctccttgctgtgcacggcacatggaagaggaatcacagggtcagagcagggggtcaagaagctgcgcgggactgaagcagggacagaatcgtccttgacagtaatgatagcagctcccgtgacggccttggagccccgtgctcagtgtttctgtttgctgataaactcgtgaaggtggtggcagcctccccaaattacagaagagaaaactgaggcctggagagattaggtaacttgcccaaggtcgctgggccccaaggaaggagaggaaggcagcgtgggaaaggccctaggaagactctcacaccctgcagggctcatgatgggccatgagccgtctgggagagtcccttccccctttccagccctcagtctggggacgtgtgggcccctggatcctcctggtttctccaaggttcctggatcccagcggcatcgaagaagtccaggctgtgggttctgcagggccggcagccgggccagtcctgctccttggccgggtgtctgactcaggagtgttgtttgtggctgtcaggggcacaccccccggtgggggaaaccagcctcagggtggcagcagcggaggcctcgaaacgcaccccttccctgtctccaggctgccgttcagatgtctgtgcctgggccggagtctgtcccggctctgggaacacttggtccaggtgttcatagctgggcatttacctggctgtctccatagaccgggaggccccagataaaagcatctgtcagctttgtcttcccctagaatgcatgcggcgggcagctttcacatgtggtcagtgtgggtggtgaggcgtgcccaagtgtgatgtgactatcaccccgcttctctctcatgtatgaaagcgcatcaacgtatactccaaagatgggcctgtcattaactccctctaactgattttttaaaaaagtaatttgcaacaggatttttttttttttttttgagatagagtttcgctcttgtcgcccaggctggagtgcagtggcgtgatcttggctcactgcaacctctgcctcccaggttcaagcgattctcctgtctcagcctcctgagtagctgggaatacaggcatgtgccacgacgcccggctaatttttgtacttttagtaaagacagggtttcaccatgttggccaggctggtctcgaactcctgacctcaggtgatctccctgcctcggtctcccaaagtgttgggattacaggcgtgaaccactgcacccggcctgcaacaggaattcttgcaacgtatgcaacacctccaaccccagcacctcccaactgaggctgtgggctgtacctggctcaccctggtgctttctgcacccagcatggtgcttggcctagagcaggtgttgctgtcagcggcgggaggccaggtgggctgactgttcccactttcacttgttcacttgtcaagctcttttctttagttgggactttattaatggagaatgaaagaaatccaactcatactggctttaggaataactctttattcgtacggctggctctcctatacccggggtcagctggttcctggcacagccggatcctggagctcagatgatgcccttgagactcaatcttttggccgggtgtggtggctcccgcctggaatcccagcactttgggaggctgagacgggtggatcaccggaggtcaggagttcgagactagcctggccaacatggtgaaaccctgtctctactaaaaacacaaaaattagctgggcgtggtggcgggcgcctgtaaacagatatgtgggaggctgaggcaggggaatcacttgaaccagggaggtggaggttgcagtgagccgtgccactgcactccagcctgggtgacagagcgagactcttcaaaaaaaaaaaaaaaaaagacatgatctttctcctctttccctttctctgtcagttctcttctctgccttcctgtgagtcggtttcattttccccacactctccacagccccaggctttcatctcatgcttcagcaggggaagcctcttgggatggtgtcttgttgggtttacttaggtctcctgaaccagtccccttggctggccaggcctggtcaggtgcccactcctgaccctggaggtggattgagtgcagagggttcttctcagatggaggcagggcaggcaggacccaagttgtccacggtacctgttgagcacttcctgggtgtgggtgggtgcctctggggagagaggcgcttgtggcactctgcagtggccatcctgtgggaagccagcagcctgaagccaccccagagcatgaaccacacaatcctaactttcctggggcagaggtgagggttgggggaagcctccgggctcctgctggggactagctgccttggaggtagagagtcagcccccagccctgctctggcccaggaccctgaagctgctcccccagcccactcagggcttgaggcccctgtgctgtcccctgctgtgaaggagtcaagaaaatagaaatccttgtacccttcgtccacaagctggggttggcccctggcacctcagcacggagtctaggaccttcacagtggcagcaggtgccagagaggaaatttcagggagggttggccagagagagaggccaatggcaccagctagggccgtttttttcctttttttttttttttttttttttgagatggagttttgctctttgttgcacaggctggagtacaacagcatgatcttggctcactgcaacctctgcctcccaggttcaaacgattctcctgcctcagcctccagagtagctgggattataggtacctgccatcatgcctggctcatttttgtatttttagtagagatggggtttcaccatgttggccaggctggtctcgaactcctgacctcaggtgatccacccgcgttggcctcccaaagtgctgggattacaggtgtgagccgccacacccggcctttcttcttcttctttttttttttttgagacgttttcttccctttctccactgcttgggggtagggtggggcctggggccctatctgtgcccactccccccagtgtctgttgtagtgtacgtgccacatccctttgaggggctgccattagtaagtgcctgctgtgtaccaggtgtggtcagcaccagtgcgtgcagagatgagcactggccctgtggtgtgcagactgggatgcgtgcaggacacgctagccctgtggcatgaggaccagcacctgagcatgcagagatgaggacgaaccctgcggttcagctgggaagacaaatccacccgcacatgggtaccgcccccccaccccacacagccagcgtgaagcatgccactgctctgacctctgtctagacacttggcggcgggggtggggggcggctgacaggtacagctctgtgcccatgtgtgtgtacatgcgaatgccccttgcagtgtgatgtggtctgagtatgtggatgagtgcctgcgggcacatgtgtatgcgttcatgtctgtgcacgtgtccaatggggctttgtcagtatgtgagaagcgtgtgcaggtgtgtctactgatgcctgtgtgaagtggtgtgtggatgtgcacgggagcgtgtgtgccgcgctgtgctcaggtgtgtacaggtgtctaatgatacgtatgtctgcgtgcatgtatctgtgtgtacctgggtatcctgggcgtgtgtgtgtccatgtgtgcatcccacgtgcccctgtgcccatgcgtgtgcatgtatacttacatccacgtgtgctagtggaatgacatgtgtgtggctggttcctctggcgtgtgccgagccatggtggggcaggcaggcaaaggtccctgtctcaggcagccctcgggagtgggtgtgaaggtccccagtgctcaggcgtccctgaggcttccagctgaatctttctgtccctcctaggcgtggctgtgggaatccttggggcgcctttgggttccaggaagctggggctgtgtgggccgggctgctaactggggctgtggagcaatctgccagccgagccccttccggagctgtgggttcctctgggtgtggggaagctgccctccacaacctcctcggcctatcttggtgcctcctggagtgcaggacacacctcccagctctgcagcctcacccacaggaagctcgggttgggggcaggcgaagagggaggtgccacgctgggctccccgccctgcaccggcactgaccccgctgtaccacggccctcttgcggacagccccggggacgtcgttgggacatcgctgggaccccgggctctgcagccacaaccatgtttggccggaagcgcagtgtctcctttgggggcttcggatggtgggtgacaggtgggagggtgggggaatgatgggagagaacttagaagtgaagtcttgttaagtgcattggcggccgtgggaacagaggggctcgggctgtgcctgagagctgggtctgctgacgccctggcaggtcgagatgcaggatcctggtggggacatcagagaccgtaagccttccccactgtccctgggcacaatctgctggcgaatcctggaggtctgcgccggctgcccgtggggaggtggatagcatgagtgtgactgcagttgaatgtgtgtgtctctgtgtccgcaggttcccatgtatgtgtgtgcgtgtctgggattatgtgtaagtgtgtgtgtgcgcgtttgagcctgtgtgtgcaggcgtgtgtgtgtggctgtgactgccagtccgtgtgaccgtgtgtgaggtgtgtgcctgtgcatgtgggcagctgcctgtctgcacttctggccttctgtgtctgtgtgtgcttgtgtctgcgtgtttgtgtgtgtgatgctcctgtctgtgctgttgttgtggccttgtggcaggggagtctgtacctgctggacctctgggctgcctgctgtcttgggggtgggttgtgagagaaggtctcccacctgcaccccaggcagcccaccctagctctgtcctagcctgagcagctgcatctgtccccagcctcctgcctggccctctggacactcttgcctctaagcttctgtctgggatgagggatgtgctttttcttcccggcggggggcagaaggtaggcacacgaaggccaaaggcttgtctctggttcccagtgctggcagcttcttcgcagctggggaacagagtctggtggttttcatgatcggtttcctttcagtgcctgggctgggggcgttgtcagactgggagagggccccgcgggaggtggccggggggtgtcccggtgtggaaaatggtggactaatgggggtggcacgaagggcgagggggagaggggctgtgttcctcggtaatttttcgcttccgtgtgtgtggcttatttccctcttcctcctcttcaaaagcactttgccatccatcctctggcagggggggactgtgggcactccatgtttggcagatgggatggtgcggatgagaagatggcacagcgtcgcctgtgtctgctctcgggccctccctgacgcctggatctgggagctgccaccccgagggtaggtgccagtgtccgggaggcagcagaggacttggcttctggttgggaggggtgtgtgtgtcttggctgtgggccttgcagggcagggcccagcaattagattgtgccctccaaggcccgcctttctctgggaggtgtggagcagatggaaggctggtcgccagaaagctccgggtgcacaggtcccggtctcagcctagcttcattccatatgaagccctctgtgttgagacccacagctccagagcacaaggcaaagccaggcctgagatttgaatctgggcaggtgagggggaagacaggagtgtggctgcccagggctgccaagatagaaagcagaattccaagttcttctctagcagcccttctcactggggcttccttaatgaaatgcacattcagattcaggaggtctagggtgagccgaaggtggaggaagagccctaggatgtcccagacgcccttgtgtgctggctcagtgtccactaggctgtgggttccaggagggcaggccctgccccgtcgcgttcacctggaagcctggcatgtcacacaggctcagtcgatgcttgtggactcatcgaggtcttttgcacacagcaggtgtctgcttggggccccttgaggttgacgggatggcggggccttctgggcttggaaggttaaggcagcaagaaagggggcgagactggggtttgggcctcctcatctgggatggctgtcagctgggagggggtgtcacggattcctggagccctggtccctccagacagtgaacagaatctctggggctggtgttttccaagctccattggatgcagggtggataacctctggcaccaggggcagacaaggtgatgagggtgggtgggatgggatgggagagggaggagtgcccaggagccttggcttcctgaaagggaaaggcccagcctcacagtcctctccatctcccatctcagcctctccaaaaccagagccctgccctcctgaggccacaccctgatgtgggaactctggtgggctggctgctgtgtaggcgtggtttgaaccagggctgctgtgaccacggtgcctgtaggtggtgcggtgggcggggctgacccgacagcggtcagaggtgcacgcaccaggagccccggttccagcggttccagcgccgactccaccttgaccattgaggaactctaatgggacacttcctctctctgggtctcagtttccccttgtgtcagtgggggatttctgccttacccacaacacagggctgttgtaagaattaggagattccttgagaaaatgtaaaacctaagcgcctgctgtgaggggctgccatccggcagctctgggttgcacgcgttacagcagagtgtggggctctgagtcctgctcggatctgggtgtctgtgcgttgaatgggggaagaggagggtctgcaccccagagcgggtggggattccagggtgagaccctcagggaccagtagtggaagccctaaggaagggactcaagaggacgtgtgaggaagaaactgggagagacgtgggccaggcccctcggggtgccgcttgctttgctgttgtaactgagatcagaaggtgctgggagtttactcagagtgaaaggaccccgtcccctagctccaggcctcagggtgacttgtgggctggctcagctccgtgtcctctcctcttccctggagctgtgactgtgggaagcctgaggcagcgctgggctggccagagaagggtgccggaaagagcctccagggtctccagcatgctggagccagtggcagttttagtgaagctgacagtgatggtgacactgatgatgacatgtggtgacatggacagtgatggtgacacgaatcgtgatgttgcaaaggcagcattggtgctggtggcagtgctggtgacagtggtggtcacgacccttccacaagaggagatactgacagtgggaacactgtccacctttctgcctctggagagggaggaggggcctcttcttgccagccataagggctggcatatgcaggggggtaaaaatagaacctcagcggcgctgtctccccttccagtgagggcgggcacaggctggggatggaggagctggctgtgagggcagtctgcagcaaacgtgatcttccccgctctgaacctctgtgcctgatacaacccaccagggtctgccccaggagcagggtctgcctccctggatggactggtggctccttgggcaggagggtccctggggctggggatgcttgcgtcttcccaaagcagacgcctgggaaatatggatgtccacctggcattcagattgacatccgtgctgacccctgaagccgggttgctgggttctcttgcgagggtagccgtaataaagggagaggctgcatacaaagtgcttacgatccctggacctgacgtgagatacctgaattcagactgggccagtgattttacctttctgagcctgggtttcctcatctctgaaatggggagaataataatacgcatgttgtagggtggtgtgtggccccagctctcccagcactcagaggcgtctctccccctgctagcggagaactggcccctttagccagtccctgacagagccctgctgtctggtggtttgggctgtcccggggactcctccatacagatgctatgtaggagtcttcagcctcagcactgaccggagcccttgcttttctcttggcaggatcgacaagaccatgctggcaagtctgaaggtcaagtaagtagcaatttcctgttctgtaaaggtcagagatgacgcggatcagagcgccgggcccttgctccccccaggttgtgggagacacaagaggggctgtcgtgtttgtcagattccagtccgagtccatggtgcttccagatcggaggaggctggactaactcttattcctggggtgttcagggagaggtagaggtgggaatggaatcaccaggggctagaatggtgggagtgtgtgtagcaggtgtaacattcagtcccattattcttttttttctttttctttttctttctttctttctttctttttttttttttgagacggagtcttgctctgttgccaggctggagtgcggtggcatgatctctgctcactgcaacctccaccttccaggttcaagtgaatctcctgcctcagcctcccaagtagctgggattacaggcgcccaccaccacacctggctaatttttgtatttttagtagagacggagtttcaccatgttggccaggctggtctcaatctcttgacgtcatggtccgcccacctaggcctcccaaagtgctgggattataggcgtgagccactgcgcctagcccagacccattatcttcctatcactttagtttttagatatatattgggctgggcatggtggctcacacctgtaatcccagcactttgggaggccgaggtgggtggatcacctgaggtcaggagttccagaccagcctggccaacatggtgaaaccccgtctctactaaaaatacaaaaattagctgagcgtgatggcacttgcctgtaatcccagatactcaggaggctgaagcaggagaatcacttgaacccaggaggtggaggttgcattgagccgagatcacaccattgcactccagcctgggggacagagtgagactctgtctcaaaaaaaaaaaaagaaagataattacattttttatcactttaatttttatgtgaactcccaatcctggcagtgactttctgacattccccgcctactaggacctgactaaacactccagggtatgtgtgtgtgtgtgtgtgtgtgtgtgtgtgtgtgtgtgtgtgtgtgtgtgtgatgtcagctgctcatcaagtcatttgttgccaggtatgtcagcatgggcagcctggccctggggctttctgaggctcccacgccagactcagggtgtgggaattacctgcctcggtttaccgtgtatctcttggtccgtctgctgaggtccgaagcaggcacagccctctcctagaacctctgacctctcttccctcaccaccttcattcctttttcctctgcgtttctggccaaaccattttgtctgcatcctgatctcctttttcttttgagacttaaccaaagtgtagcctgcgtccagctgcacccctcccatgaggcaatgagtactggctaaccatctgctccagtggagtgaattgaaaaggagggaaattctaggaggaaaaaagcattggcctctagctcaaaatattctcccggcacatgtgaattcactgttgcatggaaaattcctccaatgaatcgccctccttccgaggcagcttctctgggttgtcactcccccatctcggcagaaggttttccctgcctagtctccctctgtcatgccattcagttgccagccctggttgtgtatcccctggatgcaggtccctgggcaaagtacggccagtcttgacggttggcataaaagagggtcaaaataagaggtttcccactttggttggttttgttcaaaaaggtgaggctgggcagttcgcagggccgggatggaggacagacttttcctgcccttcaagagctttcagtttctctgttgagctgatgccaggaagctggatgtggtggttcacgcctgtaatcccagtactttgggaggccaaggtgggtggatcgcctgaggtcaggagttcgagaccagcctggtcaacatggtgaaaccctatctctgctaaaaataaaaaaaattagctgggcgcggtggcgggcacctgtaatcccagctactcggccgactgaggcaggagaattgcttgaacctgggaggtggaggttgcagtgaggcgagatcgcaccacagcctgggagacaagagtgaaatgccgtctcaaaaaaaaaagtctagagctgatgccaggagtgccatggagtagtcccgaaaggctgcctggaggaggtggcctctaaagtagctcttagagatgaagcaggatagtaggacccccatgtctgtgctggcttggcatggtgtgtgcatcagtgcagacccattcaatctggaggtgtcagggcaagtcacccgggacaagatgcttcccttctctgggctttagtttccatatcttttgtccagtggacacaataatgtctggttttcctagagctttctagagcatatttgcatactgagtgagacgccaggcatgaagcagagctgctaaggggtgtagagtggtcagagtgttcttttggtgctgttttgggacatctagttcaatctcacaagcacttatcgagggagggcctgtttgtaaatataatatctgcaacctggaagtgcaccagttatagggtagagtgaaaagctgggggcgtgggccagggttgagattgggaccccagtgaggtctctgagtgattatctgggaaggcgatattgggatgatagcttgggacagtgtgtagcactgtgttcggagttttattggttaagattcctttgattacaagaaacaaaaacccagtgtcatctggttacgcaaaagatggaatttatggggaagaaagcagggtgccccagggaactgaaggggaggaagcaaagccagagctcaggagtggttgaaccaggaactggaaacccgttgccatcaaaatcccagctggcttctttgcagacatggataagctgatcctgagattcacatagaagttcaaagataatcttgaaaaaggagaacaaagttggtgcactcattcttcctgatttcaaaacgtatcgcggccaggcgcgatggctcacgcctgtaatcccagcactttcggaggtcgaggcacgtggatcatttgaggtcaggagtttgcgacaagcctgaccaacatggtaaaaccccgtctctactgaaaatacaaaaattagcccagtgtggtggtgtgcgcctgtagccccggctacttgggaggctgaggcaggagagtcgcttgaacccaggaggtggaggttaccatgagctgagatcacaccattacactacagcctgggtgacagagtgagactatgtctcaaaacaaaacaaaaacagaacaaaacaaaacaaaagtattgcaaagctatggttattaagacagtgtggtacggacataaagatggacagacagatggatccagtagaattcagagttcagaaataagcccttgcatttctggtgaattgatgaggcagccaaatgcccactgttggggctcctgagtcaccaagatgcctcctccctctgcctttgctgggtgaggcatctctccttctacagcagctcactgcattccctgccatgtagcggatactcctgggctgcagcccaggctccctggttgccttggctccctccccaaggacctggtgtccttggtgcctccccaggtgtccctgaggcctgcagctctgacgacaggggtctggcctcaccgttatgaagcattcactgtgtgctcaggcttcgttgcactgttttcctgaggctttgcacccacctcatgaagcaggcaccaatcctctctgcattttacagataagaaagtggagactgagagagtttaggaaacccgttcaaggtcttcagggaggaagtcacagagttgggatttgaatctgggtctgtgttttgtgtgtggagctgagtggttctcacacctgcctcccgccctactttcccatattctttccctgatgttctcaggggctgtgtatatagaatccgtggccgcagaatgcacctccgcctccacgacaccgtgggtgagaaggccgcccctggtttgctggggcccatccccttgctggaggcctggattgaatggggtctgtggtgcctggatgagttggacactcagaagcaaggatttacttaactgcagtgcaggggtacaggggctatggagccacgttggaatgctggaggggaggtggcaacggtaccacgcaggagaaggaggcttgtgtgtgggatatagcctcaggctaacacacaggcaaatcgttcacctctctgggtcagtttccccgtctgtaaagggttggattagcgtccagccttctctcttccagccttgacgttctaggagtttgcattcatgccttgaatcctttcgtatttttctcaggaccttggtgatggtaggcgctcgctgttgagtgagtgaatgcatggctgtgtgaatggaagtctctgagagcaggggctctgtgcattacatccctgactccttagggcctacccagtgcctggcacaaaacaggttttcagtctgtatttgctgaatgaatcaacatgtgtcatcatggttggcccatcacatgcaggtggaaggaaggagagaaagaggcaggctcagcgtgtggggatccctcttctccagtccgctctgggggccagctgggcatgaggtccctgtcgggcaggtgcctggggttttcttgtggagctccttgaaggagcagccggaacgggaggatctgagctgggagcctccgagacactcctcttgtcctttatttcttttttgagaccgcgtcttggtctgttgcccaggctgcagtgcagtggtgcaatctcggctcactgcaacctccgtctcctgggttcaagcgattctcccacctcagcttcccaagtagctgggattacaggtgtgcaccaccacgcccagctattattattattattattatttttgtattttagtagagatgggggtttcaccatgttggccaggctgatctcgaactcccgacctcaggtgatccacccacctcagcctcccaaagtgttgggattacaggcgtgagccactgcacctggccaaaacctctgctcctttttgctaccctctgtgctctctccacagagacccctgcatctttgctaaagaaagagatgcgtgtatgtgtgtgtgtgtgtgtctgtctgtctgtctgctgcatgggctccagctacctgaggtgaccgtcatgcacaggggctggctgcggtggcctggagtgagcacgtgaatggttcagggtagcctgtctccactgctggagcacattctcatgcacactcctgaggggtggggaagtctaaaatccattgccttgtaggaaaaaaatccagcttaaatttaagtgggtggctgcagcccttggtccctagaagtggcacctctggagagggatgaagcccatgatgggacctgggtgcagctgtgctctgtgatttcttccctaggagaaggacggggagggcctggaggagctcctgcttggctgggccagcatgtcagttctactgtggtttggccagaagataccacacagccaccgctattctaagtttcagatttaaccagctaagaattgaaaatcctgctagaaatgaaggggccatgaaggacagggctcagtgtgtctccgggcagctttcctaggtccctggggactccagtgtcagctgctggagacattgtccatgagagcaggggcttgccacagccaggaagcttgatttcttctctgctacaacctttttattattattattattattattattattattttgagagggagtctcgctctgtcgcccagtctggagtgcagtggtgaaatttcggctcactgcaacctccacctcctgggttcaagcgattctcctgcctcagcctcccgagtagctgggattacaggtgcggcccaccgtgcccggctactttttgtatttttttttagtagaggcggggtttcgctgtgttggccaggctggtcttgaactcgtgacctcagatgatccacttgtctcggcctcccaaagtgctgggattacaggtgtgagccactgggcctggtctattattattatttttatttattattattatttttgagacagagtctcactctctctcaggctggagtgcagtggcatgatcttggctcactgtgacacctctgcctcctgggttcaagtgatcctcctgcctcaggaccatacccaactattttttttgtatttttagtacagacggggttttgccatgttggccaggctggtctcaaactcctagcctcaagcgatccacctgcctcggcctcccgaagtgctgtgattacaggcatgagccactgtgcctggtctgccacaaccctttaaactcaggcttccctccccatgctgtgagaattatgcacaacatggggcacgtttttgtggctaatttttgtatttttagtagagacggggtttcgccgtgttggccaggctggtctcaaactcccgacctcaggtgatccgcctgcctcggcctctcaaagtgctgggattacaggcttgggccaccgcctccggccgttgattccaatttaatgactcttttcattcaccagttgaaggccacacctaccaattcattcccccacctttggccactgggtctttgtttactgtagattacaagaattcttgaggcaccactacgatgttctagaaccctctggggccaactcatcttagtctgctcttctcctacacacctagggcatctgctgagagtttgctggggttgtcaaggacagggggagcttgaggtttttgggggtagacagctgagtcagttcagcctacatttactgggcacctacactctgcagggagacagttgccatggcacgggacaagggctgcgatgcccacagaaaggatggaggggggcctcctggagacctggtgatgcctgagctgtctccaggggtgcgtaaggtcagcagggaggagagaatgcactccaggtagcccgaccctcacgaaggcagtggggcgtgaagcagcttcagcaggtgggacctgggagcagttactattaccagacagaagcgagggtgggagtgcagggggctgggggaaggcaggccacgtctgggagggtaggtgagctatgctggaagtggggctggatcaaagggcttaggactaggggaatgctatggtgagctcgagtctgagagcccctctggctgactggaggggttagagaggaggcagggcggccaggaggggatattgagacagccacgtaaagaggtccccggagaccctccgctggcctgcgccctggggtgaggcctcgggaagttcgcactgtttccagcggggaggatcctggccattcctgtttggaggtggtaacctggggatccaacctgtgagatggaggcctgttaacaggaacctctcttgctttgctgagcttttttcctttcgcccagtaaatcccgttgttctcacccttctgtcgtgtccaagagcctaatctttcttggtggtgtgacaaggaccccgttttgagctgagctcaggagaaagtcccataatagcatggggctggagggagtggccttccctgcctggagctggtttggaaggtgtgggtgaaggtgagaagaagggtcagctgaggactctcagaaggcttcctgtgagcgctgggtggatgctggtcccattcatggagacggagaactagcgagtttgggcagtttgggcggggaaggagggagtaagactctgaatgtaaaatcttccctccactttccactctcctgtttggtctgtctgagacccaccatatacctcctgccctgtggaagggggcagaggagagagcagcatcctgagggccgtgggggctggtctgcggcctgggaagcagctgcacggcgtcccctcgctggcccggctcggctcctgggtgcctttggcaggtgagttccaggtgagcactggccggtgtggccgcccttgtgactgacagctggccacaccacagaacccactgttagataccctccaggtgggtcgaggagaatgtgcccatttctgtcttgagtggcagactctggttcgttgatttcttcaggatgggccctgtgcctgaggacagtgttggcatgtgtgggggcatgtgggtgtgtgcagatacgtgtaggcgtgtgtgcacgctcgcccatgcaggtggacgtgagcgctgagggcccatgtgggtgcctatgtggtgccttttttggctttagcgagttcctatggtaaccatgaacatgcctgttttgggatctggagtctcggggcgtgcgtggctgcagggagaagcagggaaggcgagcgcttagccggtggttggcttgatttcattaccaggcaccggggctgctcctggaggtaccatttgccaggcggcaaggtctgcagactccaagacccatgtgctcctggccctcctcctggccagtccctgccatgcccaggaagccctggtgagtccctgttctggtttctcattggacaaacagctccccggacttggccaggtcttgtgggtatctgctgatgggcaggcagggagccggctggcagccctggccagtaggtaccaggaattggggctcttctgagatgagtgtgggacagtgggcaggaggggctttgcctattcacggagcccgtgagggtgttttccatgtggctggtggagtggcatggtccttgtgggtcccatggacagggctaaccgtgtgagtgtgagggtatgggcaaggacgccggagaggaaaatgtggaccgggtggcctgtggcccgccagccgagacccaaccatccccggaggcccccctcacccctctcagctccccgggtcctcatgaacccccaggcctctggccatgcacttgggcttcctcgctggtctccccaggcccagaggcctgctggcctggcctggatgggaagactcacggtcctgtggaagaggccagagggctctgcccggctcgctgggagctggatttggccaaggccggggaagaattgctcccacttggctctggagaaagactcgtgcctccccagattgtgcaccccctggtgcttcttgtctacacactgcagacccatgggtgtgtcaggacacccctctccagccaccgcgggagaggctcttgatggacaggggcccaagcagccctcaggggccgtacagagacgacgctggtgtctgggagcggggtggcaccttctatccccttcctcccgctggctcctctggggcagctagcagggagttggggatgtgagtgtcaataggggctgtcagtggcccctctggcttgtgctgggaccctcccctccccccgccccaccccaggagttccttcctctgcctctgagaaggctctgggtgaggctatgctgggaccgggggctgtgtgtggagcaggagttgctagggctggacagagggctgaggccctggtgaagggcgaggggagcaaatgtggaccttgcgagctttgtctggaccaccccggccttccctccctgggaggcagagtccagaacctaatccccgatggccttccctgggggcgctgggagagggagaggggaaccttcaggagagacccccagatctctagagtctttgaatcttagggcttgagatttaaaaagtcaaattagtcgttttttttttttaattatactttaagttctagggtacatgtgcacaacatgcaggtttgttacatatgtatacatgtgccatgttggtgtgctgcacccattaactcgtcatttaacattaggtatgtcttttaatgctatccctcccctgtccccccacccttttttttttttttttttttttttttgagacggagtctcgctctgtcacccaggctagagtgcaatggtacgatcttggctcactgcaacctctgcctcccaggttcaagtgattctcctgccttaggctcctgagtagctgggattacaggcatgcgccaccacacccggctaatttttgtatttttagtagagatggggtttcaccacgttggtcaggctggtcgcaaactcctgacctcgtgatccgcccgcctcagcctcccaaagtgctgggattacaggcgtgagccaccgcgcctggccaacaaaagtcaaattagtctttatgcaaatctcctgtgcccctaaaactagtcacccaggctgagcttggttacctgtggggacagtgagctcattaccttgtatggatgcctattttattgtagtacaactttgctcgaagctgaccgctgttttcatctggaatctctgtaactgcattgctcggtccagtcttgacccttggcccgcacgtccccacttacccccattcaacaaggttcacccctctttccactaagagccctgcagacactggaaggctgctttttcaccctgagtcttcccttccctccccttggctggtcaccccggcctctgcagctatatttgggattcctcacctgcctgggctgatctttgtcggaagggttcaggttttgcaggcaccctgcaggagccccatggacacgaggatggacagctagaggcgatgggcctcaccctccttatttacagatcagtaagctgagaccctgagcaggggtgctgctaacttgcgataggacaacacagaggtggtcagggcagggtcgggacgtgaggggctgctcttgtcgtctgtgacgtgctggcccctggttcttttcctgcttctccatcagctccatccttgctgctttctgacttggaccctcagctcttgggcactgcaagaatgctggcctgtcttagcggatcttccattttataacagcagctggaaatccgtttctttgtgtgtgtatttttttgtttttttgttttttgagacggagtctcgctctgtcacccaggctggagtgcaatggcacgatcttggtgcattgcaacctctgcctcccgggttcaagtgattctcctgcctcagtctcccgagtagctgggattacaggcatgcgccaccatttctggctaattttttgtatttttagtagagacagggtttcaccacgttgagcaggctggtcccgaactcctgacctcaggtgatccgcccacctctgcttcctaaagtgctgggattacaggcgtgagccactgcgcctggcctgatttttgtatttttactagaggcgaggtttcaccatgttggccaggctggtctcgaactcccaacctcaggtgatccccccagctcggcctcccaaagtgctgggattacaggcatgagtcactgcgcctggccggaaatctggagttttagacaaaatcttgacaactaactgcagactttaaagaacagagctggccgcagcctaccctgcagaccagagtcagccggaccctctgctctgctcacctccttaggcctcagctcttgtttctttgtggctgactcccaagtccctctccccaggtcatccccaagaacagtgctcttgccccgacctcagtggctggctggtcatttcggctctgttcccagactgaactgactctcaattaaccttttctctctttcagatccagttcttttctgtcactgggttgagaagcctctgagtcatgggggggtggttcctcctgtctcccggttcaggcccattatctcctgcccagtgacacaggctttctaattaacctcctcctccggtctctgccagctgtgactaactcttcatccctcaagctggctccagctctgccttccctattactagacgctggcccgaaggcagaccttgatagtgctgactctgatgggcttctcatgccaggatgctggtgtagggacccccagcccccatctggtggggggctgtctttgggtcacagcaaatagtttgtttgttccttccttccctcccccaggacggtggttctcaaacttttctacaatttggtttcacctggaggtgcttttaaaaattctgatgccggctgggcgcagtggctcacacctgtaatcccagcattttgggaggccgaggtgggtggatcacctgaggtcagaagttcgagaccagcctgaccaatataatgaaaccctgtctctactaaaaatacaaaaactagccaggcgtggtggtggttccctgtaatcctagctactcaggaggctgaggcaggagaatcgcttgaacccgggagatggaagttgcagtgagccgagatcgcaccattgcactctagcctgggtaacaagagtgaaactccgtctcaaaaaaaaaaaaaaattctgatgcccaggttgtacccagttccaattaaatctgaatgtcggagggtagaacccagcatcagtacttttttttttttttgagatggagtctcgccctgtcgcccaggctggagtgcagtggtgcaatcttggctcactgcaacctccgcctcccaggttcaagcgatttctcctgcctccgtctcctgagtagctgggattacaggtgcatgccaccatgcccagataatgttttgtatctttagtagagatggggtttagtagccatgttggccaggctgacctcgaactcctgacctcgtgatctgcctgcttcagcctcccaaagtgctgggaatacaggcgtgagctgcggtgcccaactatacttttaaaagatcccccgttcattccaataggcagccaaacctgggaagcacttccccaagggatacacaagtgtggtgaccgtcagtggttgggcaatgactcaggtcaggctggatgttaaaatgggctcctggtgggcgtgagccctctgggccagggcttctggtaacatttgaggctggctgactctttgttttacggtgccatcctgtgcgttgtagggtgttgcgcagcctctctagcctgtatccacaagatgcccacaacccacccctcactgtgataatgaaaatgtctccaggccaggcatggtggctcacaaatcccagcactttgggaggcccaggcaggtggatcacctgaggtcaggagttcgtcgagaccagccgggccaacatggtgaaaccctgtctctactaaaaaagtacaaaaaattagccgggcatggtggcacgtgcctgtaatcgtagctactcgggaggctgaggcaggagaatcacttaaacccgggaggcggaggttgcagtgagccgagatcgcaccattgcactctagcctgggcaacagagtgagactccatctcaaaaaaaagaaaaaagaaaagaaaaaaagaaaatgtctccagacgttgctctatttctggggcagtggtataaaatctccccgactccgttgaaaactactgttctaggcctagtaggttcaccttgacagcattctcaaatattcacagaagaaaaggggcaaaggacaccaagtggggaccccagcttactgattgatttgtgggcttggcagtcaggcagcctctgtttaaatcctgactctaccagctgggtgaccttggacaagttacttaacctctctgtgcctctgtcagttctggttttgttttctcacaatcgtgcctcctcttgatcttcagctgcagcccgagggtggaacttgctgtgtgtggctgggcactttcgcctgtggctgtgctgctctgcccacagggaacatgcctttgctgccccttccctgtcagcatcagggtcacaacctgcccgtccttccagggccagcttccatgcagcttcctccacgcacagccccttccccatcggcatggaaggctctcttccttgtgcccctggggcagccggaacctcaggtcacatgcagctcctcccgcgccgtggggatctggtggtttctgtctgagttcctccccacttggggtctgagaccgtgggagcctctagcgtgcccagctcgggctgtctcactgtttgttacccaggtgaggtggctgtcccctccctaccttgggttgagctgtgaaccagtaggttaccgcagtgtggtaccaccccccccaaccccaacacccagctcattctgagagggtggagtgggcggaaatccgtgcctggcagaccacaaagccacataactgacttttgtagccctgccctggggtgttgggggggagggttgacggcagccattgcccctttcttcggtgctttgccaccagcagacgccccgtggaattgaggagctttgttctacgagctcgggaacgggacttgggagggacagcccctgtcccaccctgccatgccctgttcaaccctgtcaggcagctgaacgtaggctggacccatggctgcccaccctggctgcagtacagaatcacctaggggacctcgttaaaatgcagcttccggaccccaccctggggcttggggattctgcctcatcagcctgggtggggcccaggaaacctgtgtgttaccagcgctgaggtgctgctgatgaggcagctggcttcacagctgcacgggaaccagtgccgtttaaagcactttcccccacagtgcggctccagcagtcaggttcacgtactctgggtgacctggggcaggctgcgcaacctctctgtgccccagtttctttgtctgaggataataacagtacctgcacgtgggtgcgcttgttgtgaggcttaaatgagattatccaggtgaaatgggaacagagtgcctggtacctagtgctcaacacatgtaacctgccttaacatctctgatattattattattattattattattattattattattattattgagacagagtctcgctttgtcacccaggctggattgcagtggcataatctcagctcactgcaacctccacctccccggttcaagcgattctcctgtctcagcctcttgagtagctgggattacaggcgcgcaccaccacgcccagctaatttttgtatttttagtagagatggggtttcaccacgttgaccaggctggtcttgaactcctgacctcaggtgatccgcccaccttggcctcccaaagtgctgggattacaggcgcgagccaccgcacccggccccatttccgatattaacaacagtcctgggctgtgcggtcacacacgtgtaactgtgcgatgtgccctcgtgcctgcaggcgtacctacgcaggcacactgagcattgtgtaccgggacccaggcctccctgctgaggacagagcatccctgtggtacatgcgtggacgcagtcactggctggacgtggtcagaagggcagacgtgtgtgtacacaaggcccagacaagcgggtttttatttgattcacactctgaccttattccttgagttagcagcacctgggctgagctctgggagcccaaggtgccccttgtttccatagcaaccataatctggtaaaaataggcgggggagggaagagctggaagaggcccgagccggctccgggggcatcctgcctgctaaggtccttttttccacattgctgaccatacagaggtgctgttttgttttgttttttttttttcttaggataatgacatgcaaacctctgagtactcatgactcagaattgacacttgttaacattttttctcattttcatcaaaccctcttatttatttatttatttttgagacggagtctcactctgtcgcccaggctgaagtgcagtggcgcgatcttggctcactgcaacctccgcctttcgggttcaagcgattctcctgcctcagcctcctgagtagctgggatcacaggcgcccgacaccacacctggctaatttttatattttttagtagagatggggtttcaccatgttggccaggctggtctcgaactcctgacctcaggtgatccacccacctcggcctcccaaagtgctgggattacatcaaagtctttttaaaaaactgtgttaaaatatacatattataaaacttaccatttaaagcatttttaagtgcaccattctgtgacattaagtacatttacaatgctgtgcaaggatcaccattatttctagaagtttttcatcatcccaaactgaaacttcgtatacattaaataataactccctattccctcatctccacagcaccctgcagccaccattctgctttctgtttctatgaatttgactgctcggtgaactgtgtataggtgaaatcacacagtacttgtccttctgtgtctggcttatttcacttcccataatgtcttcaaggttcatccatgttgtagcgtgtgtcagaatttcctttttttttttttttttttttttgagatggggtcttgctctgttgcccaggctggattgccgtggtatgatcttggctcactgcagcctccacttcccaggctcaagcgtttctcgtgcctcagcctcctatgtagctgggattacaggtgtgcaccaccacacaaggctaatttctgtatttttagtagagatagagatagggtttcgccatgatggccaggctggtcttgaactcctgacctcaggtgatccgcctgcctcggcctcctaaggtgctgggattacaggggtgagccaccatgcctggcctagaatttcctttccttttaagactgaataatatcccattgttgcatgtatcacattttgtttatccatgtgttcactgatggacatctgagttgcttccaatttttttttgctgttgcgaataatgccacagtgaacgtaggtgtataaatatctgggtctctgttttcagttcttttgggtatctatttaggagcagaattgctgatcgtatggcaattctatgtatagttttttttttttttgaggcagggttttactgtgttgcccaggctggagtgaagtggcatgatctcggctcactgcaacctccgcctccctggttcaagtgattctcctgcctcagcctcccaagtagctgggatcacaggcgcctgccaccacacacggctaaattttgtatttttagtagagacggggtttcaccatgttggctaggctggtcttgaactcctgacctcaggcaatccaactgcctcaacctcccaaagtgttaggattacaggcatgagccactgcgtctggcctctatgtttaattgtttttgttttgttttgtttttgagatggagtctggctttgttgcccaggctggaatgtagggcacaatctcagctcactgcaacctctgcttcccaggttcatgccattctcctgcctcagcctcccgagtagctgggactacaggtgcccacgaccacgcctggctaattttttgtatttttaacagagacggggtttcactgtgttagccaggatggtctcaatctcctgacctcgtgatctgccctcctcggcctcctaaagtgctgggattacaggcgtgagccactgcgcccggcctctatgtttaatttttttagctttttttaaaattaaagaaataaaacacacacataaagttaagttccggtcatcatttctgcttgcctccgttcctctatttcttccatccataggggctaccattagcaggaattttgtgttttctctcagcccactttatttatttatttatttatttatttatttatttatttatttatttatttttgagacggagtctctgttgcccaggctggagtgcagtggtgcgatcttggctcactgcaacctccgcctcccggttcaagtaattctcctgcctcagcctcccaagtagctgggattacaagtgcgtgccaccacgcccggctaatttttgtatttttttttagtagagatggggtttcaccatgttggccaggctggtcttgaactcctgacctcaagtgatccacctgccttggcctcccaaagttttgggattgcaggtgtgagccaccgtgcccggcctcagcccacatttttaatgctttcacattcatacacaggtatctagaaacatttatagtttttgtgtgcattaaaaagggacatacctgacatccttttgaatttgtgtgaggtggcgttctggcgctagattgcctgggttcagatcttggctctgacacgcagcagctgtgagacctcaggcaggttccttcatctctccatgcctcccttttctaatctttgaaactggactaatagcaaagcctgaaacctactgcaagggttgttttggagactgagtaagtttatacatgtctagtgcttagaacagagaggggatgtagcagacacaggatggatatattaccattatcgttctgcatgtgtgtctgtccacatggttgtaaagtctattttttttttttttgagacagagtctcactctgtcgcccaggctggaatgcagtggcgcgatcttggctcactgcaagctccgcctcccaggttcacgccattctcctgcctcagcctcccaagtacctgggactacaggcgcccgctaccacacccggctaattttttttgtatttttagtagagacggggtttcaccgtgttagccaggatggtctcgatctcctgacctcatcatctgcctgccttggcctcccaaagtgctgagattacagatgtgagccaccatgccttgctttttttttttttttctttttttggagactgagtcttgctctgctggagtgcagtggcaggatcttggctgactgcaacctctgcctcctgggtacaagtgattctcttgcatcagccttccaagcagctgggatcacaggagcatgccaccacacacttttttttttcttttttgacggagtcttgctctgtcacccaggctggagtgcagtggtgcaatctcggctcattgcagcctctgcctcccgggttccagcgactctcctgcctcagcctcctgggtagctgggattacaggtgcatgccaccatgcccagctaatttttgtgtttttggtagagacggggttttttggccaggctggtcttgaactcctgacctcagatgatccacctgcctcggcctcccaaagtgctgggattacaggcatgagcctcagcgcctggtgatagatctagtttcttctctctttctccttttttttttttttttgagacaggatctcactctgttgctcaaggtggtgtgatcctggctcactgtagcctcaatacccccagggctcaagtgattctccaacctcagcctcccacgtggttgggactacagcatgcaccaccatgcttggttaagtttttaagaaatttttgtagagatgaggtttcaccatcttgctgtctcaaacttctgggctcaaatgattctccaaccttggcctcccaaagtgttgggattacaggcgggagccaccacttctggcctagttttttctttttggtgccatgcatattaatttgtacaaatagatcacattttttttgtatcccccattgatcccctcttgctggacacctaggtcgtttccattttctgatattgcaagcaatgctgcaggcagtggctttccccttgcctggccctctgtgcgtttgtgtgaggtcatgaggggtacctagaggtggggctgttgggtcgcagctctactggatgctgccagattgccctcaagagaggacttaggctgggcgcggtggctcacgcctgtaatcacagcactttggcaggccaaggtgggcggatcacttgaggtcaggagctcgagaccagcctggccaacatggcaaaaccccgtctctactaaaaacacaaaaattagccaggtgtggtggcgggtgcctgtaatccagctactagggtggctgaggcaggagaatcacttgaagacgggaggcagaggctgcagtgagctgagatctcatcactgcactccagcctgggcagcaatgagagacaccgtctcaaaaaaaaaaaaaaaaagaggacttagtattttcactgctcccaattctatgattcccattccccacgtcctcactgatgtttgattttcatgttgatttgagtgacagaagcatattttattttattttattttgagacggagtctcactctgtatagtggcatgatctcggctcactaaaatctccgcctcccgggttcaagcaattctcctgcctcagcctcccaagtagctgggactacaggtgcccgccaccacggcccggataatggtttttttttttttttttgtatttttagtagagataggtttcattatgttggccaggctgctctcgaactgctgacctgttgatctgcctgcctcggcctcccaaagtgctgggattacaggcatgagccaccgcgtcctgcctattattttattctttattatacaaacatgaacagatctctgaataagcgcttggaaaccctcatggctccactgtcagatcgctgtgtctgagcctccctcgagtccctctccacaggcccagggatgcgcttctcttcaccctttttctgtgtcacaagcatttccatatattgctacattcttttttcccctctttaaaaatagcacttttcctgattataaaaatagtacatgctcactgtagaacatttagagaatatgtacaaatagagattaaaaaataaaaatatgacccatcacccaaaatgttatcattctgatgtatttctttacaccttttttttttttttttttttgagacggagtctcgctctgtcgcccaggctggagtgcagtggcacgcttacagttcactgcaacctccacctcctaggctcaagcgatcctcccaccttagcctccggagtagctgggaccacagcatctgccaccatgcctggctaatttttttttttttgtagagatgaagttttgccatgttgcccaggctggttttgaactcctggtctcaagcaatccatccgccttggcctcccaaagtgctgggattacaggtgtgagccaccttgccccgccaagtgtggtgttttaaatttaagtgaattaagtacaattaaaaatgcagctcctcggttgcactagccacatctcaagggctcagtagccacatgtggctggtggctaccatagggaacaacgcaggtacagaacattacagaacattttcatcatcccagaaagttctactgtacagcgctggttgagaatgaggtccagactcccctggaggacttccaagggctggacaagcccagagagtctatgctgtctatgatggattacgcactgcagaaacgtccctggacccccaggccagaaggcatctgaaccgcataaagccagtgccaccgggtggtgctgaggaggaggaggcggcaagctggtgtctggggcagtgaggatttcagatgcagctcctgcctccttgggcagacagaactgtcacctccagggttgcccaatcccatggtcagcacccagttcaagcataatatgtcgtgggtcctggtgtctcttgcattcacgcacacacacacacaggtatgtaccattgagacatgaccacgcagggtcacccaggttcacacatacagcctcattcatgctcagaaacagttccccaaaaggcacaaacacggtctttgccgattgccattataacagcaacaaaaatagctgttaggctgggcgccgtggttcacgcctgtaatcatagcactttgggaggctgaggccagaggatcacttgagcccaggagtttaacactagcctgggcaacatggtgaaacctcgttgccaaagaaaattaaaaaacaattagccaggtgttgtgtggtatgtgcctgtagtctcagctacttgggagtcaggtgggaggattgcttgagcccaggagtgggaagctgcagtgagctatgatcacaccaccgtactccgcctggaggacaataaaaccctgtttttttttgtttttttttttttttttttttttaagaaaaggtggctcacgcctataatcccagcactttttttttttcctttggggaaattttttttttaattatactttaagttttagcgtacatgtgcacaacgtgcaggtttgttacatatgtatacatgtgccatgttggtgtgctgcacccattaactcttcatttaacattaggtatatctcctaatgctatccctccccactccccccagtcccagcactttgagcggctgaggcagctgtgaggtcaggagttctagaccagcctgaccaacatggtgaaaccctgtctctactaaaaatacaaaaagtagccgggtgtggtggtgcgcatctgtaatttcagttactcagggagtgctgcttccttggggtgaggcacagccctgtggcgagtctcttggtaaagtgaaaaatgctgtaaatgggtggctgagatgggtgcagaggattggggtgtcatggggatggcgggtggcatggggctggcttccggatacctcatccctgacattttctctgttgacattggaacccaggatgtccagatgctgtttttgaagccctatcggccagggagtcaatgggcccccactttgcctgggagggctgtgtcctggtgtcctgtggggttttggtctcccaccccggggcctaagggcctcagaatgaactggaacccaacctttgtcaggggagccccagcaatgtctgcacgacatacgcccccaaacagcgtgggttcaggaatttgtaagtgtttgagaaagaaaaactgttaggattctagtttcgttgaaaagccattttgcctttgtcttcctctgggcacctgaccatccattcttagcccacctgagtattgagcatacactatcgtctctgcagtggaggtggtcctggacgcatggcgtaacgtgggctctctgggccctccagaaaagtgtgccactcgctcctctccggctgggccgtcagaacccacagctcacacacacatccagtcaaggtcagaagaggtggctgcattcctgactcaaggtcaaaagaggcaactacataatcagtgagtggccctgaggggccagtaagcaataaggcagcgggaaagggtgcagagcaattgtggagcaattactaagcaagcagaatgggaagcaacacgactgaacaagaaacagcacatggggccgggcacggcggctcacacctgtcatcccagcactttgggaggccgaggcgggcggatcacgaggtcaggagatcgagaccatcctggccaacatggtgaaaccccatctctactaaaaatataaaaaattagctgggcgtggtggcgggcgcctgtagtcccagctactcgggaggctgaggcaggagaatggcgtgaacccgggaggcagagcttgcagtgagctgagattgtgccactgcactccagcctgggtgacagagcaagactgtctcaaaaaaaaaaaaaaaagaaagaaagaaaaaaagaaacagcacatgggccaggtgtggtggctcacacctgtcatcccagcagtttgggaggccgaggcagatggatcacttgagattaggagttcgagaccagcctggccaacatggtgaaaccctgtctctactaaagtacaaaaattagctgggcatggtggcacacgcctgtaatctcagctacttgggaggttgaggcaggagaatcacttgaacccgggaggcggaggtttcagtgaaccgagattgtgccactgtactccagcctgggtgacagagctagactccatctcaaaaaaaaaaaaaagtccgggcatggtggctcacgcctgtaatcccagcattttgggaggccgaggcgggcagatcacctgaggtcaggagttcgagaccagcctcaacgtggagaaaccctgtctctactaaaaatacaaaaattagccgggcatggtggtgcatgcctgtaatcctagctactcgggaggctgaggcaggagaattgcttgaacctgggaggcggaggttgcagtgagccgagattgcgccattgcactccagcctgggtgacaaaagcgaaactctgtctcaaaaaaaaaaaaaaaaaaaaaaagaaatagcatatgggtcacaaattctgttgactaagtagaagcagaggcttggccagagaggaggaggaggcggcggctggagatgcctgtggtggttcgaaaggaagcacctggactgtttgagggaagcctctgtacaatgtccaattttaccccaaaacgtatcatgctgcctccctgcaccacttcctcttttaggagacaaggtgttgctctgtcccccaggctggagtgcagtggcataattgtggctcactgcagccttgaactcatggcacaagcaatcttcctgcgtagctgggatgacaggcatgtgccaccacacctggctaatttttaaaatgtttcttatagagatggggtcttgctatgctgtccaggctggtcttgaactcctggcctcaagtgatcctcccaccttggcctcctaaattgctggtattatgggtgtgagccaccacacctagtcccatcttccctttcaaacacaggcctagcagcagcatctctccagcctgtctccgcagggttgtttttggctcatgatttgggcaagaggagggagaagggaagagaagaaactttgctgttggaactgggtcagaattggaatacaggaagcaagaacatgagtgttcacgctttgactgagctgttgacagcaccgaggccagaggcaggagaaatgaagctgtttgtttatctgatgaatattcatcgagctcctatttgtagccagccgcctctgttttaggagccggggatccctttgttgaatcctggctctgccactcactgctggggttaccttgggcaaccgtctgaacctctctgagcttgttttcccatccggaaagtgaagataaggagcgtccctgtctcacagggatgtttgaggatgaaatgagctaacataggaaaagcacttagcatggtgcttggcgcagagttagtgctcgtgactgcagctgttactgaagacagagcgtttaggtgtgaagagggtctggtgcccgcatccaaggaactcacagtctctggaggaaacagacatttaacagtcatctgcaaagcatgaggcagtgccaatagagatattcttcctggtggaatgagggaaggcttcttgaaggaggcggcgctggaaggttgaaaaggaatccctaggaagagaaggttgcagggggcattttttttcttttttctttctttctttctgtttttttttttttttgagacggagtcttgctctgtcgccccggctggagtgcagtggtgccatctcggctcactgcaacttcctcctcccaggttcaagcgattctgctgcctcagcttcccgagtagctgggattacaggcacccaccaccacgcccagcaaatttttttttttttttttttttgtatttttagtagacacagggtttcaccgtgttagccaggatggtctcaatctcctaacctcgtgatctccccgcctcggcctccccaagtgctgggattacaggcgtgagccaccatgcctggcctgcagggggcatttcacactgaggaaacagtaagggcaaaggctgcgggtgggtggggaagtgtgtagagctgtttgagaagcggtgagccaggctctcgaaatggatggagggacatggcaggaaacagccagaggcgagggtggggatccgctcggggaggctctgagtgtgttgccggcgagatgacgggtgccctggaagagcgggatgggggaaccgcctgtctccttggtgacttgggaaggcggccttgggagctttggggatggattgcggaagggaggagatgcttgctgtgctcctgaggaggggtggggcctgaatgtcctcttggctggggttggaggggagggccaggctagggtcctaagaaggtgaatcctgagcccaggcatctagcccacgtgcagcatgaaaggaggatttccggccgggcgcggtggctcacgcctgtaatcccaacactttgggaggctgaggcgggcggatcacgaggtcaagagatcgagaccatcctggccaacatggcgaaaccccgtctctactaaaaatataaaaattagctgggcgtggtggcgtacgcctgtagtcccagctacttgggaggctgagacaagagaatcgcttgaacctgggaatgggaggttgcagtgagccgagatgacaccactgcacttcagcctggtgtcacagcgagactccgtttcgagagagagagaggagagaaagaaagaaagagagagagaaagaaagaaagagaaagtcccatggaaatgggggtttcacatttgggggatttgcaaagtagtcacgtgggtgaggcaggagggaagcctagtagcagagaagatgatgccttcggccttgagtgtggtgcgtttgaggagcttgtggatcgtcccaggggtgtgtgtggttgggctctttagctcaggagagctcagctgagtggatacccactcgcacatccaacagctctcattcccaaagcgtgttctgagtgtgagtcctacaaaagtggacaattcagaccctgttgggttttgtggcactttctagtcagggaggcagatgagaacagaatgaagaacgcagatggtttcagacagtgcccagtcctgcgaaggaaatagaacagtgaggcgatgagggtggggctcggggctgggggaaggggctaccctgggtgggtggtcaggaagagcctctccatagaagggacatttgaggcctggcgcggtggctcatgcctgtaatcccagcactttgggaggccaaggcgggtggatcacctgaggtcaggggttcaagaccagcctggataacatggtgaaaccccctctctactaaaaatacaaaaattagccgggcgtggtggtacctgcctgtaatccccaagctcttctcccagcccacccggcaccagccagtttgagctctgactgggaactgggatctcattcatcccatctggtcagcatctctttggttgctttttatcagcttcctattagaaaaaaaaaaaatccccttgaaaaacaagggggagggttcatacacgatcggttgcagcaggcacgccagtgacggtgggggcccagggggagcgtggcagaggctctcaggctggaggccagctactgctccggccagcccttccctgtgggggagccacaagaggccgtccctgggcctgcaagcatgagatgagccgagcacttgaccaaaactagtttgggtcttagaatttaacttatcctgggccgggtgcggtggctcacgcctgtcatcccaacactttgggaggccaaggctggcggatcacttgaggtcaggagttcgagaccagcctggctaacatggggaaaccctatctctactaaaaatacaaaaattagcagggtgtggtggtgcacgcctgtaatcccagctactcgggaggctgagtcaggagaatcgcttgaacctgggaggcggaggttgcagtgagccgagatcgcgccattgcactccaacctgggcgacagtgagactccatctcaaaaacaacaacaaacaaacaaaaataatactgcgatttcctagcaatgcccagtgacttaccctaaattcagtgaaagttgaaaaaaaaaaagaagtggcatttgaaggagacccgaaggaagaaaaggagccagtgtgaagctgtctggggaagagcattccaggtggtgggaacaggcttggcaggtgtgaagatgaggaaggaggcccctgaagagccggcgggaagagcgggtggatgggaacacagtttccccgtccgccagcaggtggcactgttggcccaggactgcccgggcatggctgggagagcaggtggggccgcgggttctttgacctcaggtttgtgattctggctgtgggctcatcacaggctctacctccaccctctggggagataagccctggccgggggcagaagagcagttgtaatggtttcctggctgttctccttccccaacgggtcttgctttcagtgtttctttgcttgctccctctccagaggtgacttccctcccggtttctgggtatctgtgtctttgctctctccttttgcttttctttttgctcccttggtctcttctcctccctctctcattgctccctgggggggcaggttcctgtctcaaagattaattacttgctttttttttttttttttttgggaaacctcgctctgtcgcccaggctggagtgcagtggcacgatctgggctcactgcaacctctgcctcccaggttcaagcgattctcctgcctcagccttctgagtagctgggattacaggcacccgccaccacgcccggctaattttttgtatttttagtagagacggggtttcgccatgttggccaggctagtctcaaactcctgacctcaggtgatccacccgcctcagccttaaaaagtactgggattacaggcctgagctaccatgcccggccaattacttgctttcctgatgtagctcagatggagcgggtggtgacttaggatcaggaaggtgctgtttctcatcccattgcctacccttccttcccgtggcttcagatctccataaagggctggggctggggtcgtgaccccgtcggtagaaaatggtcccagcgacccttctctcctggagcccatggacccacctcccagtgccatgccctgctcacctccagcccctctagcaggcagccctgtcttcatgtgagaagggagaactggatggcaaagcagatggcacagaacagctgcacaagagctcaccgaagggcttgttatgaaagagtcatttttgtcaacagaagtacgcttctgccctatactccgtgctctgtgaattatttctcaggggagactaagctggccagagcctggtggtggcctcctggctgtcggatgtcagagttagggctgcaggttgaggggtccttggctttggtctgtgagtaccatggtggttaagagcctggtctctctctcttaaattttttttttttttttttgagatgagattttgctatgttgcccaggctagtcttgaattcctggcttcaagagatccttctgcctcagtctctcgagaggctgggattacagttgtgagccaccgtacctggcagtctctttattttactttactttttcctctaaagttaaagtttacagtattttattttgttgtggtgagaacacataacatgaactctaccctcttaacagacttttaagtgtacaatacattattgttgaatgtaagtaagagtttactctcttaaagcctcccactgggtgggaagtctagcaccttacaacaggaccctgtaatcccagcactttgggaggccgaggtgggcggatcacttgaggtcaggagttcaagaccagcctggccaacatggtgaaaccctgtctgtactaaaaacacaaaaaaattagctgggtgtggtggtgcatgcctgtaattcgagctactcgggaggctgagggaggagaatagcttgaacccatgaggcggaggttgcagtgagccgaggagatcgtgccattgcactccagtctgggcgacagaggaaaactccgtctcaaaaaattaaaaaagatggccgggtgtggtggctcacgcctgtaatcccagcactttgggaggccgaggcgggcagatcacgatgtcaagagatcgagaccatcctggctaacatggtgaaaccccgtctctactaaaaatacaaaaattagctgggcgtggtggcgggcgcctgtagtcccagctactcaggaagctgaggcaggagaatcgcttgaacctgggaggcggaagttgcagtgagccgagatcacaccactgcactccagcctgggcgacagaatgagactctgtctcaaaacaaaacaaaacaaaacaaaaactaaaaaaaagattttgaacagtaaatgtatttacatggttggttctaaaaccaaaatgatataaaaatatatgtggtagaaagatttgcttgtactccaatccgccctgtccctacattctaaaattcactttgaggttctttccagtgcttctttattcacatgtaagatgagcatatccttttcttacctccactccccttccctcccttcccctcccctccccttccctcccttcccctacccttccctccacttccctcccctcccctcctctcccctccctttccttcccctccctcccctgcccttccttcctctccccttccctctttctttttctttctttctttttttgagatggagtcttgctctgttgccaggctggagtgcagtggtgtgatctcggctcactgcaacctctgcctcccgggttcaaggattctcctgccttagcctcccgagtagttgggactacaggcacctgccaccacgcccagctactttttgtatttttagtagagatgggatttcactacattggccaggctggtcttgaactcctgacctcaggtgatctgcctgctccagcctcccaaaatgctgggattacaggtgtgagccaccatgcccagcctcctatttctttttcttaaataaaaggtaatatcctacaaaacactgttttacatcttgcctttttctctggagaattcctgtctgaccactgagagctgctgctgcctctgccccattccttttaaaaataactgtgtagtatttaacggtgtggatttaattttagagactgatgattcctttcagaaatttaattttgtataacgtaagtaatataagaatacatttttggctgtgcatggtggctcatgcctgtaatcccaggaccgtaggaggccaacgtgtgtggattgcttgagcccaggagtttgagaccagcctggtgggggggcagcatgacaaaacctcatctctactaaaaataaaaaaaattagatgtggtggtgcacacctgtaatcccaggtactggggaggctgaggttggaggatcccttgagcccaggagtttgaggctgccatgagctgtgatcatgccattgcaatccaggctgggtgacagagtgagaccctgtctcaaaaaacaacaacaacaacacaaaaaacaggctgggcgtggtggctcacgcttttaatcccagcactttgggaggctgaggcgggcggatcacgaggttaggagttcgagaccagcctgcccaatatggcgaaaccctgtctctactaaaaatacaaaaattagatgggcttggtggtgggtgcctgtaatcccagctactcgggaggctgaggcaggagaatcacttgaacctgggaggtggagtttgcaatgagctgagatcacgccattgcattccagtctgggtgacagagtgagactctgtctccaaaaaaaaaaagaaaacaaaaaaacccaaatcattttccttaaaacaatcagaacattaaagataaagtctcggccgggcgcggtggctcatgcctgtaatcccagcactttgggaggccaaggtgggtggatcacgaggtcaggagatcgagatcatcctggctaaaacggtgaaaccccatctctactaaaaatacaaaaaattacccaggtgttgtggcgggcacctgtagtcccagctactcgggaggctgaggcaggagaatggcgtgaacccaggaggtggaggttgcagtgagccgagatcgcgccactgcactccagcctgggcgacagagcgagactccatctcaaaaaaaaaaaaaaaaaaaagataaagtctcctatggccagcagtgacattccctttctctcctccccagagtagccactgttcagagtttggtacatacttttctagatatttaaacagggctgggtgcagtggctggccaggtgcattgactcactcctgtaatcccagcactttgggaggccgaggcgggcgatggctcgaggtcaggaattcgagtccagcctggccaacatggtgaaaccccatctctactaaaaatacaaaaagtagctgggcgtggtggcacttgcgtgtagtcccagctactcggtggggggctgaggcaggagacttgctggaacttgggaggcagaggttgcaatgagcgagatcgcaccactgcactccagcccgggtcacagagcaagactgtctcaaaaaaacgaaaacaaaaacaaaccagtatttttacatgtaccttaagtaaccatcaatgtccatacatacacagttagctcattccttctaatcacagtttagggtccagcttacaaatataccacaccctgcttatctgtttctcctgtaaatggttgttcttgataattttttttttttttttagatggagtcttgctctgtctcccaggctggagtgcagtggtgcaatctcggttcactgcaacctctgcctcctgggttcaagcgattctcctgcctcagcctcccgggtagctgggattacaggcacacaccaccatgcctgatttttgtatttagtagagatgaggtttcaccatgttggccaggctggtcttgaactcctgacctcaggtgatccacccgcctcagcctcccaaagtgttgggattacaggggtgagccaccgcgcctggcctgttcttggtatgtttttactcttatgaaaagtgccgaggtcaggagatcgagaccatcttggctaacacggtgaaaccccgtttctactaaaaatacaaaaaatgagccgggtgtgttggcgggcgcctgtagtcccagctacttgggaggctgaggcaggagaatggcatgaacctgggaggcggagcttgcagtgagccgagatctcgccactgcactccaacctgggagacacagcgagactccgtctcaaaaaaaaaaaaaaaaaaaaaagaaaagtgccacagtggacatcctcatagttgactgtctacacatgaaagtgtttctctagacttgagtgaatcctagatgtgagattgctgggtgatagggtaggtgactttctatttcatcatactgcaaattgcctgccaatttctatgccactagtaggagtgtacatgttgcttgtctgttgggtgaagcatcctgtctccttgctgtggttgcattccctgatttccagccctctgagcagctctggctgtgtcctgcgtgctgtaccctccgcccagagaagcactgtcctccgtaagtcaggtggactctcggcctctgaagttcctgcacccgcctggtgtctttgcagcatggtcttttgctgagaataacctcgaccttctccttttcaaaagccctccagagggctttactgaccagagaggtggctagagagttggctgtgggattgaccacactgacttccccagacccatcttaagaggctggctttagattttcatcctatcccagttcttaagatgtaagttctgccctgagggcccctgggggaagccacagcttaaagctcaaatgcatttcccttgctgaaggagctgagccagccaattccccttgtgctagttcaggggttttgtctgccaatctcaaacccaggaacaagttctaagaactgggtcccttgagagacctagagtctggcagttgggtgggaagaggattgaccttggagacagtttctgtcacctacacccacctcctgagaaataacttcaagagaggaaggaccatcttggtcgaggtggtatctcacacctgtaatcccagcactttgggaagctggggtgggcagatggctcgagcccaggagtttaagaccagcttgggcaacgtggcaaaaccccatctctacaaaaaatacaaaaattagctgggcatggtggcaggtgcttgtagtctcagctactcaggaggctgaagtgggaggactgcttgagcccacgaggttgaggctgtagggagctgtgatctcatcactgtactccagcctgggtgacagagtgagaccctgtctcaaaaaaaagaaaggaccatctcatctggtcctctgcctcagttcctaccccatttactataccactgaatccttcaccatccacctgacctttatttaaattaaaataaattaaattaattaattattattattattttttgagatggagtctcgctctgttgcctaggctggagtgcagtggcgtgatctctcctcactgcacactccacctcccaggttcatgccattctcctgcctcagcctcccaagtagctgggactacaggcgcccgccaccacacctggctaatttttttttgtatttttagtagagacagggattcaccgtgttagccaggatggtctcgatctcctgaccttgtgatccacctgccttggcctcccaaagtgctgaaattacaggcatgagccactgcactctgccattaattaatttttctgagatggagtctcgctctgtcacccaggctggagtgcattggcacgatcttggctcactgcaaactccacctcacgggttcaagcgattctcctgcctcagcctcctgagtagctgggattacaggtgtgcgccaccacaccctgttaattttttgtatttttagtagagatggggtttcaccatgttggccaggatggtctcgaactcctgacctcaggtgatccgcctgcctcagcctcccacagtgctggaattacaggcgtgagccaccacaaacttgttgttaatggtcactcattgtccgtggttgtcacatctcttttgtctctttaaatacagaacagagctgggtgtggtgaactgtacttccagctattcaggaggctgaggtgggaggatcattggagcccaggagtttgaggctgcagtgagctatgatcgcaccactgcattccagcctgggtgcattccagagtgtgaccctgtctataaataaatatagaacagcagacctggcaaagttgtttagtagaacgtctcacattttggatttatctgaatgcttcctttttttattccccaacattttcctggaatagtccttgattttacggaagaaagatgaaatgagtagcttgtgtgctgacagtgaagaggaagggagacactcctgttttatctgctggggccagatttgtgccagccctgccttttccttgggtgtggttgagaggactgtgcgcagaccgcccccagccagccactggcggggtgtgttggtgcatctggcactggcggggtgtgttggtgcatctgggtgttaggaggtaggtccaggggcttctcctgggaagttgtccccatgtcgccttcggggggtgctccctgtgggagaatgagtggtgtggtcgtcccccttgcctgaagctgttattttgttccctcctgtgtttccttgccggttgggtagaggtctactatgttcactaactaggttactagtgacagaaaccttactcaaactggcttaagaaaaaaaaaaagaaaccaaaaggaaaaacaaagtccatgaaaacttttgtaattggtaagtttaaggaacctggctttggccgggtgcagtggctcacacctgtaatctcaggacttggggaggccaaggcaggcggatcacctgaggtcaggagttcaagatcatcctgaccaacatggtgagaccccatctctcttaaaaacacaaaaatcagctgggcatggtggcgggcaactgcaatcccagctcctcaaaaggctgaggtacgagaatcgcttggacctgggaggcggaggttgcagtgagctgagatcacgtcactgcactccagcctgggtgatacagcgagactcagtctcaaaaacaaaacaaaacaaaacaacaagcaaacaaaaaactggcttcaggtccagctagatccaggtgggtgagacagcatcatcggaccatctatttgtacctatctcttggctctaattcctgcatttatttcattcacaggcacctctccccacatgttataaggcagccactggcagctctagtgtgagctttgaaaatctcagtaggtatgattaagctgcttccttctatagcacctgtaaaaatttggtgttcactctgtttggactgacgaggtgtgtgcccattcctgaagcaatcgtagtggattggtgaatagagtacatgaattgaggccagtaacggtggctcacacctgtcatcccagcactttgggatgccaagacaggaggatcacttgaggccaggagttcaagaccagtgtgggcaacaaggtgagaccctgtcactacaaaaaattaaaaaattaactaagcatggtggtgcacacctgtagtcctagacacccaggaggctggggctggaggattgcttacacccaggaggttgaggctgcagtaagctatgattgcgccactgcactccagcctgggtgacagagcaagactctgtctctggaaaaaaaaaaaaaaaaagcatgaatttgaatttgaattggccaagcctgcatcgtgtacctaccccaaagctcaggctgggtaggttgagaaaggggcagccccgtataaaccacaaaaaccaacagtggtgtcagagtgctccccaggggagcatcaaggtactgtcagctagaggaaggggcctgggcacggagcaggcagaaaggcatattccgcttcgtctggtgatgggcatcgggagtctctggccgagtcagctcctcgtttcctggggctccattcctcttcattttggatttggcggaagtcagtgtccacaggaccatctgtgtcagggtgtcagccctgcttctttttttttttttttttgagatggagtctcactcagttgcccaggctggagtgcagtggcgtgaccttggctcactgcaagctctgcctcccgggttcacgccattcttctgcctcagcctcctgagtagctgggactacaggtgcctgccaccatgtccggctatttttttgtatttttagctgagacggggtttcgccgtgttagccaggatggtctcgatcccctgaccttgtgatctgtctgccttggcctcccaaagtgctgggattacaggggtgagccaccgcacccggtctcagccctgcttcttagtggctgtgtgatcctggacagaagagttagcctttctaggtttcggtttactcatctggaaaggagtatgatgttcatgttctttcttttttccttttttttttttttttttttgagacagagtctcgccttatcacccaggctggagtgcggtggtgcgatctcggctcactgcaacctccgcctcccaggttcaagcaattctcctgcctcagcctcctgagtaactgcgattacaggcgcccaccactgcatccagctaattttttgtatttttagtagaggtggggtttcaccatgttggtcaggctggtcttgaactcctgatcttgtgatccgcccgcctcggcctcccaaagtgctgggattacaggtgtgagccacggcgcccggccttgtgttccttcttgatggggctgacaggatccagtggagtggtaggtgtggaagtgcaggcagctggcgacatgctgaacccagggggtggtgtgtgctgccctgcaaggtgattcttctgctccagggtgagcagggcctgtccttggacttgctctttggagagttgggatggtgacctgtactgggatggtgacctgtactgggttgttgacccctcgggatgtgtggggtgattcttccacagatgaacatagcatggggcagaacactgtcccactgcgggaaccctttgctcattctccgagctccagatgaggaagggaggcgggtggaattggatgaattggcgcagtgattccgaaattgtaaccgggggagatgacatttggtggtaagaggacgggacacagcattccccgaaactgatccccggagagaaagctgtttattccctttgcagttctctttctgtgcagctcatcacttcaaggagaatgtctcagttaggggctaatatatgtctttaacacctttctaacatttgctaaccttccttattaacagagagagtgggtctcaagcctcaggccttgggcaggcgacagtgtttagcagactgtaataacattattcaattttcattatatttaccttttttctggtagacatttttttttaaggtttaaaaattatagaaaaggccaagtgtggtggctcaggcctgtaatcccagcacttttggaggccaaggcaggtggatcacttaaggtcagaagtttgagaccagcctggccaacatggtgaaaccctgtctctactaaaaatacaaaaattagcaggacatggtggcggacgcctgtaatcccagctgctcgggaggctgaggcaggagaatcacttgaacccaggaggcagaggttgagtgaaccagtgagccgaggtcacgccactgcactccagcctgggcaacacagtgagactctgtcttaataataaaaaaaaaaagaataaaaaataaataaaattacagaaaaattaagagtacagagagtccccataggctctataatccagttccctacaacttacattagtacgatccatttgctataattaacattagtgtggtccatttgctataattaacattaatatggtccatttgctataattaatgaacctagactgatgtatgatcattaataactgaaatgcatggtttattcagattttagagtttttccctaatgtccttttctgttccaggaaccacattacatttagttttcacagctccttagactcctcttggctgtgactgtttctcagactttgcttgtttttggcagccctgacagctttgaggcgtgcttgtcactcaatttagatttgtctcatatttttctcatgattagactgggtattggtttttgagaggatgactacccaggtatagaccaggtatagaaccatttttctttttttaattttttttgagacggagttttgctcttgttgcccaggctggagtgcaatgcgtgatctcggctcactgcaacctccgcctcctgggttcaagtgattctcctgcctcagcctccggagtagctgggattacaggcatgcgccaccacgcccagctatttttgtatttttagtagaaacggggtttcaccatgttggtcaggctggtctcaaactcccaacctcaggttcgcacccggcagaaccattttcgtcacatcctgataaccactgttgatgttggccttggtcacctggctgagatagtgttttgtcagatgtctccattgtaaagttattctttatttttaaatttttattgattgattgagatggagtctcactccatctcactccagtgtcactggagtgcggtggcgcgatctcggttcactgcgacccccacctcctggattcaagcgattctcctgcctcagcctcccgagtagctgggattacaggcgcccaccacaacacccagctaatttttgtatttttagtagaggtgggtttcaccacattggccaggctggtctcaaactcctgacctcaggtgatccgcccaccttggcctcccaaagtgttgggattacaggcgtgagccacagtgcccggctgttattctttattttcttccatccgtagtatactgttcacatctaaggagcagggcattatattttctttcttttcttttttcgctatgtttcccaggctgggctcaaactcctgggctcaacttgatctcctgccttagcctcctgagtagctgggactacaggcatgagccatcatgcctggcttatatttactttaccttctatttatgagaaatgattatatccatttatgatgtgaacataaagtcttggctgggcaccgtggctcacgcctgtaatcccagcactttgggaggctgaagtgagtggattgcttgaggccaggagttcgagaccagcctggccaatatggtgacaccctgtctctacaaaaaatacaaaaattagctgggtgtggtggcctgggcctgtagtcccagttactcaggaggctgaggtaggaggattgcttgagcccgggaggtggaggctgcagtgagccgagattgcgccactgcactccagcctgggtgacagggtgagaccctgtttaaaaaataaaaagaccggtgtggtggctcacgcctgtaattccagctgcttgggaagctgaggcaggagaatcgctcgaacctgggaggcagaggttgcagtgagccgagattgcgccactgcactccagcctgggcaagaagagctaaagtctgtctcaaaaacaaacaaacaaacaataaaaaacatgaagtctttataatattaatttataaaacatgaagtcttttcagtatttaatttaaaaattaagtccatttaaagaaaaatattaagtagagagaaaagttacaagagatatggggaattttttttttttttttttgagacggagtcttgctctgtcgcccaggctggagtgcagtggcacgaactcggctcactgcaacctccacctcccaggttcacgccattctcctgcctcagcctcctgagtagctgggactacaggcgcccgccaccacacgcggctaatttttttttgtatttttagtagagatggggtttcaccttgttagccaggatggtctcaatctcctgaccttgtgatctgcctgcctcggcctcggaaagtgctgggattacaggcgtgagccaccgtgcccggccgatttggggacattttaaaaagcaggaaagccaccctggaatggtagatgtcagagaaatgctgaaggcaggaagatgttgagagtatggtctgggaaaatggctggggctcagtgtcatctcctggcctgtttcccaaatccccttaagacaaggaacaggaagtgactgatgtagcctctgagaagtctcagacacagcgcagaggggccatggctaccccagggacgggtgtgatgactccctggggtcacggcttttcctccctcccttctctcgggctcctcctgaccccacagcattcccagcagtttctggcaggcaggtgaggagacctgggtcaggcaggctgtggcagctgcctgtgcaactggccctgtggcgtgcaagcctcaaccctctctacagctcagggtctgaaaggcggtgccaggtactgggtccttccgcccatgttatctagtttcctccacaacctgggggagtattggggtccttgtcattctcatcactcaggggaagagacctgtccaggtcaccagctggtcagggcccacgcttgggtaataggtgaatatttgacctcacacctttggatgtgaaacaagttacactcctttatttttctaaaaagtcttttaaaaatatgggctagccaggtgtgtggtggctcatgcactttgggagggcgaggcaggcaggtcacctgaggtcaggagttcgagaccagcctggccaacatggtgaaaccctgtctctaacaaaaatacaaaaattagccaggcgtggtggcacatgcctgtaatcccagctacttgggaggctgaggcaggagaattgcttgaatccgggaggcagaggttgcagtgagccgagatcgcgctactgcactccagcctgggtgacagagcgagattccgtctcaaaaaaaaaaaaaaaaaaaaaaataccacttttactaccctctaggaatggcatgaaatacagtagttttggagccctcccctccctagagttgcctaaaagccgtgggtgccctaagagagacctttgagtcgagccactgctttgacacctttccttggcaggctggtggtgtgaggctctgggtgtgagcatcctttagacgcccatctgagtttatgcctccagtgtcagggccgaaggtgggtctccatcctgagacctcgctgtcccaccctctcctcccctccagccaatccaattctgtcaagtcaaaagcctgggaaagtttttctggggcagaggaagctgaggctccagaacatggaatcctccttcttttctctctcttcctcccttccgtctttccccttcttttctttccatggtatttattgagggctagcgtagagcagacgccatcctgagtgtggggtagggcgatgactaaggtgtacacggtgtctgcctccgtggagtatacattccaccgggggctggtgtggggcaaatagacaagaaaacaagcacacagacaaatcagcaacaacaaaaaacccaaaacctcaacctggaataatacatgaagaaaacaagccagcggctaggtgcagaatcactaagggtgtgtcctgcaggtgagtggtcaaggaagccctctctgggaggcaacatgcttttgggataggtctatggtggagaaacaactcagttaatttccctttttttttttttttaatggtgtctcgctctgtcgcccaggctggagtgcagtggcgcgatctcggctcacggcaacctccacctcctgggttcaagctattttcctgcctcagcctcttgagtagctgggattacaggtgcatgccaccatgactgactacttttttgtatttttagtagagacggggtttcaccatgttagccaggctggtctcgaactcctgacctcaagtgatccacccacctcagcctcccaaagtgctgggattacaggtgtgagccaccgtgcccggcccaatttccccatttggtggttcagttacattgcatcattaataaagtctcctgcctcccactaccttgcagggtggggcggggtggggctgagatggtttccgtccaggttctccaagaaagacaagagcttcgccttcccagagtcatgctgagtgtacttcttattgctgacatggggccacgtgaaggtcactactggccttgcctgggcaacatctttccccctgtgattgggaggacgtgattggcacacttaagtcctttagttatcagctgtgatccatcatttgtgacccacagagcccctgattctgccttgtgggtacagtgagcgaggggttgggggcgggggtggaggaaatggacagaagcaaagagtttggagcgttgggtaaaaggaagatggccggcgcgcttttttttatttttatttttatttatttattttttgagacggagtcttgctgtgtcgcccaggctggagtgcagtggctcgatctcggctcactgcaagctctgcctcctgggttcacgccattctcctgcctcagcctccggagtagctgggactacaggcgcccgccaccatgcctggctaatattttgtatttttagtagagatggtgtttcgccattttaaccaggatggtcttgatcccctgacctcgtgatctgcccgcctcggcctcccaaagtgctgggattacaggcatgagccactgcgcccggccggccagcgcggtttctgaagctgctttgggacttggagggttcagagagtgggaactgaatttttttcccctaagagtagagagggagttgcttacacgaaagagctttgattacaacaggagtgatggaggctagacagctggaaggattttccttatggaaagggggtggaaaagccccagaaagcaggcctggtggaaagcttgcacattgcagacctgcagttgctcagcaggaggtttggagctcagctcccggctgggtgaagctctgggagtctgtgtcaacacctagggaagatgagctttgtgtttaccttttaggctaaaaggacttaatgtcggggtgggaaggatcattaacacatcagtgactcagagtccagaaggaaactgttgtccttccttctgtcacgaaggaaactgtcgttggctaagccaagccggaaagtctttgattacacccacaaagaggggcattttcccctggacccaacccagagttctcttcagggactgatagaggagaaagagatgaattcagacaacagggaaataaattagaatttattaggagtcgggtaaaagggtccccaacctataagttttctagttagtcaggcgtgtgagctggcaaccaacccctgccagtttctgcagtccacggggtggtccccaggaggttgaatgaaagaatcagtgtccccgcctcatctggtcccggcctgcacactgtgcctagtaccctcatccctgcacatgtatggcactgactacataagttctagcccagaggcacccagcagtgcctcagtctttttttgttgttgttttttgttttgagacggagtctcactctgttgctcacgctggagtgcagttgcatgatctcagctgactgcaacctctgcctcccgggttcaagtgattctcctgcctcagtctccagagtagctgggattacaggcgcccaccaccacgcccagctaatttttgtatttttactagagacggggtttcaccatattggccagactggtcttgaactcctgacctcaagtgatccacctgccttggcctcccaaagtgctgggattacaggcatgtaaatgcacaaatcttcattatacattttggacaaatggatccttcttccatcctgatatagaacatttctgtctgtccagaaaaatctcccacatccagaggcagccattgttctaatgtttttgtatcttagattgttttaaaacttcttatcagctgggtgtggtggctcacgcctgtaatcccagcactttgagaggctgaggcgggcggatcatgaggtcaggagttcgagaccagcctgaccaacatggtgaaaccccatttctactcaaaatacaaaaattagttgggcgtggtggtaggcgcctgtaatcccagctactctggaggctgaggcaggagaatcgcttgaaccctgtaggcgaaggttttggtgagccgaggtcgcaccactacactctaacctgggtgacagagtgaggctctgtcttaaaataaataaataaaataaaataaaataaaatttcttatcagccgggtgtggtggctcacgcctgtaattccagcactttcggaggccaaggcgggtgaattccgaggtgaggaattcgagaccagctggaccaacatggtgaaaccgagtctctactaaaaatacaaaaaattagtcgagcgtggtattgggagcctgtaatcccagctacttgggaggctgagactggagaattgcttgaacccgggaggtggaggttgtagtgagccgagattgcaccactgcactccaccctgggcaacagtgcgagactctgtctcaattgaaaaaaaaaaaaaaagttctcatcaatggaatcccgttgaagcattttaagcattttttggtgtctggcttctttcacttagatcttgcttttgaggtgcttccttgttgttgcatgtgtccatgttttgttcccctttattattgggtcgtattccaccgcggggatgtaccacagcttgttgatggacacttgggctgctttccgactttggcggtttgttttgttttgttttgtttttgagatggaatctcactctgtcactcaggctggactgcagtggtgcaatctcggctcactgcaacctccgcctcccaggttcaagtgattctcctgccttagcctcccgagtagctgggattacaggcatgagccaccatgcctggccaactttggctattttgaataaaatggtgatgaacattgtcatgcaagtctttgtgtagagcatgcatgttcactgaatccttgcagtagctaataggttggcactgttgttattcccattttacagatgaagacactgaggcacagagggggtgaattcctagtccaaggccgcatgcatagtaaaagctgggggtaggattctaacccaggttcgtctgactgcagcatatgtatttttattccctcactgtagtgtctttgcaccacagctgtttggggccattaagcctagggacaagtgggcatctcctctcaatggcctgtcaattcctaactgcattttagctcacaatagtagttgataataatggtagtgttgataataatggatttgagtcaccacaaaaagattccatcaaacctgcctttatttttatctgtttatttttgagacggagtcttgctctgtcgcccaggttggagtgcagtggcgcgatctcggctcactgcaacctccacctccctggttcacgcgattctcctgcctcagcctcccgagtagctgggattacaggcgcccgccacgttgcctggctaatttttgtattttgagtagagacggggtttcaccatgttggccagactggtctcgaactcctgacctcgtgatccacccgcctcagcctcccaaagtgctgggattgcaggtgtgagccaccgcgcccggcatcaaacctgtctttaaaggacaacagcatttggaggcgtttgagagaaatctctagctagggtcattacagtaactaacagcaagcaaggaagcaaacaaaaagtcttgctacccaaagccctagtcgcctggaaatctcacatagttgtaattcgtcatctcccagagaagccaggcacagaaggcgttactggatatataaaatagtatataaataatacatgtataagaaaccactctgttctctgtagagccaaacagaatagggttttggagagtctgctggttctcgctttgaaagatgttgctaagcaatgttgctaatattatggaaagacagcttccctcccggcttttccactcagcctcagaaactctggaagaggtggaagtggcttcaggagtagcagcagctggggaggtttggtaatcagtgaggcgggggccgggggaccttgggttggagagggactgtgctgtaggccacccagccctcagcctcatccgctcctgattctctgtactgactcctgggcggcctctatgcaaaataacacctcttcctgttcgtcagaaatttcacacacagaaggatccttttgaattttttcactgtgggaaaaattactgtagtcatgcagcttagcaaaaattcaaaaatccataaatgaacttcaaaaaaggaagtattttaaataacttcagtaacccaagtgatatatgaagaacttctttattcctccctctacccactctccataatccctgaacaggaagtcggcagggttctgattgacatcacgtactgcaggccccaccttcatggctctgggtaccagagcgcagggtgcccgccactgagtgggatctgtgggtttcctcagcgtggtttcctttccttggagcttggaaatgccacacaagtcacagagatccgtttccaaaacctgagccagtttagatcctctgcttaatatgacgtctgtggccccaggaaagttgggctgagctgaggtttcccaggcttgtctttgaggcctccgagtcctggcctgcgtttatcacggaacgaccctattgtggtgggatggacctcttgggggctggtcatgggttctgtgaggggattttagaagctgggaggagagtcagtatgttggcagagagttttcctgcatctctctcttttccttctttttttttttttaattagttatttatttatgagatagagtcttgctctgttccccaggctggagtgcagtggcacgatctcagctcactacaacctccgcctctgggctccagcaattctccttcctcagcctcccgagtaactggtattccaagcgcccgccaccacgcctggatgattttcgtatttttagtagagacggggtttcaccatgttggccaggctggtctcgaactcctggcctcaagtgattcgcctgccacggccttccaaagtgttgggattacaggcgtgagccaccgcacccggcccagctctcacttttcaaaaatagaaactgcttcccgacctcagatgacttcaatctttcccttcccccgacgccttcctgcctccctcttccccctcctctgtcttcctcctaagggggcatcccagagacgcaactgtgctgtggcccagcagggggcgctgatgtacctgccaagagtggaggtgtcttagcacaggtgtgagcgttcagctgtgtgcgagcgggcttcagagtgatatcccagagcaggtgtgtgtatgtgtgtaccctcaaaggcagaagagagcgggggtgctggaccgtcctgtccaaggctctgtttataacccttgcgttgtcccaaaggttgtgtggtccatggaatagctgggaccctgcccgtggaggggaggggcaaggcgtttgaagacatctggttttcatcaaaggccccaccctccttgctccatggcccccctcgcccccacccacccccaatcccagcccagaacggtggcagtcattctgcccagcagtggggcgctgggagttggtggctgggtggggcgacgaggtggcgtctgctgcaggctggctctctgacgaggggcacggggattggggctgattcccgctttctcatggatatgtctcctggagccggttcccaggcacagaaggcccttttcttcagggccaggcatgcgtgtctgtctgcctcaacccactggcccctcaggaacgggctgtgcagctgtctgcgctctgttcatgattaacttcgctgtctcccgccccaggcctgattcccacccaggccccctcagcctttggagttcccctggactggaagagagacctgggctggcagctgccgggcactttgttctctgggactgtgagctttggaggctggaacaggccatggaggtcctgagagctgggacgccgtggggcataagttgggtgaggtgagacctgcaggaagaccccttctctgccgtcagagacttctgccgtcctcatttcctgcggtctgcatgtatccagctttctcagcccaccccaaagtgcctcatgaatgtggccttggagcagagtaatgtgaaaattcttccctgtccgttctctttcgaactgtgatttcttcaagaacagtgccttggtttggcgcaggtgtgtcactaacacctaacactgcctgctttttttttttttttttttgagatggagtctcgctctgttgcccaggctggagtgcagtggtgtgatctcggttcactgcaacctctgcctcccgggttcatgccattcccctgcctcagcctcccgagtagctgggattacaggcacccgccaccacgcccggctaattttttgtatttttagtagagacggggtttcaccatgttagccaggatggtctcgatctcctgacctcatgatccgcccgcctcggcctcccaaagtgctgggattacaggcgtgagccactgcgcctggcccgcctgcttttttaaggaaggtacttcaagcttagagcctttgtcaggcaacagtattgaggcagaacttaataaatttatgtttgttttcatggtaggaagggcaagtgataatggattttcatttagggttgcaataacgttttcttttaaaattaagtaaaggcagccgggcgctgtggctcatgcctgtaatcccagcactttgggaggccaagatgggcggatcacgaggtcaggagatcgagaccatcctggctaacacggtgaaaccccgtctctactaaaaatacaaaaaaaactagccgggcatggtggcgggcgcctgtaatcccagctactcgggaggctgaggcaggggaatggcatgaacccggttggcggaagttgcagtgagccaagatcttgccactgcactccagcctgagggatggagcaagactccacctcaaaaaaaaaaaaaaaaaaaaattaagtaaaggccaggcgcgatggctcacacctgtaatcccagaacttgggaggccaaggcaggcggatcacctgaggtcaggagttcgagatcagcctggccaacatggcgaaaccccgtctctactaaaaatacaaaattagcccgatgtggtggcgaatgccggtagtcccagctactcaggaggctgagccaggagaatcgcttgaacccaggaggtggaggttgcagtgagccaagaccgtgccattgcactccagcctgggcgacgagcaaaacaacgtctcaagaaaaaaaaaaaaaaaagtgaaaaagtaagttgatgtaattaaagcaaaattataaacagcagagcagcatgacactaagacaaagaattatgaaggaggtggcgtgtggcccaattgtgggaagctttggctgggctaactgcacacactggctggaaatggtcttcttttgaggtttggagtgtgttaaccctgtttgtttcgggcagggatggtcttccatttttctttcttgccctggtctcttgcataaagctggacatactgtacatgtttaataaatgctggtggaatgggtaagcctagcattgatggttgttccagtctctgctattgatgggttttcttgtgctttggggtcccctctgtggggtgtgggtgtgatgggctgtgggggctggagtgggagttaagaggggaaattgctgtttatgcaccaaaggtggcgagcttgtagggcaggggcagaaggatgggacctctcactgccaggaaaattctacctcttagagactcaggagtcaggggctgagaggttacgattttttgggggacagccttgtgtttgcagtgacactgggcttgtagaaggacttagagggctgggaaccccagaataagagaatgaataatggaacctgcatggtggattttgtgccttcatcatcccaattccctgttgtagttgtttggagaggtggggtctcactatgttgcccaggctggtctagaactcctggtctcaactcaagtgatccacctgcctgcctcggccttccaaagtgctgggattacaggtgtgagccaccctgttacccactgtgcacttgacctgaactagctcccacactctcacctgctgggaaggaggatcaggccttccgttgaggtgcagccttctgtgtgtgggtaaaatacacccaacgctaggatagacctaagccagcgccctcatcaccttccctgccatctaactgaagcggtccatcagctaacctgtgggtcctcgggtgctgtgtgctatagcgcggtgggagagaggggaagagaagctctgggttgcatgctgctgggagctcttcccttttctctaccaaggacactcattttattctttttccagaccaattcttaagtcactactggcatagtacttgcagcctgcctaaccgccaatctcaggagtggggcccgggtcattcaaatctctagctataaaaagatgtccatggctatctatatctctgatcccccacaaccccggcagggagggggtgggggtgggggtggggggcacaaggccagtggtaacggctgcttcataaatagaccaggtgcatttaagaaccaccctggggcttcctcccctccaccccaactccagtgccagcaggaagctgtgggcattggagaggcagggctgaagcctcaggccctcgaattcgtttgcagtccctctcccctctccacccagcatggtcccctccctgcctggattttctgtgtttgcttgaacaccagactattaaaaacaaaacaaaaaacaaaacaacaacaaaaaacaaggcaaattgcctcagggggaacctcttcggccccaaagatggactaattggcttgttctaattcctttcagccccctgcccacttccttttccctagaggggcaaagctgtgagtgatgcttcggaggggtgaggcgggagggggctgggaggctgggcagcacctggaagtggatgagggcgattgtgagcgaggccccgcgccgatggtagggaccaggccacagccctttccccaggagccggcgcgaccttccgaccttccgaccttccgcccttcctttccgaaggagatgaggctcgcgcgcggctggcaggggcgggagggaccacgcgacgagtgcgcagcggccaggcccgggtgggcgcggggagggcggagtggggggcgcccggcccgccaggaggaagcggggtcgccgtgaagttggttattgaacccatgtggagtcaaactcccagggccgggagagccagtgttcgcggggagccgaccccagcccactctgcatcccagctcggcgatccttgcgccgactctgcggggaggcgggggcagaattccgcctcgttcctcccatccgcaagctcccacccggggacccgggcccgggagctgcgagccggggcgggcgccgggctcaggtgccccctgtaagcgctgggcggccgggaggggacggggaccgcgcgcgggcagtttcgtttggacggaggaggacgcgcgtttcctcttggtgcctgttttctctccctctgttttaaaagcagtgacagcatcggggaagtatccggggccgggccggggagggcggcagccgcctctgcctggggagggagctcggggccgccggcgggagtgcgggcggggaccagaaggagcgggcgaggggaggcagggccggggccggggagggcgcctgggagccgggcaggggggtcccgggagcgctgtccgcctcctcctgcgcttcgcccgctccctgtgccccgcgtcctccaccatccgggcggccgaggccggggcgcgggaggcggggccggggcgggtcccggcgcgggcggcgcgtctgagcgggagccgggagccgccggcccgggccgcgccccgagcgagcctcggaaatgcccgcgccgggggagcggacggcggctgccccgcgggccccgaggagacgctgaaggtcgccgggagggaggggagagcgcgcggtcacctgacccccggggcgcacctaggcggggcggggcccatgcgaggcggaggccgggggccggggcgcgggctcaggggccgggtgcggagcgcgcggagccggggctgcggggacgcgggcgggcgaggtcgggcaccgcgggcggcctcgccatgtcccagcccgcggggaggaggcattgccgaaaggcggggatccgcgccgccgtggtgctcatcggactcctgcacaaatcccggaggcagaataaagagaaaaggtaaacccctgcagcgccggccgcttccctccgctctcctgctgcatgccagttttctttggggtggacttttccgatgggtgtttggttccgtgttggttagaaaaaagcctcctctccaggtaccgtcgtgcgaaccgagttcggagcttcgccccggaccctggctggtgcgaggagcctgggcaggaccttggcggaatcggagggccgctgggagggcgcatcggggtggatccctgacggagggaccccaagtccgtcgcccccagaccctttgcagaccgcgaccccgttccccaagcctgcagccgcggatgccattgatccagcccaggcggctccatgcgccggtgttgccatttgcttcctgcaacttggctgagccctcgaggtgcctgcctggccgagatccgcttgctctgcgctcggtgccggcaggcgaggagcaagtttggaggttgttcgctccccacccaccctctcgccccaccgccatagggtgactttgcctcttcgcctttctggcgtttgttctttcgtttgctcctggatattgaaaatagttttctttagctatttcagagacattttggacgacctgtgtggtgggaggtgtggggtttggagtaggcaaaggaggttctgaggaagctttctaggctgcaaccgcagctgcaggtctgacatccaccagaccccaaggagctaccaggcaggtcgttggcacaaagcctccctgttctgctagggtgcatggcagagcctccagcaatggggggaggggagtgcggaagctgactgcccacagagatgttgccgggatcaggatttggggtagcttccagtgaccctgctggatcctagtttccagaggagttttggaatggttaataccgcaccctataagacacgggcagtggaaccagagacacctgggggtgaccagcagcccctggatatgcccacaggtatgaacgtacctggggtggtggtaggcagggaatacgggggactttgagaagctggcatggattgcccttgtggtgggttgtcccccattcctctcgtccccccttcctataatgtgtgtaacaagatgttgcccgctgcacagaatgaatttcccgtgaaaatgacataaggtggttcagcatgaaataacattgagtcacctagtgagaaagttcttcccttttcagttctctgcgaatccttgtgatttctttgaggggaagtttcaggtggatgctagtctgcctttaacacattttaaacacttgctaatcttccttttgtaattaagagagagcagacctccggctcccggtcctctgagtggggaacagttgcctggctagaacttaggttgtttttgtttttgtttcatttatttttaggattctctcctggttaatggccagtggtactgatgtttttccatttgtggtagtgatataaaacatctctttaaacatatgaagtcacaagaattaatctattttatttatttatttatttatttttgaggaggagtctcactctgttagcccaagctggagtacagtggcgccatctcggcccactgcaacctccacctcctgggctcaaacaattctcgggcctcagcctccggagtagctgggactacaagtacccaccaccacgcccagctaattttttgtattttagtagagacgggggtttcaccatgttgcccagggtggtctcaaactcctgagctcaggcgatccacctgcctcggcctctcaaagtgctgggattacaggcatgagccaccgtgcccggctgaagtgaatctatttaatagaaatagtagtaataataatacaagtgttaacaaatatagtggaaatcctgcaagtggtctaggaatggctgatgccagcgacatgtgtgtctagcagaagaagctgccatgggaactctggagtgcaatgttccagggcctgagtccatcttcccctggacttggattcccttctgttttctgcccttcagcattttatctgtagagtggtggtgaacaggtcaactctgagacagcctgggcctgctttgagggctggaatggaaaatgggcttgatagaaaggcagatgcgtgggaccaattcctgattctgagtatagaatgggtggtggttggggggtggagaggaaaagccccctgcacagagagcgagaagttctcttcctggctcatctgttgactgtggtgtgatggtagatttcatctctgggaacctcggtttctgcctcaccacaaagggctgtgaggctcaagtcagatcatgtgagtggagacaggacagaaaggtacaaagtgctgcataaaggtaacgggggtttgatcggaactgttccccctcttctctccctgagcctgtgctcctggtgaccaaggtcagatgtccggtggtgacagccccaccagtagcagtcaagaccagccatgcatgggccaagggggcagccaggtgggtttgagcctgggcagaactagtctgtgggtggtgggggcaggtgcagtgaggcccagggaaggacccggatagggacagggagggattggctgggacccgggtaccccaggcccatggagtcctttatttcttcctgagtgcactgtgctcttaagagcctgcaatgcaggcagacattggtggccttcctagcccctggcttcatcccgttcttctgtcgctccaaccatcctggtggctttggccatggacttaacctacccaaggagaaagagtgattgatttcatcatggtgctaagtgacctttgcttccctctctgtatctggagtttctttgtctctttaagcgtctgaaatgagtgcagcaagcactattgacccttgctctgcaggtgctggtggccacgggaggcctggagcaggctgcagctgccagcctctcttaagcatcccccatactccatgctgggcgttacatttgatgagctcttccttccaccacctctcatcacaaggtggggtcaggctcaggccccttcttctcctcccagaaggcttgatccatccatcgatcttcccagcacctgtaattgacaggcttgtgcagataacactgttggctcttagccttaagggttgaaatggttgtgtgtggcttgcagggaccacccagtggtctttttcatcctcctgctctctccaggccacttggaaatattgcgtattaggggacagggaggtgtgccagccagggtagtcatgagacagatgtcccatatagtcccagaactaggagactcccagctagtcttggtagttcccaagaactgtgctccaggctccaacttcaatttccgttttcgagaaatgggcgtggtgatcatcatgttggacttgaccgtgctctacgggagctgtggggcagcctggaggttatgcctttttctgcccatctttcagggtttctggcacatgggatcctgtaaaagcagtggcgtgtctgagaggggattgggtttgagtatggctcccaggagacacctggatgaagccttcctcagagactgcggtttggaaaccactttgattttcagagcctgcttcttatggatgtgggtagtggggagcttggctccctgagggggaaaacaggcagctttgctgggaaggacggaggccgaggaacacgatcaaaatatgtacgttcttggccgggcgcggcagctcacgcctgtaatcccagcactttgggaggccgaggtgggtggaccacctgaggtcaggagttgaaaaccaccctggccaacatggcaaaaacccatctctactaaaaatgcaaaaagtagctgggtgtggtggcgtgcacctgtaatcccagctattcaggaggctgaggcaggacaactgcttgaacccgggaggctgaggttgcagtgagctgagattgtgccactgcactctagcctgggcaacacagcgagactctgtctcaaaaaaaaggtacgttctgaaagatgtggataaagtcactgtggccttgggtgtgactttctgaactggagagaggtcatttagcataaatgaaaacaagtccacttcttatggtgggtagttattttgagacagctcccatcatggagtttatgaggaggaagatatggattctctcatcatttagcaaattctggcaggctgtcaggggagagctcgaatctgatgaatgtgatccctttgttgtggagtatcatacctggtgggttattcctgggtagaaaaagcctatcgcaattcttgtttaaaaaaattttgttgtgaaaattctcaagcatacacaaaagtagagagaatagggtaacataatacctactttcagccattatcaacttacggccccaatcttgtttcatttatgtaccaatgcactcctccacaagattatttttttgaagtaaatctcaggtactagatcatttcattcttaaatatttcaatttgtatcttaaagataagaattcttggccaggcacggtggctcacgcctgtaatctcagcacgttgggaggccaaggtgggaggatcaccactggagcccaggagttcgagaccagcctgggcaatatagtgagactcatctctacaaaaaaaataaaaaaacatagctgagcatggtggcatgtgcctttggtcccagctactcgggaggctgaggcatgagagttgcttgaacccagaggcagaggttgcagagagctgagatagagccattgcactccagcctgggcaacaggaaaaaaaaagttaagaattcttaaaaaaacccccgtaacactaccgttattataccctctaaattaacagtgatttcttaataccatatttagtcagtatttgaatttccccagttgtctcgtaaaagttttcaaaagtttttttgagtcagaattcaaacaatactatgtgatgggtgatgtgtctcttaatctgtattttcctccaactcttttttttttttttttttttgagacagagtcttgctctgtcacccaggctggagtgcagtggcacgatctcggctcactgcaacctctgcctcctggtttcaagccattctcgggcctcaacctctcaagtagctgggattacaggcgcctgtcactacggccggctaatttttgtatttttagtagagatggggttttaccatgttggccaggctggtctcgaactcctggccttaagtgatccacctaccttggcctcccaaagtgctggaattataggatacatgagccaccctgcttggccctttcaactcttttaaaaaaattttaatttaatttttttggagatgtggtctcactctgccacccagggtggagtgcagtggtatgatcttggcttactgcaacttccgcctcctgggctcgagtgattctcccacctcagcctcccaagtagctgggactacaggtgtccgtcacaacacccagctaatttttgtactttttgtagagatggggtttcgtcatgttgcccaggctggtctcgaactcctggactcaagtgatctgcccacctcggccttccaatgtgttgggattataggtgtgagccgctgtgcatggcccacccaactctttttttcttacaatttatttattgaagaaactggactgtttgtcttgtggagtttcccacagtcaggattttgtggatggcatctcctggtgttatttaacatgttctgctgtcccctgtgttacctgtaagttggtatttagttctagaggcaccatcagatttgttttttgttgttgattgtttgttttttttttttggcaagatcgtgccattagtaattgtgtagttgtctctttttgcgacgttagtcattgttgattgatttgtttctagggtgtgaacctggtatcgggagattacctgtgtcctgccattgcaggcagccccatgagctggctggacatgaggactgtgcctggggtttgtccagaattctggccttgcagtcccagagtcccagagctggaaggggcatgagacaggagccgatccactccctggtcccagaacagatggctgcttgttctctccttaggaggcagctgggtcctgccctttctggaagggcctgtctcctgtcctcttctgtctgatgtttgaatgacacccggtgggctgtcgttgctttaaagaacaaacacctccctttagccagcttcccactattcacttcaccaaaggtctgaggccttagaccattcgagttgaagggacagaatgtgaggtgcaaatgagtttaattcctcctgagccactattttaatctcctgcttggtctcctggcttctagtctcccttatcctctctccttatggtggccagagtggagtttaaaacattcaaatagaaccaggtctctctcctgtggaaagctctccatagactttccattatacttatttatctttttttttttttttttttttttttttgagacagcatcttgctctgtcacccattctggagtgcagtggcgcgatctcagctcactgcagcctccgcctcctgggttcaagcgattctcctgcctcagtctcccaagtagctgggattacaggcacgcactaccgtgcctgggtaatttttttgtattttcagtagagatggggtttcaccatgttggccaggctggtcttgaactcctggcctcaagtgatcctcctacctcagtctcccaaactgttggaattacaggtgtgagtcaccgcgcctggccgactttccgttatactttaaatgaaatcccaactccatagtccggcccacaccccctgcctgcttctgtgacctcacctcccaacttgtcgtcctttcctcctggtgatcaccatgattctgttgcggaggcctcctttccacacttggaacatggcaggctcgcccctgccacaggccctttgcacctgctgtttacagtgagctcattggctggtgcttcctcatccccggactcttcactcacatggcatctctttcaaaaggcctcccctgacgatccaatctaagcagctccctccagtcattactgctttaccctgctgtatttcctccatggtactcctcatttactgatcgtatctagtgtgtgcaataaatagttgattggctgtttcctcccctagaatggaaactgtttcagagcgggaactttgccttctttacctctgggtctccattgcccagaataggagatgctcagtaaatatttgctgagtgaatggatggaagcccaagaggcctcctggctcccctaagtagaacgtgcccattgcctgtttctctggggtcttttttttttttttttgagacagagtctcgcccaggctggagtgcaatggcgtgatctgggttcactgcaacctctgccttccaggttcaagcgattctcctacctcagcctcccaagtagctgggattactggtacccaccaccatgcccagctaatttttgtattttttttggggggggggacggagtctcgctctgtcgcccaggctggagtgcagtggcgcgatcacagctcgctgcaagctccgcctcccaggttcatgccattctcctgcctcagcctgggccctcctcccgtgctgagtagctgggactacaggtgcccgccaccatgcccggctaattttttgtatttttagtagagacggggtttcaccatgttggccaggctgctctcgaactcctgaccccaggtgatccacccaccttggcttcccaaagtgctgggattacagacgtgagcctccatgcctggctccctggggcccttttaatactcagcgccctttcttttgtctgagattggggactgtctcccttctctctcctttctttccttctggaagagattttgtagagaattgcaaatgatcacttgcccgtgtgtagctctgtcattatgccttgcctctgcatagctttgggacccgtagacgtgagagggaccaggctcagccatgaccgtcctgaagctggggccaggagccagggctcttcttgacactgcgttcctaagtcttgggtcctggaactgccgcctgattggcagaggcagcctcccttcatttatgccaaagaggggcagtgggcgtctgaattagtggacagtcgccattagccaatatatatatttttctaaatgcagttttatctctttggagcttgtgtggtgcacagatggctgcttaccaggatgttgccaaatagagggcttgtcaggcctgttcggtgaaatcaacgaaaagcacttctgttcagacgggggctgctgaagggcccaggaagtctctcagtcattttaagcagatgaagcacccccacgccccccaactccctgcccctcaacaaactcagtttctttgcctactgaatccataaaaagtaagtgaggtaggcaagatgatttcaggtggacaagtgctttttattttaatagctactttaagaaatgaatcctggcaagtgatactggttttccatgtatgatagttatataacgttagaaaacccgaatatgggctgtgcacagtggctcacgcctgtaattccagcactttgggaggccaaggcgggcggatcactcaaggctgggagttcgagaccagcctggccaacgtggcgaaaccccgtctctactaaaaataaaaaattagctgggcgtggtggcgtgcgcctgtaatctcaactacttgggaggctgaggcaggagaattgcttgaacttgggaggcagaggttgcagtgagccgagattgcaccactgaactccagcctgggtgacaaagccagactctgtctcaaaaaaaaaaaaaaaaaaaaaaaaagtaaagtcaggcccatcactttagggattccactaagagtgtctgggtggtgcccggggtaccctttatacccatggcagaaggaagaacatggctggtatttcataagctgagatttctgagtgcgggggtcctggttgaaccctgaagagggtctcgaagaatccaagctcatttctaggggtgagtacacttgatcaaccttcccttctccttccaggcagactagtgggaacctggagcagacgctgtgtttattcagtgcccttggagcaagggtggattgaaaaattgtcacttgcttttaagcttatcagttatgaacactgtatttcatgaaggctggagctccagccaagtcctttccagagtcctccagggctgggcagcctggctgggagctggggacgcctctggagacatgtcggccccatgtgtgtcctgagacagctgaccttgccttatggttagtccatttctccaaaggcaggagttgcggggggcctgtggatgagagccacctcctcccttctttctccctcttctgcctttttctctttctctactgtaaagatctttatcagtcacactgaatgctgtgtggcaggatcagggcactgtgatgatacctgttgtcaagagggcttactctggagggtaaagcaacttgtaagaaccccataagggaggcatctctcttgtctttggttgatggatggggctgagttaagagtctagtaagagtggaggtagggccgggcacggtggctcacaccagtaatcccagcgccttgggaggccaaggcaggcggatcacctgaggtcgggagttcgagaccagccaacatggtgaaactccgtctctactaaaaatacaaaaattagccaggcgtggtggtgggtgcctgtaatcccagctactcaggaagctgagacaggagaatcgcttgaacccgggaggcggaggttgcagtgagccgagatcgcgccactgcactccatcctgggccacaagagtgaaactctgtccccctcaaaaaaaaaaaacagtggcggcgggagcccccggttcctcaccgtcttgtcccgtacgtagcagcatgccatcctgactgcggagagtgcagacagcagcagccctgccacctaggagcttgcagtctgaggcggaggtggggagtgggcccctgcagactcctcatatggttaggaagcctgtcctctggaccagacacagtcctaggtgctgaggacgcagcagtgggcagcagagaagcaaagccctgtctggctggagcgtccatgcctgatgggtgttattctgcccacatactttgttttttcctttggagctgatattttagaattggaagattccacattgtgaatctgtttttcagtcttgagaaatcagaagctctgggaacactggctggactggccttccctcattacacctcaacttctagctacctgatcagtacagggctggtagcctcctgctcactgcagcccacctacacctggccacacctttgctacctgccccttccctgaaggacgggacgtacggtgtggggagcaggaggctgggggttgggagctctgggtgtaaccctgtgaacacagaggctgggggttgcatcccagtcctgtgcgtcctttgggacttcttggtcttggcagatccattgcgatgagaaaggaggggtcccggcagcctagcggggcgccctgtgggagctgggctgcagaatggccactgtggatttgccttcaagtattcctcctccctccccctcctgaattacctccaaacaaaatgacagaagttatgggaggctgcgcgtcgcagtacagaaactcaggaataacgtgagaagggacagagacagaaacactcgtggatccccgctctgggcctgcacctgcctggtacttatgcttcacttacctcatttcattctctgcatgacactgatgatcattatcttcattcttcatagaggagaaagctgaggttcaaaagggatggcgtctccaatgtcacctagctcgtataacagagctgggattccaatctgtctggtgccaaattctatgctttttctcccaccaccaattatatggtgaccctggctgaggtacttaacacccccgtgctacagtccaatgaagtagattgaagtgcagctcagagagaccaggtgtcctggtcaagactccaaaactctgttttgggtctcctgttaaggagttaagaactctggcaccctagaacattctggttgtttttaaaggaagggatcagatgggtctctggaacagctgggcttcttttgaatgcttagcctgagctaaggggagggtggagcctagagcagggaaaggtctgtcctgtcaggtgtcagataagctgaaaggtctcctggctgctggcctcactaatgagaacagaaattctcacttctcgatatgaactggaaggtcccggctgcagcctgggttacctgtgccatctgtattttaatagaacgtctattttaataagatctttgagatgcacagacagaaacagcatgtaaatcaataggtcactgaaacaggccatctgaaaacgagatctgcaaatgtgccaggaagggcttttgagagtgacagcaataaatgccccttgtggatggccagaaggtcccccaagggtatggccacatggaggcaggactcagccgtggtgcaagtgatgggaaccgagatgcctggcttccacattgcagctcctctgacccccagcccccttctagaaagggctgccagccctcttggtggcatctgcccctctctttcccctccatgaatgcaaatgcaagctgcagtccctccttaaatggattgtgtcccaaacgttcattcactcattcagttcacctccatcaatatgcgggtgccctccctgcctccagcagcccatgctcctgaagcagagatcaaccatggaatgtgaatccaagacagaagagggaggtgtggagaagaggtgcagggagccctggaggtcagaagaaagggggaccgcccaaggaaggctgcctggagttggtggcatttgaagtgggcctcggggactggacaggatgtctgaagggagagatggagtgggaagcacatccccaaaggagacagtggaagacaaggggccaagataaaaaaacaggggcccgctcagatcccaccttggctgtggtgtggattccctgctggggaacgtgggagatgaggctgttagggcggcctggggccatttcgtgttaggtgttgaatgctggggaaagaagggcaggtcaggctgtgggaggcttccctgctccccgcctcccctagactcagggcagttggtaccccagttagaatacaaaaacagagtcagtcagtgttatacatgaaacaattctgtaacatttgtgttattgtgatttttattaaatagaggtttggggcccaagggcctttgtgttggtgaggcagtagataatacccccaaatgtcccttctgattggtaatttattttatttatttattttattttattattttttgaggcagcatctccctctgtcgccaggctggagtgcagtggtgcgatctcggctcactgcagcctccgcctcccgggttcaagcgattctcctgtctcagcctcccgagtagctgggattacaggtgtccgccaccaggtccggctaatttttatgtttttagtagagatggggtttcaccacgttggccgggctggtctcgaactcctggcctcaagcgatctgcctgtcttggcctcccaaagtgctgggattacaggtgtgagccactgcactcggcctattttattttttattttagagatggagtctcactctgtcacccaggctggagtgcagtggtacaatctcggctcactgcaacctccacctctcaggttcgaatgattcttctgcctcattctcccaagtagctgggattacaggtgcccactgtcatgtctagctaatttttgtatttgtagtagagacggggtttcaccatgttggccaggctggtctcgaactcctggtgtcgtgattcccctcaccttggcctcccaaagtgctgggattacaggtgtgagccaccgtgcctggcctctgattggtcatttagctgatttagtcaagaaacttttggtttgaagtggcaagccccaattcaaattaatgtaaagaaaaaatgaagctttggggtttaggtaactggaaggttcaagggggacggattcaggcctggctggatcgagagctccagtggggtctttggacactggttctttcaccccgtctctaggctgtgccttcctttgggttgccttcgtcctcaggtaccttatccacgaagatggacgatggctgccctgggctgaccttctacccacttagcaataccaacaggaagagcaaatctgtttcccaatcatttcagcagatgtcccagggatggctcaccctggacagaaagtgagtcacatacgcatccctgaactttggccagaggggtgggatacactgattcatgaagtctaggtcttacgcccaccgctggttcccgggatgcagggacttggctgggagtataggagggatgggtcacctaaggaaacctggcatgttgctctcagaagctcaggggatggaagctgggcagtaaaaatgccaacagctgtccactctgctggccctagtggcttagttgatgctgatcttggcacggtcttgtcaacttggctggtggctgcagctgctggtaccctcccagacgcaaggaggcttccttctgccttggctggatgaggtgtgctttcttcttcacggatgcagctcgcgggatccccaagcctttggtagtaaacacacttcctgggctgtcttttctctgagtccattctgaacatcaaagcattcagcctgtgaccgcgctggacctggtctgagaggacagcctggctttgctcggggttggctctcggctctgggattggataatgtgtccccttcctgttttgcttatgctttgtggcacccagctgccctccaccccagcaggtccggattccttgaatacagattgcccctccttccagacgtctggccagtggatgcttttggttacgaggccctggctgagagaagggctggctctctgctatccatccccctggtggagggccaggcccagaggaagtctcagaggtcttagagataggcacctctagatggcaaaaacacgactgcagaagggcagaggagcggcctcaggaaaaacccagggggatatatgatcttgaacgtacatggtgtcgaaactgcggcccttggctttcccatgtgtgaaatgcgactaagactaatgaaagtcttttatgtgtgtaggcaaaaatcttatttagcaattcctctaccaggtgcaatttttttttttttttttttgagatggagtcttgctctgtcacccaggctggagtgcagtggcacgatctcagctcagtgcaagctccacctcccaggttcaagctattctcttgcctcagcctctcgagtagctgggattacaggcatgtgccactacgcctgtctaatttctgtattttttagtagagacagggtctcaccatgttggccaggctggtctcgaactcctgacctcaggtgatctgcctgccttggcctcccaaaattctgggattacaggtgtgagccactgtgcccggccagaacagatagtgtttaattccactttgtctgtgtctgtttgagctgctatcacaaaataccatagactgagtggcttaaaccaacatttacttctcccacttctggaagctggaaagtccaagttcagggtactggcagatggggtgtctcatgagggctcaaatcctgcatcacagacaaccgtcttctcgccatgttctcacatagcgaaggggcaagggagctctcaggggcctcttttccaaggcactgattccattcatgagggcttcactcctcctgacccaatcacctcccaaaggcccctcttcctcataccacggcagtgttagttaggatttcaacacagaaattttaaggggtgcacaaatatagtctatagtctatctactcttatagtgtatagtatgcttatatgaggcacctagaataggcaaattcctaggggcagaaagtagaatagaggttgccaggtgttggagggaaagagaatttttgttgaatgtgtacaaagttcctgttcgggatgatgataaagttctggaaatggacaatggggttagttgtacaacgatgtaaatgccactgaattgcaaacttaaaaaggggtaaaatgatgaaaaaaaaaaaacctaaacaaactttatgcaaaaccttaatatgtacaatagaaaaagcgttcctctggttgaagatggggtgggctggctggtggttctcgcctggtctctgtgaatgctcagctgagttgggaaccaaagtgccttggggactccagggaagcagcagccctcccttccccaacagcccacgttctgaagttgaaggtccctcagggctctgtcctgcccaagctcacacccccactgagggtcacgtgttgctggggaaggtcaggtcccgggagcaggtgcgggcagcgctgggccaccttctgcgagctcccttctcatcctgacatttccctttcctgcagtcttgggctcatggccagccgtcagccagcaccctgtggcgctctcctaggaggctgatctggtgagcggggacgtatagggggtcagcaagtggcccaggtggaacgtggctccgggccacgtgagtggagggcttgagttttgtgaccacaatgtggatgccctctgtgacctgctggcctgctttgagatgggcagcagctactccagggtgcgttgacctgcagagcaggcctcaggggtgggaatctgtatggcccctgaccccggcatggcctcagaaccttcctcagagtgcactctgtgctgctgcttgacaatctttttttttttttttggagatggagtctcgcactgtcacccgggctggaatgcaatggtgcaatctcggctcactgtaacctccctcccaagttcaagtgattctccttgccttagcctcccgagtagctgggattacaggcgcccaccaccacacctggctaatttttttgtatttttagtaaatacggggttttactatgttggccaggctggtctcaaactcttgacctcgtgatctgcctgcctcgtcctcccaaagtgctgggattacaggcatgagccaccgtgccctgcctgacaatctggtttttgaaagaaatgtttattatattttaaaaatccttgttccttgcagaaaatttggaaaacacagaaaagcacaaggattaaaataaaaatcaccttcagtcccacaagggagactgtagagatattaacgtttaatattttttttgtggtcttttttttctatgcaaaagcacaccctttcacgtaatatacttacatctgcatctacgtctgtttctctgtattgtaacaaaggcgggattatactttaggtacagtacattagtcaagacccttggtggcaagtgacagaggcccatcttgaattagccaaacaaaataagggggtttattggctggggtaacccatctgtggaaagggttgggcctcagaaacagctggatccaggggcattggcagaactcctctctgtctcgtcactgtgtctctttgtgttggcttcattctcttgggccatctgtctccatgatgttggatccatggttgtagatccttgtgggctaaacgtttcattttattttattattactattattcttttgagacagagtttcactcttgtcacccaggctggagtgcagtggtgcgatcttggcttactgcaacctccgcctcctgggttcaagtgattctcctgcctctgcttcccaagtagctggaattccaggcatgcgccgccacacctggctaatttttgtatttttaatagagacgaggtttcaccatgttggccaggctggtcttgaactcctgacctcaggtgatccacccacctcggcctcccacagtgctgggattacaggcatgagccactgcgcccagccaagggctaaacattttaatggctgaatttcccccagagaggaaggaaagctcctttccaacagctctggttagatacattccagggaggagttctgattggcctggattgtgtgtccatctcagtccctatgtgcaggggtgggagcggggagccatgattggcccagggagagtcaggggcgcactctggtcagagtggtgttgtgttacaagagtcctgtccagcgggagaggggcagttccctaaagcagaggtggggagcttcattacagaggagggagaggcaacagcggtagggccagcaaacaccatagacaaaagctgctttggagttggtgccagccacgggggtgccagcacggcgtgttgggtgagcacgtggaccctcaccttcatgctgatttcattggggttcaattggtaccatcccatgggcagtacagtttggcagtagctgtctccattatccatgctatcctccttgacccagtgagccacctctggggatctgtcagatgtgcatctttccacacacgtggaatgacgtagaatgaggtcattcacggcaatattatttgaaatagcaaaacactggaaacaaccaaatccctattcatagtgaactggctgcctaaattatttcacattcataccatggactaactacttaaaatagaatgatgaggccaggcgtggtggctcacgcctggaatctcagcgcttttggaggctgaggtgggtgaatcacctgaggccaggaattcgagaccagactagccaacatggtctctactaaaaatacaaaaattagctgggtgtggtgatgcacgcctgtaatcccagctactcgggaggctgaggcaggagaatcgcttgaacccagaaggtggaggttgcagtaagctgagattgcaccattgcactccagcttggatgacagaatgagcctctgtctcaaaaaaaaaaaaaaaaaaaaaggtgaagctgtctgtgtaactgcatcagcctaaaatgagtgacagaaagacgagttctccaaaacaaagagtttctttgggaatagcaaggggttgcaatctgaggtgtccatgctctgatggaccataggcacatccgaggggagtgggacaaggggaagcttttagaggaaaaagaaggtcatataagctgctttgaaacaaagaccgttggttacagaggcttatctcaggagggggcttttgttcttggtggtattggctgctgctaggagagggtcttcacagaagtggcttaactggaaagttccagcagggacagcccttcccggcagtttctgttacccgcagtcatgcgcgagggccttttcttcatggcttccttttgttagggtttgatgtaagccactccgtttttgatactgacaactttcacacttgatggaaagttctccctagatttttttttttacaaagacaaagttttgttctgtcacccaggctagagtgcagtggtgtgaacactgcagctttgacctcctgggctcaagggatcctcctgcctcagcctcctcacaggtgcacactaccatgcctggcaaagtttttgtagagactggatcccactttgttgcccaggcctggtctcaaactcttgggctcaagcgatcctccaacctcagcctcccaaaagtgggactctagtaaaaatacaaaaattagctgggtgcggtggtgggtgtctgtaatcccagctgcttgggaggctgaggcatgagaatcgcttgaacccgaggggcggaggttgcagtgagctgagattgcgccaccgcactccagcctaggggacagactgagactttgtctgaaaaaaaaaaaaacggaaaatagtacttcatctttgtgttgtgttggcttgtatttgcataaagaagctgcagtaggctgggtgcagtggctcatgtctgtaatcccagcactttgggaggctgaggtgggcagattgcttgagctcaggagttcgagaccagcctgggcaacatggtgaaaccctatctctaccaaaaatacaaaaaaaaaaaaaaaaaaaattagccggttggggcggggcatgcctgtggttccagctacttgggaggctgaggtgggaggatcgcctgagcccaggaggcggaggttgcaatgagctgagattttgccactgcactccagccagggtaatagaatgagaccctgtctcaaaaaaaaaaaaaaaaaaaaaaaaaaaaaaaaaaaaagcagcagcagctgcagaaaggtgtgtaaagatcatttcacaggctgaataagtggacagattgggacaaggataagacaaaataggccttctaataattttggcgtttgagccctgctaatgtattcctcattcaaaactcaacagaccagtttccttttggggtgatgaaaaagttatggaattagtggtggtggttacataacatcgtgaatgtacttaatgctactgaattgtatactttattatttatttatttatttatttttgagatggagttccagtcttgttgctcaggctggagtgcagtggcgcgatctcagctcactgcaacctccgcctcctgggtacaagtgattctcctgcctcagcctcccgagtagctgggattacaggcatgcgccaccacgcctggctaattctgtatttttggtagagacgcggtgggggggggcgggtttcaccatgttggccaggctggtcttgaactcccgacctcaggtgatccacccgtctcagcctcccaaagtgctgggattacaggcatgagccactgcacctggcctggctttctcattttctagctctctgactgtggacaagttacctgatttctcaaagaatcagtttctcatttgtaaagtgtggataataaaagagtctgtattctgcagattaaataagaggcataagattgagctctgtgcctggggaacaatgggtacaccctccctcccctttctcccctctgccaactggacatttgcatttaaatggggactcttgaagactaaaaacactctaaactccaagggaggaatggttggaatttcagaaaaattcatagctcttatctagggtaaggtctgggtcttttcctgtggagagttaagcttttaggtcctcctcacctgaggccccgggctgacggaggcattggaagcttgtaaaagtcagggctgagatgacctatctacaaagagcatttctggcaccctcatttcaagcaggtattcagtgtatgtgcataagaatgacgtggagaggaaaggagaaagaggtggaaaagggggagggagaaaggacccgatcaaggtcaacagcctgaaccagtcagaggcctcagcctggggctggattctggaggaaatgagacggtaggtgctacatcacccatggaaacaaaggagcagccacccagccaggaaaagccccaaacccttgaaaccccacgtttagcttgcgagctctctgctctcctgtatagcagaagttcttgaagttctgcctctgcttctcaccaatgcccagcagccactctggttctggacccggtggtcaccctctgccctcagtttggcatccctcacacagcctcatactcgcttctcaaaaggctgtctccattttgctcatgactgtcgacctagagaaagaaacagagagaaaattaatatagagagtttgctcgggccaaagttgaggacagctgccagggacgcttcaaaattaccttggggacggcgcccttcgacatttgttaaaagcaagtttttgttttgttttgtttcttgagatgtagccttgctcttgacgcccaggctagagtgcaatggtgcgatctcggctcactgcaacccctgcctcccgggttcaagcaattctcctgcctcagtctccggagtagctgagattacaggcgtgcaccaccacgcctggtgaatttttgtgtttttagtagagatgggatcttgccatgttggccaggctggtctcgaactcctgacctcaggtggtctgcctgcctcggcctcccaaagtgctgggattacaggcatgagccactgcacccggccacaagcaggtttgtaaaggcaaaggggacagggagtggggtgatatgaagttgttggatgggcattctaactggttacaggggtaacattggctgtgcgttgttgagctctagggtctgagtgatggcgtccagtgtatggctatgtggcatcagttagtttagggctcatgtagcaagtggcttcaagaagtgattacttagctcatggagcgggtgagagggaccgctgttgcttttcagtgcctctctgggcctgaccgtgacaggaggattgcatttctcagattcaacattgcctttttttctcacgacagtgaatgtcttgtcctcctggtttccctccgtctcgccgcctgtctgtctcatcctcctcctctgctggccttccacctgctgtcgtgcctgggccccttcctcttctctgtctcccttggtgatctccgcttggacatccgatagttcttccaagctgaacgtgtcccaactccaggtcttcattcttgccccgccaaagtcatccttcctgtagccttccccagcttgacttctctgcattgttttttgtttgtttgtttgtttttttttttgagatggaatctggctctgtcgcccaggctggagtgcaatgatgcgatctcggctcaccacaatctccgccccccgggttcacgccattctcctgcctcagcctcccgagtggctgggactacaggcacccgcccccacgcccggctaattttttgtatttttagtagagacggggtttcaccgtgttagccaggatggtcttgatctcctgaccttgtgagctgcctgcctcggcctctcaaagtgctgggattacaggcatgagccaccgcgcctggctacattgtttttatagatgaaaagagtccaactctgtaaaatattcgaagagatttattctgagccaaataagagtgaccaatgtagccccaggagatcccgagaacaagtgcccaaggtggttgggctacaggtggttttatacattttagggagacgtgagacatcagtccatccatgtaagatgtccattggtttggtctggaaggttaggacaaccagaatcgggggttttggagggtccataggtggattcaaagattttctgattggcagttcattgagtgagtttatctaaagacctggaatccatagaaaggaatgtcagggttaagataagcagccgtggagaccaaggtttcatcatgcgggtgacgcctccaggtagcaggtttccgagagatgagatagcaaatgtttcttatagacctggagtctgttctatgagtctttaggtccctgtgctgatgttgatgctggtcagctggggctgaattccaaaggcgaggagagcataaggaggcatgtccgaccaccccttcccatcatggcctgaaccagtttttctggctaactttggaatgcccttggctgaggggaagggtcatcagttggttgggggccttagaatgttatttttggtttacgttcttttttttttttttttttcttgagacggagttttgctctgttgccaggctggagtgcagtggcgtgatcttggctcaccgcaacctccacctcccgggttcaagcgattctcctgcctcagcctcccgagtagctgggactacaggcatgcgctgccacacccagctaatttttgtatttttagtagagacggggtttctccatgttgctcaggctggtctcgaactcctgacctcaggtgatgcacccgcctcagcctcccaaagtgctggaattacaggcgtgagccactgtgcccagccttggtttatgttcttattccccatgtccacttgtcagcatgctctgttgctgcctccatgatgcatccagagacggatcatatctcccatctccaccacggtcttttgaggccagtccatcatcagctgtcacctggattattgaggaacctttcagccagcctccctgcggccatgtttttccccttacagtccgtcctccgtaaggcagccagagtgatcctgtgaaactgtgggacacatcacatctctgctctgctcacaaatctccctgcctggccgggtgtggtggctcacacctgtaatcccagcactttgggaggccaaagcgcgtggatcacctgaggtcaggagttcaagaccagcctggccaacatggtgaaaccccatctctactaaaaaaacacaaaaaattaactgggtatggtggcgggcacctgtaatcccagctattcaggaggctgaggcatgaggattgcttgaacctgggaggtggaggttgcagtgaactgagattgcgccactgtacttcagcctgggtgacagagaattaaatgaatgcctgaaatttggttttagtgaatgaatgcttgaaatttggttctcatggtgagggtgacaggaagccatttcaaggccttagatagggggctcatatgatcaggttgacattttggaaggtccctgtagctcctgggggagacagtttgggagtgggaccagagtgggatcctggagattggctgggaaggtgtcagtggcttggagatgatggtggagggggattggggtgcattgactgagctgagagacgtgtaggaggcagagtgaaaggcttgttgttagagctgtgcttaatacactttcatggacacacgcgttacctggcatcctctggaaatgcagatgcgtaaaggtgggtctgggctgggtcctggagtctgcttttgggtgacattatgttgccggccggggacacacttagagtagcaaggggttgggtgtcaggcataagggaaggggagtcaggaacacattgtgcctttaattgcaagagaacctaggaggaggagcaggttgggggaaacgatgaggtcatttagggacacattgggttcgaggtgcctgtgagacccccccggggatgtggcatctggagctcagcccaggctggcggtggaaaatgaggagtcgtccttgggttggtgggtgcagccttggtgtgggtgaggctgagtgggagagggcatagggagggtggtcagagctgcggaagcccctgtctgtatgccgtatcgctgactcgaaaggtgcatcacctaggcaagggcgttggttaggtggtctaaccaccaccccttccgatcatggcttaggtggtctaaccaacacccttgatttagggcaggggtttctctcgctggttcctgctggttcatcagcctaactaaggaagggagcaggagcctctcccctgaaggaggcggcagcctgtgggcccatgagggaagccagccaaccctggctctctgcttctgatgcacctgtcccagtgggcctgtccggaagcatttgggtatccctgctgcccaggagccccacggtggactcaggcaaacctgggccccagagcccacttagccacttggtagctgcgtgagcacgcgcaaggtgctgcagcttgctgggccccggttttctcatccgtgtgatggggtaataatagtgccctcttcccgtgacggttgtgacgatcagtgagatggggtgtgtgacatgctgagcccggaggccggcgctggccagtgctcagtgaggttctgttatctctggagggtgtggcaaggtcaggatggacactggccttgcctcctccttcctgccctacccactgcatgcacctggcttggccccacctccaagcccttctttttttttttttttgagacagagtcttgctcttgtcactcagggtggagtgcagtggcgtgatctcagctcactgcaacctctgcctccccggttcaagtgattttcctgcctcggcctcccaagtatctagttttacaggcacccgccaccataactggctaatttttgtaaacttagtagagctggggtttcaccatgttggccaggctggtttcgaactactgacctcaagtgatccacccgcctcggcctccccaagtgttgggattacaggcgtgagccactgcgcccggccacaaagcccttcttacattgaaagtcccttggctgggcgtggcagctcatgcctgtcatcgcagcactttgagaggccaaggcgggcagatcacgagatcaggagttcaagaccagcctggccagcatggtgaaaccccgtctctactaaaaatacaaaaaatagctgggtatggtggtcggcgcctgtaatcccagctactcaggaggctgagacaggagaattgtttgaacccgggaggcagaggttgcagtgagctgagatcgcaccatggcactccagcctgggcgacagggcgagactccatctcaaaaaaaaaaaaaagaaagtccctgcttcctgttgggtcctcctccttgccttgagccctctccctccattcagatccatccccactgatgtctcctgctcgtctcttgtccattacttttttcctcctgagccctactgtaatgcttggagagtttggggggctggtgagggcaggatcatctgctgtctgttcatgtctcccaagagaccgcagggtccttcaggctgggtgggtgctgaatatccaatggggaccaggtaggcctgattcctgccctcctggagctcaccgtccagcgggaaggacaggcatcagactgatcgtgacaactgaggggctgggagcagggggctgggagcagggtgccgtggtggcagagagcacggggactgatggatgacatcggaagggagggacattcaggcagagacctggaggatgattaggatacaggaagacgaaggcttgggggggatgggagtgtgggtgagagaagggtctagacagagggagtagtgtgagtgggagggctcatcacaggaacccacaggctgtgtagaccggttggggcaggtgtggagaggaagtgagaggggtgggagatgaggctgggtggggccgttgggacaagggggtgcggagagttgggtttgagccacatggtcatgggagccatggaaggaggacagaataatccacctcacatttatttttcaccttcttcttttttttttttttttattgtggtaaaatacacatcacacacagtgtctcacttgaatcattttaaagtatacggttccgtggcatcaagtcctgttcacagtgttttgggatcctcactaccattctccagaccatgttcatcatccagatggaaactgtatccattagccgtcactcccacccccgcctcccccatcccgaagcaactaccatctactttctgtctctatggatttgcctcttctgagcatttcataatgcaggttgggtgtgtcttatctgacatgcttgggaccagatttcatattttttttggattttgctgtatttccattgtacttagtggttcaacatccctactctgaaaattcaaaatctgaaatgtgccgaggtcaggcacggtggctcacgcctggaatcccagcactttgggaggccgaggcgggtggatcatttgaggtcaggagttcgagaccagcctgtccaacatggtgaagccccatctctactaaaaatacaaaaattagccatgtgtggtgatacatgtctgtaacccagcactttgggaggccgaggcaggtggctcatttgtggtcaggagttcaagaccagcctggccaacatggtgaagccccatctctactaaaaatgcaaaaattagctgggcatggtggtgcacgcctgtaatcccagctactcgggaggctgaggcaggaggattgcttgaacctgggaggcagaggctggagtgagccgagatcgtgccactgcactccagcctgggggacagagtgagactctgcctcaaaaaaaaaaaaaagaaaaaatgtgccagtgagcatttcctttgagcaccatgttggcactgaaaaagtttaggatttgggagcattttggatttcagctttttggatttgggatgctcagtgtgtagatggaatcacacagtaggtggtggtctgtgtgtggcttcttccacttagccagcattcatccacattgtagcacgaatccgtaacggcacttcattccttttcagggttgaataatgttcctttgtgttggtgtgccacgttttgtttatccactcattcgttcatggacatttgtgtttctttcacctgtgatcattgtgaatagtgttgctatgaacacttgtgtacatgtttttgtttggaaatgttttctggagtggaattgctgggtcatatggtaattgtttgtgtaactttttgaggagcgtccacacttttcaacaatgggctacagtttctctgcattcttgataacgtttattgttatctgtttttttgcttttttctttttttctcgatgatggccatcctagtgggtgtgatctgcttttttttatttgtttgtttttgagacggagtctcgctatgtcgcccaagctggagtgcagtggcgcaatctcggctcactgcaacctctgtctcccgggttcacgccattctcctgcctcagcctcccgagtagctgggactacaggtgcctgccaccacgcctggctaattttttgtatttttagtagaggtggggtttcactgtgttagccaggatggcctcgatctcctgacctcgtgatccacttgcctcagtttctcaaagtgctgggattacaggcatgagccactgtgcctggcctttttttttttttttttttaattttgagatgtagtctcactcttttgcccaggctagagtgcagtggtgcgttcttggctcactgcagcctccacctcctgggttcaagcaattctcctgcctcagcctcctgagtagctgggattacaggtgtgcaccaccacgcccagctaatttttttttttttttggcatagagtcttactcttgtcccccagggtggagtgcagtggcacaatctcaactcactgcagcctccacctcccaggttcaagtgattctcctgccttggcctcccaagtagctggggttacaggcacgcgccaccacgcccggctaatttttgcatttttagtagagacggggtttcgccacgttggccaggctggtctccatctcttgacgtcatgatccacccaccctggcctcccaaagtgctgggattacaggcatgcgccaccacgcctggctaatttttgcatttttagtagagatggggtttcgccacgttggccaggatggttgattggcttttcatttcagcatggtccctgtgtctccttcctggagaatgggttgctcagtgcagtggctggagatgggctgggatgcgggtgccgttgtctaggtgagagatcatgcttcggggtggagtgatggaacagttagggaggtggcgaggactttgtgataccatggaggccacgggtgagggaagtagggactcaaacgtgactgattcgtgtcatgtccccagcggctagcgctatgctggcacaccgtcggtgctttacagatactcgcggaatgaatgtcagatccccaagaagaaatgggaacctggaagttcttggtgctctttctgaaggcccctcccctgtgggccccctgatggtcctgggcttgggcagcccctcttctgagggaggctgcggggttgtcttggtcggggttatgtgaaggtggggtgggcagcagagcagcttccaggggctacctccatcttctctgtgttcaagctccacagcccccaggagaccacgtgggtggtgctggggagctggagaggatggtcttttgggaggggcgcatttgagggctgcactgtgagctctgagggggcagcaaagcctttcctgagctccccaaggctggtgtgaaagcactttctgtctgcaggtcggtgtcccagcccagggacgctcctccattcttggcatttctctcggggttctgggagggtccagaaaggcctcgcccagcctttgcggttccctttcctctggcttccactccacgtgctgccctgctctcggcaccttccccagccgggcagccttttaacggatggattttggccttgatggagagggaagcgccttcgatctaaaagcttccaaaagcttctctctccacccttctgtctttcctctctctctccctcattttctcctctcctgttttctttttttttcctcacctgtgttctgtaaatctgtaaaacaaacacactttaaaaatgtcacttgtctcttctatctgcggcctagagtggggtaaagctgttacctcccttgggagtcggcttttgagctctgggcatgagtcagccctgttcctgatggccgcaggatgattggcagagaatcccagggtggctgcctcatggcctggggcctcgccagctggggcttcaaggctgtgacccagatagggaggtgggtgaccctttctgcctattccctgctcaccttctggtccagggagggacccagaatggacaggcaggggcctaggactttagccaaccttcgagcaacagcaaaaactctagacaggcccctgtggttacccacgtcagtgtgaactgtgggctcctgtcagccttcacctccgcctcctctctctccagggagagcaggtgtgtcctttctgggccagtcgggaatctcttgttcagcactgttggaggtgtgggggatgcatggggcacagggtgtggtctccagaaacttctagtgtgcattgcaagtgagaagcatcctcttacgccaggactctgattgggcagggaatactcagcgtactcaattccaggctttgctatggggctgagagaacgctcgctgtggggtgcagtggggctgcagtggccctttcattcattctttgcttcttcaatcactccttcactctgtatgtgaatgggcgagacgggtcggacacagctcttggagtcagagttcttgagttgttttttttttttttttttgagacagaatctcgctctgttgcccaggctggagtgcagtggtgcagtctcggctcactgtaaccttcgcctccccggttcaagcgattctcctgcctcagcctcccaagtagctgggactacaggcgtgcaccactatgcctggctaatatttgtatttttagtggaaaagggggtttcaccatgttgcccaggctggtctcaaactcctgacctcaggtgatccgcctgcctcggcctcccaaaatcctgggattacaggtgtgagccactgcgcccagcctagcgttcttgaatttgaattctgtttcttccactgactagctgtgttcctgttagcaagtcattcagcctttcccaagcctcagccgactcatctatatataagatgaaaacatcactccttgtcctgatcttcctcacggaactgtgcttggcagaggaagtaatcatacgcgtcacagcaaattatgacacaagtgtaaagtctttctgcgaacagatactttttgagggccttcagggtaggaatgctgcccttgaccctgtgggctacatggagatggtcaagacagtccctgtcctcatagccgttacggcctggcaggccaaataggcacatttcttttatttctttctttttttttttttttttttttttgagatggagtctcgctctgtcgcccaggctggagtacagtggcacgatctcggctcactgcaagctccgcctcccaggttcaagtgattcttctgcctcagcctccccagtagttggattacaggcacccgccaccacgcctgactaattttttgtatttctggtagagatggggtttccccatgttggccaggctggtctcgaactcctgacctcgtgatccacccgcctcggcctcccaaagtgctgggattacaggcgtgagccaccgcgcccggcagatagacacacgtcttggcagatccggctggaaggttctcagcatgctttctcatggggcactgatgcaacagagcccctgagcacctcagttcatccagcacatagtccctgcatgtccacaggagccaggagctgttcagaggctagatcggtgggcttggagtacgttggaggtgagcaatggtgaggcccggctacccccaccaagtctcgcagctgcaaccagctcctccagcaggaagagcctctgtgttctctccctttggcagctcctcgcatcccaccacgtacactcagttctgggtctaggggctgaagcagtgccttttcacttgggtgattttctggctggcctaggaatggcctcttcctgtcaccatttggttgagccaactggggcagggagaggatctgggaaggggagacagagatcctgaagagggccccttaattctcagtggctccagctgcctggcgaggccaccctcatgcctcctggggagaatatcgccgtgtctgtggatagtcccttccagcattattgacattgatgcatcatcttgtcacttaggtgaccagggcagctggaaatgattcggcaggaaggccgaaatgccggccttttctcagccctgattccctgtggcaggtgctgggtttgccccctggggcctcctgctctgggttgagatgtcgcatgagaagagcagaaggcagatgcggcagggccttccccacaccccgtccactttactagatgcctctggactctgaattttttttcccaatgaatatgtatttatgtgtgtgtgtgtgtgtgtgtgtgtgtatatatatatttttttttttttttttttgagccggagtctcgctgtgtcccccaggctggagtgcagtggtgcgatctcagctcactgcaacctccgcctcccagatttaagcgattcttttgcctcagcctctcgagtagctggtactacaggcacacgccaccacgcccagctaatttttgtatttttagtagagatgaggttccaccacgttatccaggctggtctcgaacttctgacctcaggtgatccacctgtcctggcctcccaaagtactgggattacaggtgtgagccaccgtgcccggccatatgtatttatatttacaataaaaatttaaaaatcagaaaacagaatgatagtcagtggtgccctttgtaacaatccaagaatgggttattggtatttaacaggatacttttgtaggcatttagcgaagcaaaaataactttctcttagaaaaacataacgcctgtctcaggcgctttcccacgcagctttgcttgtggacttcaggtttgtctaggtgggtgtttgcacggcccttgaactacccattccccagcagacggcttgatgaatgagcccagtggctcagcacaccagagcggcaggggtcggggagtgggactgaggccgagggatccaaagcagcagtgcaacaggcaagtcatccagggattgcccctccgggtccctcagaatcccagctgtgccacttacttgctgcaggaccttccagaaatcacttaccgtctctgagcctcagtttcttcatctgcaaaatgggagaataattctgtatctaccacataggggtgttgaaaagattaaatgaaataacgtacataaagagtttagtatagtgctaagcaaatattagctgatatgatgatgatgacgaataatagtttttttttttttggagacaggatctcgctctgttgctcaggctggagtgcagtggcgcattgcactctgcctcctaggtccaagcgattctagtgcctcagcctcccgagtagctgggactacaggcatgcaccaacacgctcagctaatttttgtatttttagtagagacggggtttccccatattgcccaggctggtcttgaattcctggcctcaagggatctgcctgccttggcttcccaaagtgctactattacaggcatgagccaccgtacctggctgatgatgaagaatacttaccttttttttttttttaagatggagtttcgctcttgttgtccaagctggagtgcaatggcgtgatctcggctcactacaacctccacctcctgggttcaagcgattttcctgccttagcctcccgagtagctgggattacaggcacacgccactgcgcccagctaattttttgtatttttagtagaaatgggtttcaccatgttagccaggctggtctcgaactcctgacctaaggtgatctgcctgcctcagcctcccaaagtgctgggattacaggcgtgagccaccgcgcttggtttttttgttttttttttttgaaatggagtctctctctattgcccaggttggagtgcagtgatgcaatctcagctcactgcaacctatgcctcccgggttcaagcaatccccctgcctcagcctcccgagtacctgggactacaggtgcataccaccacactggcaaatctttgtacttttagtagagaaggggtttcaccatgttgggcaggctggtcttgaactcctgacctcaggtgatcctcctgcctcggcctcccaaagtgctgggattacaagtgtgaaccgctgcgcctggcctaactattatctctactatctgtgtccagacaagaagcccgaggccaggagcagaatcaatccccagggaatagcaggagcttggtaacagaccaaataggtggggaagtggttaactctgtctcagagtttttaaaaattttgcttttatcatgatcatgatttctaattgacacataataattatacctattttgggggtacagtgtgatattttgatatgtgtatacaatgtgtaatcatcaaatcaaggtaattagcatatctgtcacctcaaacgttgatcatttctttgtattgggaacgttcaaaatctgctcttctggctatttgaaaatatacaataaattgttaattatggtcaccctacaaggctacagaatactagaaatgattcctcctttcggtacttttgtatccctgccaacctctccctaacccctctctttcctgcccttctcagcctctgctgaccactattctgctttctacttctgtgagatcaacttttttagcttctacgtttgcatgagaacccacagtgtgtgtgtttctgtgcctggcttatttcacttcccataatgtcctccagttttatgcatgtcgccacgaatgacgggatttggttctttttttatggctggatagtatcgtgcatatataccaccttttctttttctttttttttttttttttggagacggagtcttgctttgtcaccaggctggagcgtattggtgcgatctcagcttgctgcaacctccgcctcccgggttcaagtgattctccggcctcagcctcccaagtagttgggactacagtgtacaccaccacgcccagctaattttttttttttttttttgtattttagcagaggtggggtttcaccatgttgcccaggctggtcttgaactcctgagctcaggcgatctgcccgccttggcctcccaaagtgtaggattacaggtgtgagccaccgtgcctggcctataccaccttttctttgtacattcttctgtttatagactcaggttcattccacacctgggctgttgtgagcagtaaacacaggagtgcagatggctcttcaacaggctgactgcctttccctcagatatgtaccctgcagtgggatcgctgggtcatgtggttgttctgtttctagtgttttgaggaccctccgtgctgtgttccatagtggctgtgctcacttacgttcccaccaatcgtgtctcaggctcttgagcagggagatgaggtcaaccaaagcactgatgaaccaaattgcagtggtgatgagccgggtgccagctcagccgagtcctccacctcttggggtctatgagctccccatgtgttacacatttttgagttcattcagtgccaggccctgtgctggggcaggccagtggtcagggtgcgtgttagagcccagccagaggcctctgttctctctgggtcagaggtaggcttggccgggggagtgagtttctgctcatcacgtggagatcttgatcacccagtggagctcccggcggctgagccctctttctgaactttccagccgtgaaatactgcaggggccatggccagattccagtatgcccctggaggctcttgcaggtatcttgtcctttcttttctaatgtcccagagaaagaggccagcactgggaggaggcaggaggtttgatcgatctgcgctggattttttttttttttttttttgagatggagtctcactctgtcgcccaggctggagtgcagtggcacgatctcagatcattgcaacctctgcctcccgggttcaagtgattctcctgcctcagcctccagagtagctgggactacaggcgcacgccaccacgcctggctaatttttatgtgtgtgtatatatatatatatatatatatatatttttttttttttttgtagagatgggttttccccattttggccaggtgggtcttgaactcctgacctcaagtgatccgcccgctttggcctcccaaagtgctgggattacaggtgtgagcccccgcactggcctgcgctgtgttctgtaggttgggttagagcatgctgttgagatgagatcccagccctggtccctgggagccaaatcactgatgcttggttgcatggccatgggtggaaccccttgttctggacactcgtcttccaggaatgtaccacggtcacaagcaagaaaggggaggaacgaggatgggccaggtgccctgtctcagtgctggaaaacagcttcatgcatttgtctttctaatgagtgagaataacattattatagtaattgaatagaccaggcagatttaccctgaaatgctgtagtctgtccccattgaaactgttatttagtttgaaccaatgatggaagctcctaatccattatgtcaccaagtaatcttattcagaagagttaagacttaagacacagtcttagagcggagtggagcagtggcttagctggaaggccggttggctctgtgatagggaaactttcagtgctcacagactgctgggggatttcttagcatggatggtttaacacgcctctgtgctgggcactgtgagacggggctccttttcttcttgggcttgccgggaattcagccaacacatgggaccccttattacacagtgtatcctcccagtagcaccagtttttggtccaattcaatggtcagtgtttactttttttttttttttttgagacagagtcttgctctgtcacccaggctggagtgcagtggcgcaatcttggctcactgcaagctccgcctcctgggttcacaccattctcctgtctcagcctcccgagtagctgggaccacaggcgcccgccaccacgcccggctaattttttgtgtttttagtagagacggggtttcactgtgttagtcaggatggtctcgatctcctgacctctagtgatctgcccacctcggcctcccaaagtgctgggattacaggcttgagccaccacgcccgaccaatgtttactttttatgactgtgtaaatgttattcattgttatgtgagagggtaccataattatgttttctttcttgtataacttttcatgtttcttggagttaatgattaactcctgtttctgccattagctttgttttctatggacctatctttctttttcttttttttttaatttttgagacagggtctcactctgtcacccaggctggagtgcagtgccacattcatggcttactacagtcttgacctccagggttcaagcgatccccctacctcagcttcccaaatagctgggaccatgggtgcttgccaccatgcctggctaatttttgtggagagacatggtctcactatattgcccaaactggtctcaaactcctgagctcaaccaatcctcccgccttggcctcccaaagtactgtaattacaggtgagagccactgtacctggcctatttttctacttttatttttttctaccacaattactttaatagatggcccctccctaccctcccccatctccgccaagcttgcatccatcagataacctgtcaattccattctttcccccaggagatctcacttccagagcccccccatcctctagtgatagtatcctcccaagaaagggtgcaagggtgtgaatttttttgagctcttgcatatttcagaatgtctttattggttgatagtttgcctgggtgtgaaattttaggttgaaaataattttctttgagaattttgagagttataacatcattgcctactagattccagagttgctgttgaaaagtctgatgatatgcagattcatatttcttttcttttttttttttttttttttttttttgagacagagtttcactctcgtctcccaggctggagtgtaatgatgtgatctcggctcactgcaacctctgcctcctcggttcaagcgattctcctgcttcagcctcccaagtagctgggactacagtcatgtgccaccatgcccggctaatttttgtatttttagtagagacggggtttcactatgttggccaggctggtctcggactcctgacctcaggtgatctgcctgtctcgacctcccaaagtgctgggatgacaggcgtgagccaccgcacccggcccagattcctatttctctgtatatggtatgtatttatattttctctctggtgtcactgagaatttttcatttgcccaggtgttctgaaatttcctgacagtgtttgggatggatcttgtgtctttactgtgctgtgtacttggtggacccagagactcaggaccttcagttctggaagatgttcttgtactatttccctgctaatctttctgttatggtgagacaacagccattttattatgctcaagttctgtgggtgaggaattcagctagggcgtgttggagatgatggcttctctctgctttcacaacgtctggggacctcatcttgggtggctcagatggctggagatgactgcgacggtccactggggctgtatgtccgggagctgggctgtgttctcatagcatctactggagctgagatgcccaaggtggtttcttcatgtgcatggactgggatgtttggagcatctgggcatctctctccatgtagcctctccatgttcccagctgcagcattgacagtctcagtcaggcctttcacgtgcaggcttgctttctctggagcaaatgttcctagaggtagaggtggaagctgtcctgtgactcattcctgaaagtgaggtaatgttacgtctgtctcattctgttggtcaagactgagtcacagggccagcccagattcaagaggggagcacacaaagccatcagcaccaagagatgccagctttggataccagctgccagctcccctcccctttctctttctgggaactttcttggtcggctatttgatcttttttctcttccctcttttgttttctgtatctttatgtttttgttctactttttgggagatttcctcaacttagtcttttcatcatatttctttttctctttttcttttttctttttttttgagatggagttttgctcttgttgcacaggctggagtgtagtagcgtgatcttggctcactgcaacctctgcctcccgggttcaagtgattctcctgcctcagcctcccaactagctgggattacaggcacccgccaccagctactagcccggctagtttttttattttttatttttagtagagacgtggtttctccatgttggccaggctggtctcgaactcctgacctcaggtgatctgcctgcctcagtctcccaaagtgctgggattacaggcgtgagccaccgcacccagcccccttactgttattttaatgggcttcagaagaagtgggataataaatgcgtgtggtcagtctgacaggttcatcctggaagtctcaacaggcttcagaatatctctatttatatctcctaaaggaagtgagggtacatagttatcactgctgaaacatgattttttattgtgataaatgttatacatccacactgaatgaatcataagatgaatgcgcctttcctcgccatccaggtgaagggcgtttacgggctgggaaaatgctgatagcccacaccttgtgactcccggcttttgtgagtggtttctgaagctgccggaggccgtgaccttgtgcgctggctgcctctgctctgaccatgacgctgctccccccatggaggccaggcagtgccaggcagagccgctgactgcgcccgggaggggaactgctctgtcggcagtttctgagtgacggagtgcgtttgaagggctgggtgcgtaggcacctggcttggtgatttcttcagcgcaggggaggtggagcctctgccaccccctgcttggcacgcgctcttccctgagcaccgcccttccagcccatcccagcaggctgccttctcacctctccttccctgccccttggagggctcctgttcatttttgctttatgaaagccggccaggcgctcatgtctgtgatcccagcactttgggaggccgaggtgggcagatcacctgaggtcaagggtttgagacgagcctggccaacatggcgaaaccccgtctcaactaaaaatacagaaaaaaaaaaaagttaggctgggcatggtggcccatgcctgcaatcccagcacccagcactttgggaggccaaggcaggcagatcacctgaggtcaagggtttgagaccagcttggccaacatggcaaaaaccccatctctactaaaaatacaaaacttagccaggcatggtggtaggcacctgtagtcccagctacttgggaggctgagacaggagaatcgcttgaacccaggaggcggagcttgcagtgagccaagatcgcgccactgctctccagactgggtgacagagcgagactccgtttcaaaaacaaacaaaaaaccccctaaaaccccaaagccctacatgctgtccctgagggcctccacccctcccgtggcctcagcttccacctctgttcttgttacacctgtctttctgcttaggttttagtgctgttctgatcccatttgggtgtcccaggggcccctggcttgccgtgcgtccagaaagagagccttatcatctgcctctcgcaaagcgactctcctcctccgtctgtatcacggctgaagcgtccgtcattctgttttctgaaacccaggttacttggtgtgtttagctctcggccccccctttactttctgtcaccaagtcctcttaattttgctcccgaaatgccttatgactctgaccctttcatgtcatttctgtggctgtgagcgcagtggagggcagcgcccctcggccccgtttcggtcttcccctggcccctcccttccagccgctccgttctctctctgctgcttgcagagtcctccagcaaagctctgcaggtcatgggcaccccgcctcgggccccttggcttccttcctttgccctcgagagagggttcagcatgcggcaccttttcccagcgtccgcacagcgccggcactgtttgtactgtgtgtgtgtcacctgtctcaggcccataatgttttccttcaagcggctcaggtgttacaacttcagtggacttgtttcagaaggcacctttacgtcactaccataaaaggaaaatcagggtggcctcccacaaagagggtctctgtcaaagctcagtaagtgactgttacagtgaagaccaccccaggtgccctcgggggcccgcggggaggcaggcgtccactctgggaagccgtgggccatgggatctcctccccagcgggccccttctcctcctcagaggcagtgtagcaccgtggtaaacgccacagaccctggggccaagcctgcgcccaagcctcactctgctcctttccagcaacatgatcttggtccgcttaacctctctgagcctcattttccctgctgtaaaaggggttaatactatttccttcagtggattgtggtattaaataagagagtgtacatggatcacttcacacagtgccctaacccttgaggcctgtttgctggcatttgcccttccccgctactttttttttgagacggggtcttgctctgttgcccaggctggagtgcagtggcgcgatctcggcttactgcaacctccgcctcccgggttcaagcaattctcctgcctcagcctcccgagtagctgggattacaggcgcctgccaccatgcctggctaattttttgtatttttagtagatatgaggcttcaccacattggccaggccggtctcaaactcctgacctctagtgatctgcctgcctcggcctcccaaagtgctgggattacatctgtgagccaccgcgcccggcctgccctccccttttgccagcctgctgtgccctcgaatggtgtgatgtgtctcctgggcattgcgacactggtggtctctccgtcatgctggtcacgttcctctgcgtcctgcttctgtgccctccccttccccgcttctcccgtaggtcactgctggcctcttctctaggcctagatcagccgttgcctcctgtgcgatcccgtagctggtctcccaaggagaaccagacctctcctccctgtgacctcatggcacttgattctgtatctcttgtttcaccccatgaccccacagtccatgtttggcactcgggtctttcaggtgggtgtgccgtgcctgcaggatggttttctgcattttgcccggatcattttctcagatgcttgtgaatcacacagacgtcgcctcccacgctgagacactacccttggtccccaagaactcaaaacacacaagaagacgtttggccactgtcccctcctcgctccctgctgtggtacttgggccaggtggagctggctttcccatggcagtgggaaggagcaccggaatgggagtcagagatctcagggttgaggtccagctctcgtattttctgactctgtgaccccaggctcacatagaactcggaatctctgctggcttgggtgtaaaccataaagcacgcatcagttctaaaagctgcttgtgcggtaaaggcttattttcccagggtgaggatttgcccatgtgggtagattggtccatcgctctgagatatgtgcacgagggggccccaggtgcccccaaccacagggctgtggaggggctgcagaggttctcccaggtggtctgcccgtagggtcctgttcctcccgcctcctgccctttttcctagccctggtgcagtttaggacttcaggtcctgtcctcatctaatgcacctggagggcagcaggagtgtcttctgaagctgcagcccgagtctggcccgggcctccccttgtgcccacgtgcagccacagggtcctgcgcagggtgtagcctgcagcagagactccagccggctcatctcctgcacagcctgggcctcctgctctctgtctgctctatgcaggggaccagtagccccctttgaccctctcccccttctgtcccctcacttgagggccttggcactttataaacgggtgtccaggccaggtgcgctggctcacgcctataatcccagcgctttgggaggctgaggcgggtagatcgcctgaggtcaggagttcgagaccagcctggccaacatagtgaaaccctgtctctaataaaaatacaaaaaattgtttgggcgtggtggcgcgtgcctgtaatccaagctgcttgggaggctgaggcaggagaattgccggaacccaggaggcggaggctgcagtgagccgagattgtgccattgcactccaacctgggcaacaagagtgaaactccgtctcaaaaccaaaaacaaacaaacaaaaaaatgggtgtccagaagccagttgtgcttcctgacacgttcctcctggagacttttttttttctttgagatggaatctcgctctgttgcccaggctggaatgcagtggcacgatcttggctcactgcaacctctgcctcctgggatcaagcaatttctggctaatttttgtattttgagtagagatggggtttcaccatgttggccaggctggtctcgaactcctgacctcaagtgatctgcccacctcagcctcccaaggtgctgggatgacaggcgtgagccaccatacccagcccctcctgagacttgctccccacttcccacaagcctgggccgaggtgatttggaagtggggcctcttccttggagaagagaagagaggctcactgtggggtttgggcggttccctcggctctccagcctccacgtgcttgtctgcataatgaggctgtcgggtggcatctggtgctttctcccacggctgctgctctctgcatccgtgaaccctgggattgaagtaggggtggggattgccattttgcaatttctgcggagtctttttttttttttttttgagacagggtctcgctctgtcccccaggctggagtgcagtggcatgattacggctcactgtagccttgatctcctaggctcaagtgatcctcccacctcagcctcctgaatagctaggactacaggcatgcacctggctcatttttaaattttttatggagatgggatttcaccatgttgcccaggttggtcttgaactcgtgggctcaagccatcctcctacctcagcctccaaagtgctgggattacaggtgtgagccacctcacccggccaacgggggagttttgaatcaccaaaggtctagagttggtgccccaaatctttggaatcctctcagagtatgtgctgggatgggctgtgaccccgaggtcagccctgccaggtaggaacaggtgcgcaacacctgctccttctcaagctacccattcactccacctgttggagccttttgttcctgaatccagtgtcctcttccctcccccacactctgccaggtctgctgggctcatgccctttctcccttccacactggccccagcacaggcatgagggtcatcagtgcccgcatctccatgtctgtccccttggggcttggaattgagccatgtgcatatacccggggcctggcggttcccacatggcagctgggctcccgtgtccctgtctcccagcttagcatccacagtatgtggggcagcgagtgcccagatctgaagatgtccctgcccccgtccacctctgccttctgatcagctttctgccttggcccctcctcctccgtgcccattcttcccgttgatttgagccttggcaacaaggcgaccagccatgtttttgcagcgtaccaggcactgtgctgagtgctttctgggccttcctcataacgccccatgaggcgaggagtagtcacaccgttttacagatgaggaagctgaggcatggagaggtgagataacctgaccacacagtgaatcaggagtggtgctggagtattgattagcaggagtattgattagcgattgcatcccgttcccctctccctgcagcccctggcaacctctcatcaccgttctgtctgtggatttgcctgttctgtggatttcatggaactggaatcacacagcatgtggccttttgtgcctggctcctgtcactcggcaccgtgcttcctaggtgcatccgtgttgtagcatgcatcagttcttcattccttttctttctattgtctttatagtcataagctatcagtttgtttttatttttattttattttattttattttgagacggagtctcactctgtcacccaggctggagtgcagtggagcgatctcggctcactgcaagctccgccttccgggagcttccgctattctcctgcctcagcctctcgagtagctgggactacaggtgctcgccaccacacctggctaattttttaaatattttttttagtagagacggggtttcaccatgttagccaggatggtctcgatctcctgacctcgtgatccgcctgccttggcttcccaaagtgctgggattacaggcgtcagccaccacagccagccacttatttttatttttttgaggtggagtctcgctctgtcacccgggctggagtgcagtggcacaatcttggctcactgcaacctctgtctcccaggttcaagtgattctcctgcctcagcctccttagtagctgggactacagacatgcgccatcatgcctggctaattttttgtatttttagtgagatggggtttcgccatgttagccaggttgttcttgaactcctgacctcaggtgatctgcctgcctcagcctcccaaagtgctgggattacaggcatgagccactgcccgtggtcctatttttatttttgaaaattaattatttttgcttcatttctttttatgggtgagcagtattccacagtatggaacaaccaaattttatttatctgttcgttggcggatggacacttggattgcttcccccttttggccattatgaatcatgtttcttgttccttttggtttggttttcccgagaagctctttgcagcccagctgtctgtattcctctagcttggctatttggaaagcaagagaaagcgtagctgagcgtgggtggatggctgggagcgggtgtggggaggggatgcaggaaaggggagtttcaggctttgggagaaccccgtgtggagggggccttacacctggccccagagccacctgctgctaggtgagtgtttttcctgtggttgattattaaccaacggttatgatcctgagagtagatccccaggctagaactggtgctcatttgagatgccagaaatgttttccaaggcatttaaacggccttggactcttgcttctgtctccacttggagaccacatcaacattttatgagttataatcatcatcatcatcatcatggtctacattgatatagaacttcatgttttatgtcacagctgttatttttttaaattaattaattcatttttttgagacggagtttcgctcttgttgcccaggctggagtgccatggtgagatctcggctcactgcaacctccccctcccaggttcaagcgattctcctgcctcagcctctcaagtagctgggattacaggcacccgccaccacgcctggctaatttttgtatttttagtagtgacagggtttcaccatgttggccaggctggtctcgaactcctgacctcaggtgatctgcccacttttgcctcccaaagtgctgggattacaggtgagagccacctctcccagccacagctattatttttaactccttggtactttattacccctatctttgcagatgaaggaaacaagacacaacgaggtaacttaaccaaggcctcacagctgggtagcaggcagagccaaacttgaacccaggaatcccttgattccaagtgtagggtgctctccatagcgatgtgtgagacatgacggttgcagtgacctcaagatggtctgaggcagagccctccgagggtggggaggcgaggagcctgcaggcctgggtgctgtcacaggggctccgccaggggtctgtctagctccgtctgggtgaatcatggcctttgacttctcagcttccactccaggcccctttgaccatttcctccagagatttgcatttggccaacgctggctaggacgcgtcctggtctccctgagcctccccatctgcccttggatctcctgtgcttctagggaggaaaagaatcccagagcagggaacctcagtgccatgtgagaaggggcagggcctccaggactcccccaggtggcagaggctctctgacctgcccttccagcctgcccttgccacccttctctttgaactgagtatgtaatcttcctcttctcttcctctggcttctctccatcctccttttcccttctctgctttccaagctgtccccatctccagcccctcctctcatgggtccttgtgggtccctgggtgggtctggggccccgcgtcgttagagttgcatgcgagtatggggctgggtcgcttgagggctgcggttttcaatctcagtgccatgacatgtggcaagatagatccctgtgggtcacaaagaagttgtcacctcggctaaggatttaccttttgcttctaattagagcacattcaaggttatcccttgatataatcacatcactttcacctcctcgtgtgtgatatgtttgcctgagtgggagaaaaagggataaaactgcatcaagcaccgcgtcacttaactctatcttatctcggtgccagctggtggctgggctgggctgtgcctggctgtccttgggagggtggctcatgtgtaaatgtcattgtcctggggcaggacaaggctgagcatagctgatcagagcaggggtggtgaggcagaagcaggatttcatcttcactgtttttggctctctaggccaaggctagaacctggggcctgggcactgcattcatttcctagggctgccattaccaaggacctcagatggcttaaagccgcagacatttattatttcagttctggaggccagaagtccaaaatcaaggtgtcagcagggcgacgctccctctgcaggctctagggaagaatccttcctcgcctcttctagcctctggcggggtcggcaagcctcagcatgcgttggcttgcagccgcatcactcctgtgtctgcctgagaacacggggcattctcactgtgtgtttcttcacattgttgccttcccttcttttttttttttttgagatggagtcttgctctgtcacccgagctggagtgcagtggcacgatctcagctcactgcaacctccacctcttgggttcaagcgattctcttgcctcagcctcccaagtagctcggatgacaggcacacgccaccatgcctggctaatttttgtatttttagtagagacggggtttcgccacgttgaacaggctggtttggaactcctgacctcaagtgatccacccccgtctcagcctcccaaaatggtgggattacaggcatgagccaccgctctgggcccagttcagatgtttttgagggtggcagtcatgccttctgcccaccctggcaccccctctggagtcctggacacagcgctggagcttgcatgaggctggtcaccactggtgctcatgtctgctctagcgccttccaagctcccaggcatcatttgggaaatccttctggtcagaagctgccatgtgctccgacttgagagtctgcctcgcttcctagagaccggccccaggagcttatccagtgtccagtagagaccggccccaggagcttatccagcatccagggggaaaaggcaggggagaggggctcagctcagggagtgttggatgctgcgcccttttgaccgggactcagggccttgaacaataatcatatgtgccctggtgccatgagcgtggacaccttgtgcctgatggggaaaaatagacagcatgactgtgtgtatgagcgtccagtgaccggtgatgttaaaaccagctctgtcctcctctggactgtgtgtttctggagagccagggctgctgtccatcaaggtgcctgcgagccatctccagaggccctctgctaagcccagagtcgccctatagcatctggtgggggcttgttttacttcccctccctgcgtgcttttccttgctgggctcctagccttacaggggagcagctgtcattctcaccatgggcccgaagaggacctgagggtgatgccctcctgcttgatcattcttcctttcccccatcatggctcttaaaggccaggcccattgaggaggagctgtggctgcttgggagagggccaggtggaggaggcggtgagcctgtgctggacccagctctgttgtgcacacaggcaggtgagtgtctggcagagcagccagactggagcctacggtggtaatgtccaaggccgtacatagaaggaggctggcagctctagctgagaggtagcaggagctggtgcctgcttttgtgtgtgtgtgagagtgtgtgcacacacctaggagctatctcagccctgctggtttcttgagccagttacagcctggatcaggcgggagagtcccccctctccagccatcaaaacttacatcaacaaggtccaggaagaaagaaagaggaagggagatggggagcaggagacagggattgccaggttcaggttaatggggtggaatggattctctgccaagccaggtagtccccaggcccctgatgtggctccctagttggccacagggagggctggctggtcaactgcaggggcaggcaggggtacacatgacccaggcctagcctggaagtgttctcagcctggtcctgctccgtgggctcagggagccaggcaggatggggtctgggcctggaaacctggagggctgggctctgtagggagggtgggtttctgtcatgaagaaggtgtggggttggaactgtcgcttcgctggcaggacttgggctgggaagaggggcagaaggattctctggaggtggcagtgggggtgctttgatcatttacgcaggacctgggggttgggctgactctctctgctgcttcagagcggggctgtagaggaggacacacttgtaaagttgggggctttgacggctcagcccagccctcttcggcttttaatacggttctcccagccccctcgtcccctcctgggtacagccagagcttgttcaggacactggagtccctcacccgggaattccccaggctctgcccagctggccctgttgtgcagccgtggctctgaaggctgatcccatgccaaaccgtctgcttggtgatgggaccgcacacagcactccccggtcaccagcgagggccagatggaaagtggggagtgtgtgagcgcggcaaacttgtcgcagtcatgttgccatggtgacacaactctgtttagctgcctctctaccgtcctagcccacatggactaagttaagttttacctgcggttgcacggcaggcagccctgtctcccgaggacagctttttgaccagggcctgtgtgtgtgtgtgtgtgtgtgtgtgtgtgtgtgtgtgtacgtgcagaggggctcaagggagaatgaatccgcgtttctcccctcctcttctcacacccagccccagtcctggatctctttagccccgtggttctcagactttgccgtgtagcagaatgacctggagagctcgttggagcgcaggttcctgggctcatcactggagagcctggtgtgcacctgcaaatgtgcatgtctttcgagttcccaggtgccgctggtggtccagggaccatacttagagtagcactgctttagattttggtgcattggagtaaagaaaatgctcccaattctggtttctgcattgtatttttttttttaattggaaacggagtttcattcttgttgcccaggctggagtgcagtggcgccatcttggctcactgcaacctccacctcccaggttcaagtgattctcctgcctcagtctctctagtagctgggactacaggcgtgcaccaccacgcccagctaattttttgtatttttagtagagatggggtttcaccatgttggtcaggctggtcttgaactcctgacctcaggtgatccgtctgcctcggcctcccaaagtgctgggattactggcgtgagccacccaacccagcctgcattgtatgttaaactgtgtccgagagcccagtcactcttggaggagagaagggaaggcgcaggcaggtcctcactcacctcttttggcctcttcacaggaagcaggagctggccaacagctcggatgcgaccctcccagaccggccgctctcccctcctctcacggcacctcccaccatgaaggtaagaggcttcgattcaggaaggcagggaggggagagtgtggggaagttgtgaggccttgctgtggctttggctccaggcccagcagcgtccgtcgcagtggggctgtggagtgtcctgacacctcggaggaggtgatgttcagttaagcaccagtgcgggggaagcatgacaagagactcagggtgtctgtgtcaaggggcggtgaggacattggggttgaaatggggttggcaggactcttggtaattggtagtggagtttgggaacaaggggcccagccaggaggaagccgggggatagaaggcagctgcccagaaggactgcctggggctgggctgtggccctcctgggacttgaagggcatttgcatgctggtctgccggcctctggctggcccttctgagctgggcctgttcacggcagtccccatggaagggttggctggaggttcgggtcggggtggcagttattttcttatcagcacttccttcgtgagcctttttcctggggagaccacagtccaggctgctaggcccaggaccttctcactcctggacgggagccgagggagcagtgcccttctgccaccatgaccttcccccatcacttttcagtccgacgcctcggcaggatggccacacaggcctgagctggtcctcagaggagacttttggctcagccagtgtttctgcataggctggcatgcacgctctccctccctccctccctgcctccctccttccttcacactctgtggagtgagtgaggactagtgctgaagaagtcacctgcctcctgagtcatctgaggggacatctaggccagctcctctctgtcctggggctgtgctctgagtggctcacagggagatcatcaggcatctcttcctcactgctctgcatcacccctcctcttccctgaacctaatcttttgcaagatgacaacccataggaagcagataaaacccatccatcttcctgttgttgtcctgtatccgatacccatcacatacagagccatgtggtatgcctcgaggagcctgtgtgttgaggggtagccagagcctgccctgggtgggttaagtggtcagcggtgggcgggggggcaggacagggtgcagggctgaccaaggagagctgtgctgtcttccttgtgcagtacccagagggcagtggaagccagaccaccttcactagcctagtgcctgccccagcacccagctcagtgttggtatctgagccgggtgctgggccagctctttgcacagggtaatgctaagaagcctgtcaccattccgagtgtccccttggtctacaaaggtggctgtgggatgcttgtctctgtcctcacagatggcaggagtttgcagggagaagtctgacagtctcctaggaggagtccctgaattctcttggcagattttacttactcatgtactcatttaattcatttaatacccagtatttatttgaattttgtattagttaggactcttggttgtaagtgacagaaacataactcactctggcttagtcataaaagggtattttttgcctttgtaattgcaagcatagacggcaggcatgactgcatccgcaagatcagtctcattctttctctcttctgtgttggtttcattctttgtcaagctgcctttgtggcagccgaagggtggtagcagctcctacctgtgaagtaaccccagtgaaaagaaaagtatttttttcccccagtagttctaacaaagtcccagggaagaagctcattggctggcttaggtcacatgtttgtccctgaaccaattaccggcaccagaaagatgaaaggctctgattggccagacctgggtctcatgaccgcccacctaaaccataagaactgagaatgagggaggggtaggtcctagagggaaatggcggtggtaccatgagaagaaggggaagggatgcggggcaggcaagacccacagctttccgccacatgtgcgcatgctcagccaggcccagtgctcggttctggggaccttgtagtaaaccagacattgtggtccctgctctcctagagcttgtcgtctagctagggagccaaaaatggaaaaataatgtcaggaatgagggctgcacagttaaacgtggtgaatattctaaaggtgaagcacagcatagctcagggggaacgtaaggttaggaggtggggggactctaacctagtctcggagagggtcaggtagggctttttgttaggaaatgatgtttcagctgagccctgaaaattggataggtgctagttaggctaaggtggagtccgagtggaggagagtgttctagattcttgctgttcaaagggaggccaagggaccagcaacacctgcaccatttgcgagccccttagaaatgcagaatctcaggttccaccccagaccactgaatcagagtcagcttttttatttttttgagacagagccttgctctgtcgccgagccagagtgcagtggcgcgatcttggctcactgcaacctccacctcctgggttcaagcgcttctcctacctgagcctcccgagtagctgggattacaggtgcgtgccaccacgcctggctaacttttgtatttttagtagagacggggattcaccatgttggccaggctggtctcgaactcctgacctcgtgatgcgcccgcctcggcctcccaaagtgctgggattacagtcgtgagccaccacgcctggcccagagtcagcattttaccgtcattttccggtgatttgtatacacagggcagcttgagaagcactgctgtgggcctctgcacatgcgttcaggcagccgagagagagaaggcgacagcaagaggaaccggagggagatcagaacagctggtgaagccggagttagtgttggagaggctgggcatgcaggcagggaccagatcaagcagacgcttggacattctgctgaagattttagagtttattcctagttaagagcactggagtcattgacgatgttacccagaggattaagatgagacctttggaaaatcacctggcgtcatatggcgaatgcatggcagggaacagagtggagaggggatgagctgaggctgctgcaggatccaggggaagagatggaagcctgactcggaggggccggtggggttgtttggaagtggttggagctcagattttgcaggtggtgaattgatgagatatgagatttggggagaaggaggcggcgagaatggctcccaggtttgtagccagtagatacatgggacaaccattctctgagataaaggttggtgcaggagggaggattaggattcaattcttcttcttttaaattaaaaaaaaattttagggacagggtcgtgcgctgtcactcagcctggaggatagtggttcattccaaggtcactgcaacctcgggctcaaggatcctcccatcttagcctcccgagtagctgggaatataggcatgtgccaccgagcccagctaatttaaaaattttctgtagagacaaggtcttgctgtgttgcccaggctggtctgagactcttgggttcaagccatccttccgccttgacctcccaaagtgctgggattacaggtgtgagccactgcgccttgtcgaggggtcagctctaagcactgagttggacgtgcctgaggctcagaagaacattctgtgctggaggtaaacatctgggagcccttctcctagagaagggaatggaagctttgggatgagtgagctctccagggagaggatagagcaggaagagaggttcctgaggcggcacctcgaggtggtgctggggtctctgcagaggaggctgggcccggacatggagggagaagcatttcacggtggtgggaccggcagcagtgccagctgctgctgagaggccaagtatggtgcagagtgcacagtggccactgggctccgcggcctggcagttgcaggggatgtaactcagaccagccctgggaggggtggggcggacagcagatggccgtgtgttgaggaatgggtggagatggtcagagtcagagggtgtagacggtacttgtgaggtggggagcctggagtgtgaggaaatgtggaaaggagggagtgaggcaggggtgctcaggaatctggaccacagcagggattatttttaacatattctttcaaaaaatgatttgtgagcatccactgggtgcctgcccctgctgcgctctcccatgacaggctgtcgggaggggcctcaggcaggcccggagcagagcagcctcagggaaagctcagcagctgcagtcaggaggtgtcccttcctcctcctcccccgtgttctgtccttctcccctttgagctcagctcagcaatttcccagcctgtgactttactgcccaggccccaagcacaaggtcagagctgggaagggaggaaggggtgagggattgtcctggggactcagactgggtgggggtccttctgtggttggggttgggggtcagtgtgtgtggtgtgcctggcccgaggggttctctttgtgactgtcatttgggttcattctgtggcttagcctgtggctgcagttaggagtctgtctatggcgaggaggttttttccctttgtgtgaaagctaaccacccatgagggatttaaaaccacaatcctcaccttacaccagcctgctcaccacaggagtgtcccatcacaaaagtgatgacattgatgaaataatattgcagctcctgcttgcaggctgtccgattctttccttaacttgagttccctgagcatagcgactgtgtcctattctttagggcccccaggccctggcttagggtggggacctgggacttgtttatggttgctgacagtaagggacatctcggtcagaggaggttgttctgctcctgaccctccactcctctgcttctggctggatcctatatcccagcaggcctgggctccacctgccacatccctgtcctagggtgaggccaggcctctgcttggttgacacatcccaggttattatagcacactgaggccagagacgccctggatggaggctggcctctctccgagggtccctggccctgagggttcatgaatcagttctctgttctttgagcctcgggcagtgggagaaggcttcacctggttctcttggcagtgcaggctcagggagggtgtggcaggggcacccctttggttgattagcttgggagtcacagaagattagggatgggcgatccatttcctttataggtaaaccagaagccccaaggtaggaaatgactctcccaacgcaacgccgttcctcctcgagtcaacagaataagttacattctttatttttatatttattttttgagacggagtctcactctgtcacccaggctgaaatgtaatggcgcgatctcggctccctgcaacctccgtctcccaggctcaagcagttctcctgccccagcgcaccaccacaccccgctaatttttgtatttttagtagagatggggtttccccctgttggccaggctggtctcgagctcctgacctcaagtgatccgccagccttggcctcccaaagtgttcagatgacaggcgtgagccactgcacctggcccacgataagttaaattctaagacccaaactagttttggtcaagtgctcggctcatctcatgcttgctcatctcacgcttgcgggcccagggacggcctcttgtggctctcccactgggaagggctggctggagcagtagctggcctccagcctgagagtctctgccgcgctccccccgggcccccaccctcactggcgtgcctgctgctacccgacctatacgcaccctcccccacctctttgctgtttgttttgaaggggattttttttttttgctaatatgaagctgataaaaagcaaccaaagagatgctgaccagatgggctgaataagatcccagttcccagccagagctcaaactggctggtgccgggtgggctgggagagggacttgaggctgcgtctgtgggaataccgtaggtggtttccaggcccatatttttttttggaagctgattttcatgccccaatggatcagcaggcatttagggaggggcagttgtatgcccagaattgtgctgggtcccctgggtcacatcgaagctgcagtcctccaccctcagagagcctgccgtctacaggggccctgactgagccggagaaaccagatggctcagtgtgacaaggctcagatgtgaaatgtggcttctcagtggggaggagaggagggggaaacgctatgtggggaggtggggtgggatggggcggggtggggcagccggaaggggccctaatggcaagcatgggggtcagggtgaccccctgggaccatagacagtaaaaccttcccaggccccgtgaagtaaaggggttgattctcctgattctctcgacgctcatgggaaggacacagagcatttcactgaagtccactctgctgggacttgacctgaccttgtccctggagccgcaccgggccctgagctggctcggtcagctgggaggtggcccttgctcagccttccacacccctctttgtgcaagtctgagggcagcccctctcagaccttctcctttccagaagaggataatgtgcgcttggagttcccactgcagggaccagcagaacgtctggttcctcccttgctccttggcacgtggctctccacggccagggaatgcccccaccgcctctatggtaggtaaggcaggtgtgcaggcttcctatggcagggaagaggatggagatcagaggagcctcctccttgcccctctctatccctctgggcagagctgggctgggcctccctttctggctcatggattacccaccggccaccctctctccctggggttggggggtggtgtgtgggggcttctgttccagcttgtagcacagcccccggcctgatttcgtctcttcttttgctcctggttcctgcctcctgtcttctgttaggctgtgcagggagacttgcccctcatcagggtggagtgacagtgtcagccccccatacatccaccagctctggatggatgaagggaggaggcatttgtgggagggttgacgggagcctttctgggctggggcaggaagggctgaaggacatcagcaaggaggtttggtttttccctcttcaagaaaaccctgtgtagggacaggagaggacagatatatattccctccatccctactgctggagggaggcccttgctgaagctctgtgggtcctgggagagtcacctctggtctccacatcgattgtgtttctgttgccgctccggacatggttgggatacaaccccatctcctcaggagccactgcccattgttctcttgactccatccaggagccaaggaagttcacatctgatttaatgcaggcatgaggaagggcttatttggctactgagggtgaggatgctaactaggaggctttaagaacatggagatgttggctgggcatggtggcacatgcctgaaatcccagcattttgggaggctgaggcaggaggatcccttgaggccaggagtttgagaccagcctgggcaacacagtgagaccccatttctacaaaaaattaaaaaattagctgggcctattggctcatgcctatagtcccagctactctggaggccaaggtgggaagatggattgagcccaggagattgagcttgcagtgagttatgattgcaccactgcactctagcctgggtgacagagcaaaatcctgtttcaaaaaaaaagaaaaagaaaacatgaagatgtctgcatgtgcacctacttacctgcatgcatttccctcctcacctgtgcacacctgagcatgtgcctattttccctaattctgttctcttttttttttgagatggaatctcgctcttgtcacccaggttggagtgcagtggcgtaatctcagctcactgcaacccctgcttcctgggttcaagcgattctcctccctcagcctcccgagtagctgggattacaggcacacgccaccatgcccagctaatttttgtatttttagtagagatggggtttcaccatgttggtcaggctgctctcaaactcctgacctcaggtgatccgccggcctcagcctcccaaagtactgggattacaggcgtgagccaccacactcggccttctgttcatgttttaaggccaacttgcttatgcttctggaagattactctaggtgtaactggatttttaaaaatttgcagacacagaaatgcgtaagtcttaattgtattgtatactttgactaatgatacacccacgtgagccataccttgatcaagaaacaggacatttctgcaaccccagaaagttcccattgtcctgacccagtcaatcataactgcccccttgaggagcaaacagtgttctgatttttttcaaaagtgagttttgtctgttctagaacttaattttttttttttgaggtggagtctcgctctgttgcccaggctggagagcagtgacgcaatctctgctcactgcagcctccgcctcccgggttcaagggattctcctgcctcagcctccccagtagctgggattacaggtgcccactaccactcccggctaagttttttgtatttttaatagggacggggtttcaccatgttggccaggatggtctcgaactcccaacctcaagtgatccgccttcctcaggcctcccaaagtgctgggattacaggcgagagccaccatgcctggccggtgactgtttatatgaaactgctacactgtttgccaaatggtcaggccatcttatatcctcaccagcagtgtcatttgagttctcgctgctctgcatcctcatcaacatttgccattgttggttttgacaattttagctacttgaacggtatctcattgtggttttaatccacattttctcatgactaatgatgttgaatatttttcatatgcttattgactattcttatagttcttttttcccttcctccttcctttaaattcggtagtcttcttgtaggcgttctttacatattctagtcaagttcgtttcttttcttcttcttctgtttttgaggcagagtctcgctctgtcgcccaggctggagtgcagtggcccgatctcagctcactgcaagctctgcctcctgggttcacaccattctcctgcctcagcctcccgagtagctgggactacaggcgcccgccaccacgcccggcaaattttttgtatttttagtagagacggggtttcaccgtgttagccaggatggtctcaatctcctgaccttgtgatccacccacctcggcctcccaaagtgctgggattacaggtgcgagccactgtgcccggccacttctttttttttttttttgagacggagccttgctctgtcacccaggctagagtgcaatggcgccatctcggctcactacaacctccacctcctgggttcaaacgattctcctgcctcagtcccccgagtagctgggattacaggtgcccgccaccacgcccagctaattgttttattctcagtaaagacaaggtttcaccatgttggccaggctggtcttgaactcctgacctcgtgatccgcccgcctcggcctcccaaagtgctgggattacagacgtgagccactgcgtccggccttcttctttttagaaatagagatggggactcactatgtcgcccgggttggtctcaaactctggcctcaagtgatcctcctgcctgggctcccaaattgttgggattacaagcttgagccaccatttctggcccatttcttttcttgtttttattttttggatacaaggtctcactttgttgcccaggctggagtgcagtggtgcgaacagagctcactgcagcctcaacctcctgggctcaagccatccttccacctcagccccccgagtagctgggactacaggctggtgccaccacgcctgactaatttttgaattttttgtagggagagacagggtttcaccctgttgcccaggctggtcttgaactcctgagctcaagcgatccgcccaccttggctttccaaagtgctggtattacaggcgtgagccaacgcgcctggcccatttcttttcttaacggtgtctttaatgagcagaagttttaattttgaagaagtctaattatggactctttccttttatgtctgtagctttgtgtgtcctaagaagtctttgcttaccccagctcacaaagatttccttccatgtattcttttagaagctttatttttatttattttttttgagacagagtctcgctctgtcaccaggctggagtgcagtggcgtgatctcggctcactgcaacctctgcttcctgagttcaagcgattctcctgcctcagcttttcgaatagctggaactacaggtgcctgccaccacacctggctgatttttttgtatttttactagaaacggggtttcaccacgttggccaggatggtctcagtctcctgatctcgtgatccgcccgcctcagcctctcccaaagtgctgggattacaggcatgagccactgcgcccggctagaagctttattgttttagctctaggtctaggataaacttgttttaatttaattatgtatggcagtatgttggggtctaggttcatttattgccatatggatactctgttgttccagtactgtatgttgagaagactttcctttccttgctgaactgctttggtgccttagtcaaaactctgccaggcatgtaagtgtacacgtgtgtttgtttattgtctctccaaccatggtgtttctctgcatcagggatggaaaatacgtgccatccgtgccgtcagtccaccgtttggctcccgtggcagatactggtaattgatcatggcactctttcccaagagcttagacgtggtctcagaatcctgttcaacaaagcaccgtaggcagccactggcagtcatttggagttgtcatttgagataaatcacttctggcatctctgattgaaattgtcacaagaggttatttgctgaaggtcccacagctggtgagtggcagagccaggatgtgggctcaggtttgtctgtgtgggtctgaagcctgtgctgtcttccccacctctacagactgctctgcgtgaatcatttcaacaggtcgcttcatctccgtgacctccagtctcttcacttgcataatagggacggtggccaccgggaggagtgggtgtgggcagtaatgaggtcatccacagaatcgctagtggagcatctgatacgcaggtgctccgtgatggactgtgacgatggcgatggtggcgatgacaaccatgatgagtgagatgcagatgcccttgagaaacacacagtcagggcttctctctagggaacccagagtagctggctcatcagagtcccttgcctcttcttatgtatcttcgggcccgtggccttccaagctggaggccccagagcggagccacgcttcctcaagtttgctaatagggtgcgagccacgggcttcggcctaggcgtctaggccagctgagctgtgctccttctctctttgtgggaggaacagctggctgggttcgtagaattctctttctgggaaccttcttgccctctctgttgattctccagcccatctttctttcctttggattggccacatgatcctgcctgccacaggggcgattaatccagctccttcgacctggtcctggacccctctgaggttcttcttaagaagttgaagcaatagagggttgtagctaagaatacagtttctggagccagtctgcctggggttaaggcttccccacttcttcttctttttttttttcttttttgagacagagttgcgctcttgttgcccaggctggagggcaatggcgcgatctcggctcactgcaacctctgcctcccgggttcaagcaattctcctgcctcagcctcccgagtagctgggattacaggcatgcgccaccacgcccagctaattttatatttttagtagagttggggtttctccatgttggtcaggctggtctcgaactcctgacctcaggtgatccacccgccttgggctcccaaagtgctgggattataagtgtgagccaccgtgcccagccatttttggtatttttagtagagacggggtttcaccatgttggccaggctggtctcaaactccagatctcaggtgatcctcccacctgggcctcccaaagtgctggaattacaggtgtgagccactgtgcctggcccccccgtttttaaaattcatttttattttgagatggagtcttgctctgttgcccaggctgaagtacaatggcacgatcttggctcaccgcaacctccgcttcctgggttcaagtgattctcctgcctcagcttcccaagtagctgagattacaagcacatgccaccacacccagctaatttatgtatttttagtagagatggcgattaaccatgttggccaggctggtgtcaaactcctgacctcaggtgatccacctgcctcggcctccggaagtgctgggattacaggcataagccactgcacctggccaaagcttaccctcttcttagctgtataacctctgtgcatctcagtttcctcatttgtagaatagggatgtattagccctgtctcccattgctctaaagtaatacctgagattggataatttataaagaaaggaggtttggccaggcgtggtggctcacacctgtaatcccagcactttggaaggctgaggcgggcagatcatgaggtcaggagttcaagaccagcctggccaatatggtgaaacctgtttctactaaaaatacaaaaattagttgggcatggtggcgagcgcctataatcccagctatttgggaggctgaggcaggagaatcacttgaacctgggaggtggaggttgcagtgagtcgacatcgtgccactacactccagcctgggcaatagaatgagactccatctcaaaaaaaaaaaaaaaaaaaaagaaaggtttaactggctcacagttctgtaggctgtacaggcagcaggatgctgacatctgcttggctgttggggtggcctcaggaaacttttattcatggtggaaggtgaagggagaggaggcaggtcacagggccagagcgggagcaagagagcaagggagggtgccacacacttttaaacaaccagagctcgtgagaattcactcatgatcttgaggacggcaccagggaggggatggtggtaaagcattcatgagaaatccgccctctgatccagtcagctccctgcaggccccacctccagcactgagggttacagtcccacgtgagatttgagtggggacacaaatccaaactatttcaaggataataagagtacctgccctgggtggctgtagtgaagattaattgagataatatgcctttattgcttaaaacagaggtatgcagtaagtgctacataaatattagtcattattattcctccaaaaaactttgtttctgaaatgtgcggagaatagcaatgcttagagagaccatctagggggaagtacaccaggttttcggtgaatatagtttgtcaggacgccctgatttctgccctgccaggtgcccacagctgaggggcctgtctgtggaatgaataaggattgaaattgcattttgtgtgagtggccttccaagagccttgtggatcagactccaaaccctgcctgataaatgtggatgcccttgagggtcttggaaaaaggctaaaaaccaggatccagcccagcatctgagccagacctggaggaaggaacatctttctgggttgtgctttcacctcttgccttctgaatctgacccaaacaggggtctccagggtggcagaaagaacctgcagggtcgccatcctcatgaaggtttttgggactagactgagtcgagacttggataattcggggctgggagcgtcccaaggctggcgttggaatgagttttatgagcagtttgtccctatcataagtttctttcctaacttcttttgcctgcagctgatattaaaatgagtctgtatttcggggacagatgctgaccttgtggggaacacgggaagtgggggcagggcctaaaagccatggggggccaggcgggggagcagctgccctttcagcctgggtggcccatggtctggggggtctgggctgatggtaaaggtgaccggctgccaggccctccttccttagccctctcctttttccttttctcttttttttcttttttgagacggagtcttgctctgttgcccaggctggagtgcagtagcgcgatctcggctcactgcaacctctgcctcccgggttcaagcaattctcctgcctcagcctcccaagtagctgggattacaggcaccgccccatacctggttaatttttgtatttgtagtagagatggggtttcgccatgttggccaggctggtctcgaactcttgacctcaggtgatccgcccgcctcggcctcccaaagtgctgggatgacaggcgtgagccgccgcatctggcctccttttttcttttttttttttttttgagacaggttctctgtcgcccagactggagtacagtggtgcgatcagggctcactgcagccttgaccttctgggcccaagcaactgtcctacctcagcctcccaagtagctgggaccacaggtgtgcaccaccacgccctgctaggcttaaaaaaaattttttttaattcgtagaagcagggtctccctgtgttcctaggctgtcctttccccttttctcgtcgtgctctcctcctctttctgcctgttggtgagggctcggctctgtctccccttgatggcattcagaagactgatagagcacttggcattcagggcgtcacccaggggatgcccccaggggccccccaacccccgccccaggcatgccacctgcctttggaagcctgaccagccatcccaccccagaacttagcccctgggtctgtgacatccctgcctgttttcaggccctgcctcccccgctggatggtgctgggtctggggacagagcccttgcctcttcctgggatttagaaaccaactgtgtgacatcgtgcagttcagtcatcttctgtggacctcggtttcctcatttatagaacggagctcaccctgtagggttactgcagggattaaaggaggaagcaggcggacgagggcttcgtcaagtgccaggcttctgcaggtgtcgaatatcggcacataatggacaccagtggttgttatcatggtcaatatgccaaacacgcatagggtggtttcattgataatcccgcccttctgctctgccaactgccatagactctactccactgagaccggctcagcagcgggatgctgccagattctgtgttctgccacccacccccatccgctaccctcttccatgagtgtcatttacccgacactcaagcctgctgtgtctgggacttcagaggccagtggatggtgggttctgtgttgcttcgtgaagggatgtcccctgcgtagatctgtgcctcagtgggttcctcctgtgtgtgcccctcccgctggcttcttctcccggagcccccccggcagactctgctcttggcggagtgtggagctggagtttcaggccttggggtgtagatttgattcctagggttgctgtaacaaattactgtgaacttgatgggttgaaataaaaggataaaaggaatttcttatcttttttttttcttttttgagacagagtctcactctgtcacccaggctgaagtgcagtggcgtgatcttggctcactgcacctttctgcctcctgggttcaagcaattctcctgcctcagcctcccaagtagcttgggattacaggcaccggccaccacacccggctaactttttgtatttttagtagagacggtgttttgccatgttggtcaggctggtcttgaactcctgatctcaggtgatccacccgcctcagccccccaaagtcctgggattacaggcatgagctaccatgaccggccaggaatttattttctcacaactctagaggccagaagtctggaattaaggtgtcagcagggccgttaaagtgtccgcagggcctttaaggtgtctgcagggtcgttaaggtgtcagcagggtcgttaaggtgtcagcagggccgttatgtgtcctcagggccgttaaggtgtcagcagggccgttaaggtgtccgcagggccgttatgtgtccacagggccgttaaggtgtcagcaggaccgttaaggtgtccttaaggtgtccgcagggccatgttcccgccagaggctcgaggggaagctccttgcctgcctcttccagcgcctggtggctccaggccggggactgcacagctctgctctcttcctccgtcttcttcacatgtctccctcctcttctccctgggggtctctcctctgtgtgtctcttttaaggacacttgtcattggatttagagcccacctgggtaatcgggatgatctcatctcaaactccttcatatcttaaaattatatctgttatctcagtctgttccaactgttacaacaaaataccttagactgggtaatttacaaacaatagccatttatttctcaccattctggaggctgggaaatcccagatcaaggctccaagagacccactgtctgatgaaggcccacgttctgcgtctaagatgacaccttcttgcagtgtcctcacagggaggaaggcggaaggacagaagggattcgctagtccctcaggccttctatgaggacgttaatcccgttcccgagggtggaacctttattacctggtcacctccctaggccttgccttctaattccatcaccttgggagggacatgtacattcagactgcagcatgggtaaagaccctttttccgaataaggttacacactcaggttcctggatacagacatatctttttgggggccaccattacggggtcagggctgccctctcctgggagttcctggtgggagcttggtgaggtccccgaggtctgccagcacctgctctccttgtgtagttgtaagtcattcaagtgccactgcaagggtgtgtgtgtgaggtacagggtgttgcggggctgggaggacccagtgcagctccagctcgcacaaatggggtagagcatgatcttcccatccctgctgccccgggacctggtacatatggggccatggcaggtgcttcataaacacttagtagttggtgcttaataaatactcacaataggttttcagtgaatcctcattgattgatccagccttaaggatgtggcaatgaacaaaaaagtgcccagtattttctttttgtttttgtttttttttttttttttgagacagaaattcgctgatgttgcccaggttggagtgcaatggtgcgaccttgcactaccttggcttgtggcacgaccttggctcatggcacgaccttggctcactgcaccctctgcctcccaggctccagcgattctcctgcctcagctggagtagctgggattacaggcgtccaccaccacacctggctatttttttttttttttttgagatggagtcttgctctgttgccaggctggagtgcagtggcacaatctcagctcactgcaacctccacctcctgagttcaagtgattctcctgcctcagcctcccgagcagctgggactacaggcacctgccaccacacccagttaatttttgtatttttaatagagatggggtttcaccatgtcggccaggctggtctcaaactcctgacctcgtgatctgcccgcctcggcctcccaaagtgctggggttacaggtgtgagccaccgcgcccggccttttttttttttgagacagagtctcgctctgttgcccaggctggaatgcagtggtgcaatcttggctcactgcaccctctgcctcccaggctccagagattctcctgccttagctggagtagctgggattacagacgcataccaccacgcctggctaattttttttttgtatttttagtagagacagggtttcaccatgttggccaggctggtctcgaactcctgacctcaggtgatccacctgcctcagcctcccaaagtgctgggattacaggcctgagccaatgtgcccggctgttttcttagataatttttatcagttttttttttgtgtgtgtgcaaataaccagcaaatatgaaacaccccagacaattttaaataaaatgatatatgcatattataaagttaaagcaattgtaaagtacagagaaaataaaaaaatgaataatgtcctaatcataatcctaccatccagaaatatccgttcttaccatttgctaatcgtccagacatcttggcatcatacacatagatagaggcaaacataaatgagatcacactgtttgtgctcctttgtaataaaaagagctaaattcaattttccttgcattaaccaatgaagaagaaataaacaagtggctcagaaggagttgctgaagtttagagaaatgtttcctctctgtaagagatattaatttctctaagagttctctaacagtgaggaaaaagattatgataaaaagaaccaaacctttggggtagagatattaatttaaaaaggtaatttcaactttatacatagagtttggctccctgctttgaatatgagagccaggtgattttggaggagagagggtgcagtctgggaactttgagagtgctccttttgaggggacctgctgttctcagaagagcaggctgagtaacggtctgcacctcccgatgcctggagggagtgttccgagccgaggctcagttacacgtgggaatcaagcagagcccatcccgggagcgaatagggtttgttagcaaatgacatggctgagctgatttgatttggcagcaggactgagaagtttctgaaatgtcagatgttaataggatggctggttgtctctaaacgggaagccagaagtgggggtggatggccaggtgacgtcatctgctgtagaggaggaatttgggagaaaggaaatcggaggtggggaggggaaaagagggaaggagggaaggaaggtggaagatggaggagagaggccagtggcattagaggtggagggggaaagcgaatgagatggggctggtggaggagttgggtttgcttccccgaggatcatacgttggggtgggctgagtttgtcctcaaatatgttttgtttggccaacgtgatgttaaaaaagtcatttcaatactctttagggggaatgtcccctccccaatcctatttcgtcttggagcctatctcctccctggcccctgaagacatctgggtttgagaccttcgccagatgacctgtggctctttctagagctctttcctccggggggctagtgggtggcccaggctcagaggagaccagaattgcatctcatctcagagatgccacggggatcaggagaattctgagaatcaggtgagatccccaatggtgccctgacctcaggccgctgtggattccagatgtggtttgggactgtatgtgagtgccccttggcggtggtcagttccgtggtctggagagctgggctgtgggagacaggaggcaggagctgttgttcttgtctgcttggcctcgtgcttggtgactcttggttgaaccgggaagatgtgatctctgttctttgaagacataatggccgtgaggaggcaaaaaccacagaaaccttcctccaaaagtgatgcaagatgagccattcgcacactgctgtaaagaaatacttcatcgcagtataaatagaagaaataccggagactgggtaatttataaagaaagaggtttaattgactcacagttctgtatggctggggaggcctcaggaaacttacaatcatgaaggagaagcatgtgccttcttcacaaggcagcaggaaagagaagagcgaaggaggagcttccaaacacgtaaacccatcagatctcatgagaactcactcactgtcacgagaacagcgtggggaaaaccgctccctcgctccactcgtggggattacagttcgagatgagatttggatggggacacagagccacacctttgccagggtaagctgaaaaggccaggaattccttggatgatgctctccctgccttttctctaagaggaggttgattctggggcttggaaggtacttccaggccatccttgaaggagctcagagtgagtccttcaaacaccagcatggaaaagcagaaagcaggccagcagccctggtcagatctggggagcaggaaggcaggtctgcaaagcctggggagggtccagtcagcgtgggtccgggccgggttaggaacctggtcaggccaggcccggtggctcatgcctgtaatcccagcactttgggaggctgaggcaggtggatcacctgaggtcaggagtttgagaccagcctggccaacatggcgaaagccctgtctctactaaaaatacaaaaattagctgggcgtggtggtgggtgtctgtaatcccagctactcaggagagtgaggcaggagaatagcttgaacccaggaggcagaggttgcagtgagccgagatcatgcccgggcaacacagcaagcctctgtctcaaaaaaaaaaaaaaaaaaaggaacctggtcagagcagagcaaggctgagccctgggggtaactgagcttagtgttactcatggagacaggagccaggaagcgcaggcctcccggcccatcggtgcagcctgacttggcgtggacagccccacctccacgggcagcgcccacgtcctcttcacacggcatgatctctacaacccatctggcagctttctccttgctgtgtgagtcttgggcctggtagaagtcaggagtgtacacttggttttttgaggagcagctcagagcttcaaggcagttacaacaataaagctcactgcacactgtgaatatgtgccccagagcatcgcagttttgaggatgggagtgagactagcagttcagaggcacggtgccagagtgtcacagttcctccctcccccaaagccagcttgtacttgaacctgtcgggaggtttctattagtttcttatggccgctgtcacaaatacccacacacttagtggcttaagacaacacaaatctatcatcttacagttctgaggttagaagtatggaatgggtctcactgagatcaaatcaagatattgccaggggctgggcgcgatggctcacatctgtaatcctagcactttgagaggccgaggcgggcggatcacctgaggtcaagagttcgagaccagcctggccaacatggtgaaaccctgtctctactaaaaatacaaaaaatactacaggtgtggtggtgcatgcctgtagtcccagctacttgggaggttgaggcaggataattgcttgaacccgggaggcggaggttgcagtgagctgagattgtgccactgcactccagcctggggaacagagcaagactccatctcaaaaaaaaaaaaaaaaaaaaaagatattgccagggccgcattccctctgtaggctctaggggacaatctatcctcttgtcttgtcagctcctagaaggccacctgtattctggccccatacctctgttttcaaggccagccacgctggagcaagtctttttttttttagacagaatctcgctctgtcacccaggctggagtgcagtggcgcgatctcggctcactgcaagctccgcctcccgggttcaggccgttctcctgcctcagcctcccgagtagctgggactacaggcacccgccaccgcgcccggctaattttttgtatttttagtagagacggggtttcaccgtgttagccaggatggtctcgatctcctgacctcgtgatccgcccgccttggcctcccaaagtgctgggattacaggcgtgagccaccgcgcccggctgagcaagtctttctcacaccgccgtctctcggattccctctcttctgcctccttctcattacagagactcttttgatcacactgggtggacctgggtcatccaggcccctcttcccatctcaggggcagccttaattctagccacaacctgaactcccccttgccgtgtaacctcacacattcccaggttttggggattgggacaagggcacctctgggtgtgagtgttggggggcagtatttggcctatcacaaggacccaccttcatgggctttgctcagccctgggtcctcatcggtaaaatgggcatctctacctgcttcctagaggaaacgctagccggcccaccgcatagcgggccttccctctgtgggattccgtagttctgggactaattcttcacctgcctgatctcattgctttgcgagcccgtgactgatgatacagtatcagatgtccttgccctgatcccacgaccatgagacttgaagggcagggatggaatatgtgcctaagcatttccacagagagaagagggacatagcacacacgctgcagcctagaggagctatgaccttggttttgttaccgtcagtcagctgcttgctgatcccccagcaactgatggaactgatggaaaagccaccactccttgagagaggaagaaaaaagacttatgttaagctttgcccagctctgatttggacttgcccaattttacttgaaggaaggtgccactgtccgcttcccattcacacatcgccgccttcctcctgtctaaccggaatctttcttgttgcaatttcagcctgctggctctccatgcggccggtggggaaacagcaaagctggttcccacattgataatgacacctaatcctgcaatctgcttctgtccggttctaatcacgccactgcttccattcccaggaggaccaggggcaccctctgtttcgtcctgacaaagtggactgcccatggttgacagcctgcgtgtccggggtcgcctgggggtgagggtgggaaggtgtgggagggacggaggcactgccttctgctcagatgagcagcacgtagataaccctccccaggtgacctgcctggcatggaaagtccttctcgtggtcccccaggtcagatagcgttgcctggctacggggcagtcagcgaggctccggcagggcgagtaaacaggcacacatgtttaaaattcaatatcactggcgggcaaacactccagcagcgccttccagcccaccgataatctctaattctcctcgcttgatgcgtgtgggggccctgcaccaagacccagatggtctcttctgggaattggtcgtcagctgttgtgagggatggggagtcggaggggtgggggtgcctgttatagcctcagcctcatgcagactatcatcctgatcgctctgggcaggctcctgagagacccaggggctggtctggattcactggctgggtggagcttccagggtggggagctgtctgggttcagtggctcacacctgtaatcccagcactttgggaagccgaggcaggacaattgtttgaagccaggagttcaagaccagcctgggcaacatagcaagacccctccatctctaaaaaacaaaaactagttgggcatggaggtgcacccctgtagtcccaactacttgggaggctgaggcgggaggatccctggagcccaggcatttgaggctgcagtgaaccatgatcgcgccactgtactccagcctgggcgacagagtgagactccatctcaagaaaaaaataaaaggcaggggcctttggggaagctcatgcagatttttgtctgccttaggctgcaaagaggctgtggagggggcagggcctgtggagggtgtgcacccggcacaggcgatgagtgagggctggaatctggcaatcccctggccccgccaggtgactgtgatgggcggcatttattaagaggaaggggcgctccatctgcagggtggaagaaggtaagccagcctcctctttgctggaggtgcacacatggctgcctggggcatctcctggggcagttggtgagctggttcctggtaaagtcattcctcgtagggatcgtttggcatcaacacggggagcaggtgaggttgactgttttccctgcatgtgcctcatgcttgccctcttccgttgcttaggcttccttcccttcactgcctttcatgtgtcaaggccaggttatgcccctggtagcgaagaccccgggactgccctgcccgctccacgaaggcagtgggctcttttcctgggtacactgttttccagaggcagccctgatccaggctgcctgatagttccaggagatgacggtcctgagggtgcgtgcccagcctgaggcttgtaggttcagcccagatcaccagtgcaccccgagatcaccagtgcacccacttctccagtagacatggcctgtccttcaggcctcggcggggggcagggccacgatgagcagactcgtcactcccggagccacctgctcacccttccctctgagtagcagtgtggccaaaggacctcttagtttagtgccttggggccatggtgtgtcacctgccctgtgtggctctgaaaggctcctggaagggtgtctgggactgtaagaggccagggctctcttcgagatggatctgccttgcagtcaactgcctcagcctcatccatcgctggctgggagatgactgggagcgggattgtcccagctgtgggtctggaccttcctacagtggctcaccaggcccccttgtggccaataccatcagtaccacgtgggagcctgtggctggggctgggggtctggggaggggtgacaagcccaccagctgctcactgtgccagctgggtagacccagagggtcaggcggccaggaactgggaccctgccctgcgtccactgccagcctcagtgctcaggtgccctggagacctcattagaccaggcctgagtgggggcgtggcagcttcctcactcggaatggaggcttctgttacttgccctgcatttcctacttcgcaggctcatccggagtttcagtcttgcctggcctgcagcttcagccgaggtctgcaaggcagcaccagctcttggagccaggtgggaatgccgcttcaaacacacgcacagaggcatcgctctcttttggtagaaaagctgtcggattgtaagacaaaggctgaggtctctaacgtgtcctcctttactctgggtgcctcttgtgttacctttgtgcttgagtggggggaccacaggacaggcaaattagaaactgcacgaaacaaaacaaaatgcaaagaaaaacaaaatcgaaacaaagaaatacaatataaaacaaaacaaaagagctgggcgtggtggctcacgcctgtaatcccagcactttgggaggccgaggcgggcagatcacttgaggtcaggagtttgagaccagcctggccaacatggtgaaacttcatccctactaaacatacaaaaaaactagccaggcgtggcatgccctgtaatctcagctgcttgggaggctgaggcaggagaatcgcttgaacctgggaggcaggggctgcagtgagccgagatcgtgcccttgcactctggcctgggtgacagagcgagactccatctcaaaaaaaaaaaaaaaaaaaaaaagaagaagagaaaccacaacagatgataactgtttatggcaggagggtgtgtgcagctgggtcatggtccccaccttttgggctgataaacctggctgagggctaggcgtgtatgtttgccatgagtgagtgtttcttgtgtgtgtgtgtgtgtgtgtgtgtgtgtgtgttgggtgaacgtgactgtgaatgttgtggttagttctttgttgtatcaagtgttttggatgtctgtttgggggtggatattgtgggacgccacgttggtgtgaatgtatctgcagctgagtgattcccccagccaggacagcggggccgggaaggacagcccattgtccctaccctaacctcgttagggcctcgtttgccccagcacccccttcttcagccccagctggcaaaagggggtggggcaatcgtgttatttaacatacagcttatagggaagagagctgttgagcattaaagcccccatgcggttgttcatgtataattaggctgtgggagcttggggactgactgactgttagaatcactcgggaccgaagcacttatttaagtaatcattaactggaagatgggaaaggaacagaacatgcaatttgcagatgtcccctcttcttgcaggtcagcctgaaatgaaactcccagcaagtgaggaggctggcgccttgctcagccttcctcttccctctggtgaggggaagggcaggttaggggatgctggggctgagttggggttatggagatggcatctctcaggcacatcagaagcacaagccccccaaaatttccagcttctcatgactccttcgctgacaccgccctttacccagcagcacaaagatatataatgatatattcagttctcagtccggcgcatttgatcaacacctgctctgcactaggccagggacggctccagcaaagtcccagtaatccgttgtcccaggtggaggaggatgttaacaggaagagcccagataattgaaattctggtttagctcatctgtaaatctgcttttgctgcttcccagcagtgctgatgtggtcatgggggatgggacgctgtgttttcctccttcgcgctgaagcagagggtgcctggctgggggtctctaggcaggagcgtgtgggagcggccaagttctggagcagttaaggctgttagtggtgacggggcacctcatggtctctctgggggacaactgcagccccagtggaggaggagggagactggccaactgcatatcccataacaagtgtgggacccggagctcagggagaggagagggaggaagggtgttcggtatgtggtgtgtgtcttggcatatgatgcctcttgctttggaaattctgtgaggttccatcctttttatttattatttattatatcgcgccactgcactccagcctgggtgacagagtgagactccatctcaaaaaaaaaaaaaaaaaaaagaggagctcgagaccagcctgaccaacatggtgaaaccccgtctctactaaaaatacaaaaattagccaggagtggtggcgggcgcctgtaatcccagctactcaggaggctgaggcacgagaatcacttgaacccgggggaggcagaggttgcagtgagccaagattgcaccactgcactccagcctggcagcagagcaagactccatctcaaaaaaagaaaaaaaaaaaaaaaaaaagagcagggaccacgggcagggtatgggttccatgtctggtctgtgatgtgttccctctggatgggcaaacccagaagcttcttcagcccctttcctcctccaggcacaggtcgaggctgggattgcgggaggaggggaatggcactgggatctggagtgcctggttctcaacacttgcttggcagaggggaggaggcccagtgtccccgcgtacagggcagcatggctgcggtttccctcctccatgagccagccagccagacagtgggcaggagagggcgggaagagagaagggcgagtggaaggaaatggagtcgtgtgggcgggtgagcaagttggaaagcgcctggtgtagagaggaacattgttggggagcagagaccactgtggagtgagggagggggccagctgtgcctcttgacacagccagacacctgcccgccagggccagtaaagtgcctggtgtagagaagaaccttgcctggggggcagagaccaccgtggagtgagggagggggccagccgtgcctctgacacagccagacacctgccttccagggccagttaggagagggtacaagctgcggagcccatggggctttgcattttccagggacaaggaagcttggagcgaagcagagattttccgggaggccaacacctcccttttctcccactctgtcagcctggggggctctttattcccattctttagagagagacacggtggagaagatgggaccacagctgtggctgctgggtagaccgaggccaaaccagccccctgctcactttcctgcctctaagcctttgcctgggctgttccctctcctagaatgcctaaccctctagttgaccctgttacggacctggcaaggttagtcttgaataacctgatgagatttccagagctgcttttttccagttcccccactaagaggcttagacctgaagctgagccccactttgggggaagactggaagtttcaggttgaagaccggatcaggaccaggagctcggccagctgacgctgcaaagcctgccttggagagtctgtggcgtaggaaccttacgccttaaccagcgtgggcagctcggaagcaggagccccagttgtttcttggaaaaatggggccgattgccccaaggcagccacgcccttacagagcctcttgcaaatacccacagggtcacccgtctttggtcacagccacggatggcgtccgtcatccatgcctcatctttatcctgtttgtactttaggttggttcagtacttgactgtttacaaagcacttttttttttgagacagagtcttgttccgttgcccaggctggagtgcaatggcacgatctcggctcactgcaacctctgcctcctgggttcaagtgattgtcctgactcagcctcctgagtagctgggactataggcatgggccaccatgctaggctaatttttgtatttttggtagagagggggtttcaccatgttgaccaggctggtcttgaactcctgacctcaggtgatctgcctaccttggcctcccaaagtgctgggattacaggcgtgagccaccgcacccggccttgcaaagcactttcttgaactcttctggttcttgcagaaaagaagaatgatttccccattgcgcagagaagaaaatgaaatactccttttagccagctggtaagacacaaacctgagtcttgagatttcaaatccactgttctttctgttaccccaagaaataattactgagtacaaataattactgagtgtctactactgtatttcattgcttcgaagacactttcttccctctcatttaacaactctgaaatcagggtgcatctcatgagcaatagcacaccgtaatttgtaattggaagcatttttgctttcttagcggagaacaaaataatgtgtaccttccagtggatgtccttttagtttgacgaaatctggtgcgtgcacaactgtggtgtgtgtaaatatggcctctgcctgcaaggtgtgcagtttagaggaaagatcagtcttagctattcgtgtgaaacagaatatgacgcctaccaaaaccaactcgagtgccgtgggaattccagctgaggggcttcagaaaagctttagggaagacgggtgggatttggcctctcagcatcctgtaccatctgcatcaaccagctgatttagacaatacacccaagccctgttagagtgaaggctcaaaacttggcccctggaggctgactatgggtttgcattgcctgtcgttctagatgtttaactctcagcctcagttttctcagtgacagagtggatgtgatgatagtgcttgcctcacaggtaggcgtgaggatcagataaaagaacatattcaggccaggcgcagtggctcacacctgtaatcccagcactctgggaggccgcagcaggtggatcacctgagatcaggagctcaagaccagactgaccaacatggtgaaaccccatctctactaaatacaaaaaataagctgggtgtggtggcgggtgcctgtaatcgcagctacttgggaggctgaggcaggataattgcttgaacctggtaggcggaggttgcagtgagctgagattgtgccattgcactccagcctgggcaataagagtgaaactctgtcacacacacacacacacaaaagagaacgtcccacatctttagtcaagggtctgacagatagagtgagagatcaataaatgtcacccccccgcccccatcctgaaattaattctataaatccagtacacgtagagccggcagacatttgtcgttcgatcactgttgcaatgtcaagcacgttcacatttgtggcctcatttgatcttcggaagtgccggaggatggggatcattactccagtgtcacaaaggaggcaagtgaggcgcgaggcctcacagctggccggtgaccgggctgggattcggaggctggtctgtctgacgctcagtcccatgctctcttcaccggattgcagctgctggagaaaaaccacaagcaaggaaggaaacgcggccgatctggcgggtttgctccagccggggtattttataaatgaatgatcactgctgggcatccttaatagtggggtttctggtttcgagagaagagaggtctcatttagaggctcaggaggctaatttgacggtggggagatgtgcgcagaccgccatctcctctccctgtctccacctccagtggccggtggccagttttgcctctttttttttttttattattatactttaagttttagggtacatgtgcacaacgtgcaggtttgttacatatgtatacacgtgccatgttggtgtgctgcacccattaactcgtcatttagcattaggtatgtctcctaatgctatccctcccccctccccccacccagttttgcctcttaagtactatttgtctcgctggccttcatgcctccttctttgcttggttgcctcccctggccatggagaggatgtcagagtgtggtcacactggtctctgctcatgaccctgccaggggctgtgggccttctccgccagccagattctcctttgtgccctctgaggttaacacagacaaacgcactcaccttcttcctccctcttcctctccttcctccctgcctcgaacctctttcactcagaacacctggctttgctagtaacaggctgtgtgaccttcagcaggccagttaacctctctgagctttagttaccctcccccggtgccccaaaatggatgatcatgagggtcaaatgggaggtggtaggaatgggtcctgggctctgatattgagtcttgctcttctactgtgtaccattagacgcagccctgacttcctttttacctctgtggctttatctccaaaacagagggaataactctctggaagtcctcccgggacccccttccttgcaggagagccattgcccactcctctgtgcgcccaggcagctgtgggctttacccatgctccttgctcttcgttttccggattgtaattatttgcttctatgattgtcatagtcaccagactgaagtcagttcctttcttcagttattcattcagcaagtgtttactgagcatctgtgtgccaggtgctgggattacagatgaaatgggggaaacagctaattaaacgagaagttttaaagctgagagttaaagtggttggatagggcatgtgtaggacgggagtaccaccttgggacagggaggagggtgcagaccaagagggcttcctggaggaggtgacctccaagttaagacctaaaggccaagtaggagtcaagcaaataaagtggagtgggaaggaggagagggaccgagggtgatcttccttggtctccagctccaagccagtgcctggcctggaggagatcagtaagttggttctccatctctcttcttccttgctccttctgaatgccttcctgcaaagaggcaggagcctggatccttggttttctggaccctgggatgctgtggccaagggggttgcagaagtgttctggatatggcatgtccttccagcttggggcacgccacgttcctgaggctggggctgcaggaacgggcatggcagcgtgtgctgggggacactgtgctgaatgattcactggctctgagtaggagtggagatgagccaggccagcagcacgtgcaggagggagctggaaggatgctgaggatgcacgagccttatcctgggtccctttttccaggggaaggagagaagggctcagtaggggacagcgaggctcatgaacttgacaatatcatttctccaagatagtcttttatgtcagaattttgagttggaaggaacattgccaggcctctctgcagctaggggtccctctagcacatggagcttccaaaggaagtgaggtggtgcagttcacatgctagagctatgctcctctcctcctttatgccctgacctccagcgtcattttaagcccccggggatggacctgtgccaaggtcttctctgcctggcctcgattaagctgtgtcttcccccagcccctggagacatttcctggcctctgttctcccttggaagactgtggggttctggagctgaagcaagcacaggatagggctgtgctggagagaggagacgggctttgtgcctggtggcaggctgggcaggagcagggagcgagcacggagccagggctgggaggaaggatcgatgatcatcacaatccccattgacagaggacatttcgtgtctcaccttgctctggacacagcacgtacgtcatgtcctattctacagccactttgcagagtggcttatatttctcccattttatagatatagaaactgaggctcagaggctgagtgaccaacccatgcagcttgtcagcagcagggccacgagttagtagcttgtctgccccacactaggtctggagctgtttctcccacaccacactgccttgttttgagggtttaaaaaattcattcctttccttccaagctggggaccttgctttcctctcaaagctggaacagaaccgagggccctggatgggtatggagcgtgacatgtcattagtgttggaaaaagactgtgagacccaggggatccctgggctgagccggggctggcttctccttccccacagcaccaagtgcctctgggccctgagctcatggtgtgtctcccccagccattcgctatctttaattttttttggtaaaataattacagggcatgagcactgctatctttatttaaaccatgttaattttttttaaaacagagtaacacacacacaaaacaccttggataaaaaaaataaatatctggctgggtgcggtggcttatgcctgtaatcccagcaatttgggaggcctaggcaggtggatcacctgaggttaggagtttgagatcagcctggccaacgtcgcaaaaccccatctctactaaaaatacgaaaattagccgggtatggtggcgggtgcctgtaaccccagccactcggggactgaggcaggagaatctcttgaacccaggaggcagaggttgtagtgtgccgagatcatcccattgcattccagcctgggcaacaagagtgaaactccgtctcaaaaaacaaaacaaaacaaaaaaaatgcttcaggctgttcctcaaagaaaacggttccctatgcctctgcacacccctttccagtcctccaagccaccacttattctttttttttcttttttgagacagagtcctgctgtgtcgcccaggctggagtgcagtggcacagtcttggctcactgcaatgtctgcctcccgggttcaagtgatcctctgcctcactcccccgagtagctgggactacaggcatgcgccaccatacccagctaatttttgtatttttagtagagacgggctttcgccatgttggccaggctggtctcgaactcctgacctcaggtgatccacccgcctcggcctcccaaagtgctgggatgacaggcgggagccgccttgcccggcgcacttactcttttagctctttcttcacacctcttaggtggtgtgaggtgcgtgggaatgcctcgaaagatgcaggcaccggtctctcttttacttgtttttatttttcttgcacagagagggcttcccagttcagagaagggaaaattgaggcccccaccaaggggagcctgctggagtctccaaacacacaagacccggggtctccttcaggcccaacactgtggctggtttcctgtgtcccagtcgtgccttccgtccggccacgcgggccagcagtgttgagaactcactcagggcagggatggaggggggaggcttctcacccctttaccttcctaggccccagtgggcgtccattcatcacctgctggcgtggggcctctcccttggaagggacccccttgcccttatgacgtaagacgtgtggcacctccatcagccctgggttccccagaaaaacgcccgcggcagaggacaggtcaaaggtcagcgctagtcagcgtggactaacagcttcgggcggacacccgagtcctgtagttccttgtttgatctgaaggaagttgtccagcgtcagcagcagccgccgccgtggtggtagcagctgcagtggagctaaaggcagcagggccccgactctcgggacccaggccctggcgggagatggatttcttaaagtaccttttcgtgagtgtccctgggctgtggagggatgcccgtccaggccctgctgcctggagggggtggggaacagagcctctcctgttgtcacctggctgggagccccgagtggctgtttgcctgccacgggtcatggaagccacccttcactcaggggaaggaggaaccgagaccagggacagaggggcctctgggtgggggatgtggagggcaggggacagactcagcacccgggcctttcctccctggcttggagattcgaggtgggtcctggcagagggctggagagaactcacttctgtgttcctctgggaaggcttctcggctccctgccggggcccgagggaacccactgccagccaaaggctgtgcataggtgggagttgccatggcgagagggggagggactcctcagctgggcttccgcctggcctggacgcttggagctggccaggctgcgggtcctgccctctcttctttgggctgtggttctggggactctgtgtcctgtcacggagcctcagagtgtggttagtgtgaggcccagcgaggagagtgtgagccgtggtcctctgctgccaagccacactgtccctgcaggctctgcagacgccccttccagctttggcagaccctttgtgcccgctcctggtgaacatggggggcccacgcggacttggccaggtggggactgtgaggctcttcgtctttcccctgcctgctgccagcccgggactggctgttttcttgcctttcttctccctccttggctgtgtcatctttttctctatgggagtcaagggtgacaattcagggacgagtgtgaggagtgacaggacacttgtttgtggggttggaccaaggagttccccaatctcaggctgcaccgccatgggctccaggatgctgtggggggaccggggaccttgtgaccagccagaaacggcccaacctctctggaccctggcagggtgtgggtagtggtatagtggagagttttaagctgcgaactgatctcacctgattgatgtttcaaaagaccgcgtgggccgggaacggtggctcacgcctgtaatcccagcactttgggaggccgaagcgggtggatcacttgaggtcaggagtctgagaccagcctggccaacgtggtgaaaccccgtctctactaaaaacacaaaaattagctgggcatggtggcacgtgcttgtaatcccagctactcgggaagctgaggcaggagaatcgcttgaacccaggaggtggaagcggaggttgtggtgagctgagattgtgccgttgcactccagcctgggcaacagagcaagactccatctaaaacataaattaaaaataaaatgaaataaaaacaacaaaaacaaaaaaaagaccatgtggctgttctgtggggaactgatttgagagggggttggaaggaggcaggagcccgaggcgctgtccagttgaggcaccgtgagatgagggaggcagtgcaggtaaggagaggtggtgagatgtgggatgccttgtgatggcggacttgccaggaggattggatgtggaggatgagggatcaagacatcagtgatgactcttgggttttttttttttttttgagacagagtttttgctcttgtcgcccaggctggagtgcagtggtgtgatctcggctcaccgcaacctcctcacagcaacctccgcctcccaggttcaagtgattctcctgtgtcagcctctggagtagctgggattacagacatgtgccaccacgcctggctaatttttgtattattagtagagacggggttttaccgtgttggtcaggctggttttgaactcctgacctcaggtgatccacctgcctcggcctcccaaagtgctgggatgacaggcgtgagccactgcatccagccgactctctgggctttgtcctgagtgtcactgagatggcttttgagggaaagaatgaatgagagttcctgttttggcctctaacttgggaagtttgaggtgcctgtcagacatgcacgtgagatgctgagttggcaaaccttgatggatctgaatttgaatcaggattcattctgggcaagttgcttaaccactctaagtctccaaccctccaggcctccctccccgagtacgtgtgaggcgtatggaaagtgcccagttcagtgccttatacctgcctggcacatcaccagtgcccaacagaggataccttgggacttcctacaacattgcttaatatcatctcatcttccagctcaggaacattcagtggcttccatagcttgaaacttgtgtttggggctgaaacttgggggctgatttggctcatagaatgattacgtttggtccacatagagatttttaaaattttgtgtcatccatgtacaaaaattgggagactcacacaaaaaattggatttctggcttattttgaaaacttcagcaacactgagcttgcctttctgctggacagcttagtgagagataagtaaatagtggccgccccctttggaatggccgtgtgctcttcagtgtaccattgtctcagtctcatgctctttttctcttttaaaaaaattggtgaaatttatataacataaaattaatgatcttaaagtgaacaactcagtggcgtttagtacttttgtgatgtcgtacaaccatcacgtctatctaattccaatttttattttattttatttttgagacggagtcttgctctgtcacccaggctggagtgaagtggtgtgatattggctcactgcaacctccgcctcctgagttcaaacgattctcctgccttagcctcctgagtagctgggatgacaggcactcaccacccacgcctagctaatttttgtatttttagtagagatggggtttcaccatgttggtcaggctggtcttgaactcctgacctcaagtgatctgcccgccttggccacccaaagtgctgggattacaggtgtgaaccaccacacctgacctagttccaaaatatttgatcatccccaaataaaacccctttaagcagttactccccactttctcctccccccaagcccctgacaatcacgaatctgttttctgtctttatagatttacccatcctagatattttatagagattgaattattaggcttctgcacagcaaaggaaacaatcaacagggtggaaaggcagcctacagaatgggaggaaatatttgcaaaccatatatcagataaggggtcagtttttaaaatgtataaggaactcctacagctcaataataaaaaagcctcacctgatttaagaagtgcactataggggtgggtacagtgctcacgcctgtaatcccagcactttgggaggctgaagcaggcagatcatctgaggtcaggagttcaagaccaggctggccaacatggtgaaatcctgtctctactaaaaattagctgggtgtggtggcacacgcctgtaatctcagctgcttgggagcctgaggcaggagaattgcttgaacgtggcaggtggatgaggcagtgagctgagatcgtaccagtgcactccagcctgggtgacagagcaagactctgtctccaaaacaaacaaacaaaaaaaaacaaacaaaaaccaaacaaaaacgtgtactaaagacttgaatagacacttctccaaagaagacatacaagtggtcaacaggtatatgagagggtcgttaatcatcagggaaatgcaaataaaaccacagtgatatatcacctcagacctgttaggatggctagtatcaaaaccacagaagaggccaggcatggtggctcacgcctgtaatcccagcactttgggaggccaaggagggcggaccatgaggtcaggagatcgagaccatcctggccaacatggtgaaaccagtctctactaaaatacaaaaaattagccaggtatggtggtgtccgcccctgtaatcccagctactcaggaggctgaggcaggagaatcgcttgaacccaggagtcagaggttgctatgagccgagattgcgccattgcactctagcctggcgacagagcgagactccgtctcaaaacagcaaaaccaaaaaaaaaaaaaaaaaaaaaaccaaaccacaaaagataacaagcattggtgaggatgtggagaaattggaactcttgtaacactgttggtagaaatgtaaattggtgcagccgctatgggaaacagcacggagattgctcaaaaaattaaaaacattaaaaagagaactaccaacttcattctttgcacgtggatatccagcttttttgcagcgccatttgttgaaaagactattctttccctaggattggtcttggcaatcctgtcaaaacacagttggccatagatgtgtgggtttatctctggactcttaattctactctgtcggttcatatgcctgttattgccaggaccacacggttttgatcactgtagctttatagtaagtattgattgggaaatatgagttctccacctttgaccttcctctttaagaaggttttgagtattctggatggaatttccctatcaaatttaggaggagcttttcagtttcttcaaaacatccagctaggattctgatagagatcgcgttagataggtagatcactttgaatggtactgccaccttaacagtattaaatctccaatccatgaacatggaatgtcgttccatttatttatgtcttctttaatgtcattgggcaatgttttgtagtgcttagtgtgccagccactcggttaaatttgttcctaggtattttattctttttaatgctattttattttttattttttgagacggagtcttgctctgccacccaggctggagtgcagtggcactatctcggctcactgcaagctctgtctcccgggttcacgtcattctcctgcctcagtagctgggattacaggcgcccgccaccacgcccggctgattttttttgtatttttagtagagacgaggtttcactgtgttagccaggatggcctcgatctcctgacttcgtgatccacccgcctcggcctcccaaaatgctgggattataggcgtgagccaccgtgcccagcctaatgctattttaaaatggaattgttttcttaattttctgattgtttattgattgtttattttaatttattatttttattatttttattgtttgtcttttctgattgtgtctctccgattgttcattgctggtgtatagaaacacaactgatttttgtactctgcaattttgcagacttcctttatcagctctagtagattttgtgcatgtgtgaaatctgtgaggtttttttgtgttggaacgtctcatctgacaatagagatagttttactgtttcctttccgtggtagataccttttatttctttgttctggctagaacttttagtacacccaatggtagtggtgaaagtgagtttccttgttttgttgctacttcatcttaaggggaaagcttttagtttttcatcactgagtatgatgttagctatgtctttttttttttaatgccttttatgtcaaggaagttcccttttattcttagttttctgagagtttatatcatgaaaggatattagcttttgtcgtgctctttctgtatcaattgagataatcatgtattttttcttcttcatcctgttaatgtgatacattgattttctttttttttctttattttattattattttttttgagacgagttttgctctttcgcccaggctggagtacagtggcacaatctgggctcactgcaacctctttcccctgggtgcaagcgattctcatgcctcaccctcccgagtagctgggattataggcacgtgccaccacgcctgggtaatttgtgtatattttagtagagacgggctttcaccatgtcggccaggctggtcttgaactcctgacctcaggtgatcctcctgcctcagcctcccaaagtgctgggattacaggtgtgagccaccgtgcccggcctattacattgattttcttgtgttgaactgagtttgcattcctaggataaattccacttggtcatggaatataacagtacgctgttggatttggtttattggtacttcgttgaggatgtctgactctatccataaagatactggcctgtagttttctgtggttcctttgtgtcactttgataacgctggcctcataggatgagttaggaagtgtttcctcctcttctatttttggaagagtgtgagaaggactggtgtgaattcttctgtaagtgtttggtcggcttcactatgaagccatctggccctggactgttctttgttgggaggtttttaattactacggattccatctctttacttctcccatcactcgtttaggttgcttgcctcgtgcctgaagtcattggcatcttctagtcctgtcttagaatttaaatatgagtctgcctaatttaagatgtcctataaaaacccaaccatcttcccacccttccccaccttgccacatctctgctctggtatctctgctgagagatggtccctcccacacagcagcagcattcaacatgatgaaccccataggtcagtggttctcacttgggaacttcttagaaacgcacattctctggccaagaatcagaagctctaggggtggggcctaggaaactttttttatttttgagacagagttttgctccttcgcccaggctggcgtgcagtggcgtgatctcggctcactgcaacctccaccccccgggttcaagtgaatctcctgcctcagcctcccaagtagctgggattataggcgcccgccaccacacctggttcatttttgtatttttagtagaaacagggtttctccatgttggtcaggctggtcttgaacgcctgaccccaggtgatccgcccgccttggcctcccaaagtgttgggattacaggcgtgagccaccgtgcccggccggaaactgtgttttaactagcccccaggtggttctgtggcattagcactgccacacttaacagagagccattgcaggctcctggccccagtgacatagtgaaatggcacctctgaaacgctccagcagcaaaggagccgtgagcatcaggagttggtggaaaaaggagaccagagaagggaaagaggagcaagcaggtggcttggcgggggtggtggggggagacttggttggaacaggacctgattctggaggacggttcattattgggagcacccactgggcatagggttggccatccagggtgaggggtgcagtctgtggtcagagcacagacagctgttaatagcagtaacactggcccgtccagccctgactctagccatcccaacaagcccgccctggccactcccaggccaagactcagccctcaccgcttgcttcgttgcatcttgcttagcagaatatttagtcattcatctggcaaatgtttattgagcatctactgtgtgctaggcagttctattaatagcacagggatatggcaaggatcacagcaaacgaagagctctgccctcgaggaccttctgttctgcagccagcctggtggccggctggttctcatcctgcttgccctgtggatggggacttctggaccggtagcggagtcgggcagtgtggcgtgctcggtggtcagacgacatgggacacatcccatcccgctcccagggcgtgccctgtttccccagctttccagaaacgggtttagagaactctccagaaatccttttccttggtcatgtcttccctcttcatccggatgagaaactcactctgacctgtttgcttctccccccagcactttctggcccgcatctccccccgattttcctgggacccacgtaggtgcaaaacacctgctcctccatccttgtcttctggtaatgtttttagtttgctgttgatgtagccttgtcccctccgtgtgtcctggattggggtgggcgggaataacgaggcgattgcaaggactcattgagcgacctgtgtgccaggctctgtacacgctggcccgtgtggtcctgccacagctctgtgagttagcggtcatgttttcagccccatgcaaaggcgcaagcactcagacagcgtggttctgtgaacatgagtgtgtggtgcctcccaggagcagggattttagcgaggctgctgacacataaacacacccccacctccagaagcagaggagaggagcccagggccagggcaggtagctcagcaaggacccagcatgctgcaggtggggccagtgagagtcacttctccagcgagggtcagagaggagagaggcaagagtgttgcaggggcgagggtctcatgagctggggtgcggcaagagggaaggaacaggtggatgcctgtctgcaggagaagctgtgcctgtgtgtagagctgctgtggaccagggggaggcagggagggcacagggtggtgatgagatggagagaaggggtcctggactcgggtgcaacaagagggaaggaagaggtggctgcctgtctgcaggagaagccgtgtccatgtgtagagctgctgtggaccagggggaggcagggagggcacagggtggtgatgagatggagagaaggggtcctggactcgggtgcaacaagagggaaggaacaggtggctgcctgtctgcaggagaagctgtgcctgtgtgtagagctgctgtggaccagggggaggcagggagggcacagggtggtgagatggagagagggggtcctggactcacacgagtgccatcttttcccgtcgcttcttctgctttgccgcctgggcagtgggctggcacccgaaccggcaagtaggggcattgggaaagatccctcaagatttcccaagcctaaattactccttgtggttcttgttcacgtctgcccctgctacctgggacctcctccagcatcctcctccccaaagacttctctgcctttctgaaggaagaccaggctgtttctgtatcgggaggtggtggggacaggggtggaacttggggcccagacggagttcctcagctgagtgctggctctgcgtggttatctattgactggctgtgaacgcagagtccacggggaaatgctggccgcccctctgatttgggtggcaagagctgctgctgctaatacattagacagctgcatggacgctgctattgatgaggagacccaattacatgcctctgtgaaaatccagcggctggcttcctggtggatggagaccccttccggaggctgtcccgggcaggacgttagtctctggggcaatgccagtgagtcagtgagcattaactgagcacctgctgtgtgccctgagcattaaccgagtgcctgctctatgccctgagcattaactgagtgcctgttgtgtgccctgagcattaactgagtgcctgctgtatgccctgagcattaactgagtgcctgctgtatgccctgagcattaactgagtgcctgctgtgtgccctgagcattaactcagtgcctgctgtatgccctgagcattaactcagtgcctgctgtgtgccctgagcattaactgagtgccttctgtgtgccctgagcgttaactgagtgcctgctatgtgcccttggctgtatgcagccatctcagggtgtgtggatgagggtgtgtccgaaaggctgagctgctgttcccggctggcctgagtcacgctgcttctgggtggaaaaggagactcactccctgccaactgtcccattggaaagtgcagcaagtcgctgagaagtggggccggcccagccaaggccatgctgccactggctgatttctgctgctgggcactgtccatgcagggatcatccacccagcacgttgctcatggctgaggctgaatcatagcccttctcaccaactgtgccagccccaggccatggggcatcttcattcagacccatttcttttcttcttcttcttcttcttcttttttttttgagatggagtcttgctctgttgcccaggctggagtgcagtggcacaatcttgcctcactgcaacctccacctcccaggttcaagtgattctcctgcctcagcctcccaagtagctgagatcacaggcctgtgccaccatgcctggctaagttttgtatttttaatagagacagtttcaccatgttggccaggctggtctcaaactcctggccttaggtgatctgcccacctcggcctcccaaaatgttgggattacaggtgtgagccaatgcgcccagccagactcatttctaacagtcttctaaagacactgtctctgggaagaccaatgaaatcgagaaaaagtatcttgaagctgctagcccacctccaacaggacaaagcatgcttccagagggagctttcccatagctccttctaggagctgctatttactgggcattcactgcagaccagaccctggctgggcacttcttacgcctgttctcacctcatctgcctaagagcgctgaagtcaggaactatttgcttcaatttttttttttttttttttttttgagacagagtcttgctctgtcacccaggctgaagggcaatggtgtgatctcagctcactgcaacctctgcctccaaggctcaagcaattctcctgcctcagcctcccaaatagctgggattacaggtgcccgccaccatgcccagctaatttttgtatttttagtagagatggggtttcatcatgttggccaggctggtcttgaactcctgacctcaagtgatccacccacctcagcctccctaagtgctgggattataggcgtgagccaccgcgcccggcctgcttcaattttcaggtgaggaacttaaaagaggaatgaagagaggttaacatgcctcatgcaacacagctgggcagtagcaggttgcccactccccagacctgggcttcgaccaccgggctctgctgcctcctgtgtgtttctgctgcacctaaacctaaatcactctgcatgaccttgcagccgaagcctgagttctggggttcagcatctctcaggcccaggccccagctttgctctcccatctgatcttcaggatgtctgacccagaggcctccagccagccgggctgatccactaacgcttcactgactgtgtgccgagctgcttctcttttctgtctttgcccattcagttcctgctgcccgagtgccacagtctcctcacccctctctatccagtgatttctcttgatcctttaaggtctgtctgggatcttgtgtcttgcaaaaagccttcgttgacattttggttttaagatgtgtccatgaattctttgatgcttctctcttcaagaggtcgaacttgttgtgtgcggtggctcacacctgtaatcccagcactttgggaggctgaggcgggaggatcgcttgagctcaggagttcaaaaccagcctgggcaacatgatgaaaccctgtttctactaaaaatacaaaaattggctgggtgtggtggcagtgcttgtagtccctgctacttgggaggctggggtgggaggatcgcttgaggccaggagatcgagactgcagtgagctgtgatcatgccactgcacttcagcctgggtgacagaatgagaccctgtctcaaaaacaaacgaaaataaaaagacgtgaaacctaggctgggcgcagtggctcacgcctgtaatcccagcacttggggaggccgaggcaggcggatcatttgaggtcaggagttcaagaccagcctggccaacatggtaaaaccctgtctctactaaaaatacaaagattaactgggtttggtggtgggcgcctgtagtcccaggtacttgggaggctgaggcaggagaatcgcttgaacccaggaggcggaggttgcagtgagccaagattgcgccactgcactccagcctgggcgatagagtgagactgtgtctcagaaaaaataaaataaaataaaataaatactgaaaagcacaaagggaaaaatcatctgtaccttcagcctcattttgttgtgtatcctttgggatatttttctccgtgggggtgatgcatgccctcagatgcagtcctgtgtctctctatacaaacacattctttatgtttcatggaaacaatgggatcatcttgttcaaaactctatttttctcacttagcaatgcactgtgaatctttgcagtagcatcatgagcacagacctcctcttgtcgtttattgtatgagtgtacccctgtgccttatttacttttcctttcacggttgggtacttcccccattgcttagactttttggcccttaaacagtgctgggacaaacatccttgtacatgtgttcttgtggcatggcccggatattgttctagggtaaattccttagagtgggtttcctggaccaaaggacgtggatattttaaacggtttggatacatggtgcctttcggaaagctgtatcaggtgtgcactcagcagagttcctgcagcccggggcctgcagactggacacagtggctgtactgtttctcattcctgccagctatatgttcctgccacatatccttgccaacactggttgatctgatagtgaaagatgttatcttactgtgatcttaatttctttcataactagagaggttgggtttgtttccatgtgttcattggttattttatgtgtgtcctttaatcatttgttcatgtcctttgcacatttttctgttttttttttcttttgagacagtctcactttgtcgctcaggctggagtgcagtggtgggatctcagctcactgcagcctccacctcttgggttcaagtgattctcatgcctcagccttccgagtagctgggattacaggtgtgcgccaccacacccagctaatttttgttatttttagtagagacagggtttcactatgttggccaggctggtctcgaactcctgggctcatgtggtctgcccgcctcagcctcctaaagtgctgggattacaggtgtgagccaccactgcaccagacccctcatttattgatataatggcttttggatagtttgaggtatggtcttccagatcattttctatgaatttatatgcatacattatatacagtatctttttttttttaagagatggagcctcactgtgtcacccagggtagggtacagtgtcatgatcatagctcactgcagccttgaactcctgggctctagcaaccctccttgcctcagcctcctgtgtagctaggattacaggtgtgaaccaccgtgtctggctgtttttataaaattgagattatattcaatgtattgtctctgatttcctccacccctcaacttaatatatcttggagagtgtcatatgtaagcaacatgaatctgttgctgtctttttgaatgattgtatagtttttttgaacagctttattgagatataatttacgtatcataaagtcacccatttaaagtgtacaatttggccgggtacgatggctcacgcttgtcatcccagcacttcgggaggccaaggtgggcagatcacctgaggtcaggagttcaagaccagcctggccaacatggtgaaaccctgtctctaccaaaaatacaaaaattagctgggcatgggggcgcatgcctgtaatcccagctactccggaggctgaggcaggagaatcgcttgaacccaggaggtggaagttgcagtgagctgacatcgcgccattgcactccagcctgggtgaaaagagcgaaactccatttcaaaaaataaaaaataaaataaagtgtacaattcagtggtttttggtggtattcacggagctgtgtaaccaccatcataatcagttttagaacctttttattgctttgaaacgaaatccgtaccttttagctatcaccttccaatcccccatccccctcagcttaagcaagcgctcatcttctttctgtctctatgaggttgcatactctggacatttgattaaaatggaattatggtcctttatctctgacttttgtcttttttaaattttttttgagatggagtctcactttgtcatccaggctggagtgcagtagcgcgatcttggctcactgcaggctccgcctcccgggttcacgccattctcctgcctcagcctcctgagtagctgggattacaggcgcccgccaccatgcccagctaattttttgtatttttagtagagacggggtttcaccgtgttagccaggatggtctcgatctcctgacctcgtgatccgcccgcctcggcctcccaaagtgctgggattacaggcttgagccaccacgcctggccttatgtaagagtttttgtgtggacgtgtattttccattctcttgtgtaggtgtctaggagtggcactgctgggtcatgcgggtacagaggcaggttcttaactgcttttctatacctcctcctgtagtgagggaatttgtcatccatttggttcacatatcagtacttatttatttatttatttatttatttattttacttatttactgagaggcagtcttgctctgttgcccaggctggagtgcaatggtgcgatctctgctcactgcaacctctgcctcccaggttcaagcgattctcctgcctcagcctcccaagtagctcagattacaggtacccgccgccaagcccagctaatttttgtatttttagtagagacggggtttcaccatgttggctaggctggtcttgaactcctgacctcgtgatccgcctgcctcagcctctcagagtgctgggattacaggtgtgagccaccgtacccggccctatctctaccttttttcatttggtgtaatgcactcaagggtcagcagtgttgtggcaggtatcagtatatgttatttttattggctgaatattattccatcgtatggatacagcacattttgtttattcgtcagttgatggacatttgggttgtacccaccgtttggcaagagtgaatactgcagtagtgaatgtttgtgtacaagtatttgcttgagtacctgctttcaattcttttgtgtatattcctgggggtcgaattgctgagttgtgtggtcataattccgtgttgaacatttccgggaattgccaaatgattttccacaatggctgtactgtttgacattcctaccagcaatagatgagggatctgatttctccacagccttgctcacgcctgtgatagtctgtgttttgatcgtggctatgttagtggtatgagtggtgtctcattgtggttttgatttgcatttcctgatgactaatggcttgagtgtcttttcatgtacttattgttcctttgtatgtcttctttgggtatatgtgtatttagatcctttgcccgtttttaaattgagctgtctttttctgactgagttgtaagagtttgtttttgtagagacacgtcctttatcagatatacaatttgcaaatatttcctagcattctgcgggctttcttttgactttcttgagagtaagtatgaggaattcgtattaacttttctttaaacgtttggtagaatttacaaatgaagccacctgggtctgggctttccttcgtgcgtcgtttttttgatcattaatttgatctttttatttgttatatgtctttagattttctatttcttactgagtcagttgtgataggttatgtttttcagggaatttgttcattttatcgaagttatctaatttattgacctatagtttatagtacttgtattttattctgtgagtgtagcttcttttaaccaattttctgcagacttttaagttgtttttatttttttactgttagaaacgatgctgcagtgaacatttgagcctgtctgtctttgtgcacattgcaagtgtgttagaggatggattgttagacgtggaatcgcgtgtcagaggtccgtgtatttaacatgttgattgcttctgttgcattatcctcctcctgttcatctttctatccgtattgattggtataagctctttacgtctgctaatcctggtctcctaagcctggagatggtaagaatgccccgcgtgggtggtgcatgtgcacctgagcaagttggaagaggaggtttggcatctggatgtttggcggctcacttctggtcaagggagttgggcgcgggtgccctaagcccacccctgtacattcacacgtggggtttctagatgccagatcctgaactgctggtaggtcggagctttttgcctctgacacgctggctttggcctgacagaggttgtctggagtcaacagcagggctgggtctctccagggacttcaccaggctccttcccagggcgggtctgggaattctgggagcagtgggagctccaggcagttctggcccatgggtgcctgcagaggtaggaagagtgcttggaggccccacctctgcctgaagaagaaccgaggacactgttcctcatccctgctttcttttctctcgtcttcactggggactgtctgttctgggcactcatgacctcccggcttcgcggtgcccagatgtgggcagtgacattagtctgaggaggagtagctgttttcaggggataggaagtggggtggcctctgtgtgttttgttggggtagagttgccagcccctcacgcttccattccgcttcccttttctcctttttgtttttcctggatacacaagggtggcaccaaagtaggtcaaaggtttggacaagtgcaattgggattttaaaaataacccatctaggctgggcgtggtagctcacgcctgtaatcccagcactttgggaggccaaggcgggaggatcacaaggtcaggagttcgagaccatcctggccaacatagtgaaaccccgtctctactaaaaatacaaaaaattagccgggcacgatggcgggcgcctgtagttccagctactcgggaggctgaggcaggagaatggcgtgaacccgggaggcggaggttgcagtgagccgagattgcgccactgcactccagcctgggtgacagagcgagactctgtctcaaaaaaaaaaaaaaagaaaaaaaaaatccctctaggcccctggaggcctcggttcaatggtgttcaggctttgcttcaccagctttagggtgccagagtggtgccttgtgggcaggggaccgggcaggcagaggcagaggtggcatagcgggccctccccctccttccctggctgctgtggccacagcgaccctgctttcaccggttggttttctgtatcagggtgtggaacgccgcttgtgttggacaccttggccccactgttgggttgaaaacatcctaaatatggctcctgccggaggctgaatgccgaggacgataggcgtttgcagaatttggctcttcccaggggccggcaggcccctttccttgacagaggctgagtgtctgctcccccagcaccattcatttgccagcccaggtgtgccttagcctctctcctgttgtatggggtgtttggccctctagccctgcaaaggcaaaatcaaattatcttctctgttgatccaaatgaattttgtccctggggaagccccaggctcagcttcctgatagttggtgaggaagaggcttttgctgtggacctcccggctgatccctgtctttctgtccccctgcttttgtctttcagtcgtcggagttctttgagatgctggagaaaatgcaggtgagtacgtacccccaccgtggcggggaagaagcccagccccagatgtgggtggcatagggaccaggcagaacccacgggcagaagccgggtgccctggacgggggtgcagagaagagacaattgcatccccttggcccagacaacctgaggccattttgctgttgaggggtacggagcactttgggaagactcctgcggagggacagggaggataaaagcagaacttccccagcagggcagctggggaggccataagccctgtggatgtggaggagggtttgaagggtccattgttcctagcacgagctggaaagaaggcctgaaagaactagctgcttcttggaggagtcatcttgcatagggaggcagaggggtggggtgggaggctggcttgtgttcaagtcctgcaccagacacttactagcaccagttcctttcctgtgctaagcctccataaataaataagaatgaatgcacccacttacatggtggttggggtgaaatgagataatcggtgtaaatacttggtagacactacataaaagttggtgtgtgatgtgggtttgggggttcttcgttgttcctcaccagggtcagggctcccaggtaagagctgctgccctggggagtatgtgcagaggcccggcagggttcattgacgtgggcgggaagactgggaagacaatgctgataatacacctgtagctcaagcacttcactgggctcagagattgacaggcgtcatttcttcctgctaaggccttcagaagtaggcatattattattattattatccccataggacaggtgagaaaatcgaggcacagaacaattaaaggcagcactcaaagggtgcgtggctcataagtagcttcagagccagagagtccagccattatgtcatgatgctttttaccataagtaggtgctccaggctcaagggaggaagattctgcaataatggtctggaagtcctaggaggaggggcaaatacagcacccacggcagtcctgagatgtgggccaagcagccaggtgtccctgagggtggggagggaggggagacgctgtttgaagggaaagtattgttactgccgtgtcaccgagagccagttattaaaattgtcctctgcgcccagcagcgtgtagatgacagactcatcttctacgcatttagggaacttatcatcagcttgcggaaaccaggctggcatgtgcctcacagtgaggggtgggagatggtatataatcaagtgctccattgcttggagcaaagctgggattttcgcctctagtcagtgggatcctggcactctgggaagctggcagggggtttgcagcccacccagccttctctccggttgctcctcagatcctctcttccttctcccccagctggagtccccttcccacaactttgccccacacagggtctctctgagcacagcattcagccccagttaaccagcctcagagtgttgtgttgtgtagaggctgcagggcttgtctgttcatgtagatcgggtgctttctagggtaggggtcttgttttattctccctctgtctgtgcaatggctgatccccctgggtagcgtgcctgttccctttcagttgagactgttgaagccaaatttctgggtgtttaagtccctaccatgtgccccctgggcccagcctcagagggttcactcttagtaagaagctcacgtatggggcactgctggccatggagtgcccgcgtgggccttgagcctgggctccatctctcttcatcttgcacgtgtggaaactgaagctcagagcagtgaagcgcccgggtcacttagctagttgtgaagagctgaaactggaatccgggattcccgatacctagcccaagagtctgggaactgggagaaggcagaagctttggattccttcagtcctgggttcaggttctaaccctgacgctttctagctgagtatcttcagtcaagtcggtttccccttctgagccttaatttcttcactgaggggagaaggggaaataaagataatacccattgtggccagttgcggtgtctcacacctgtcatcccagcacttgggaggtcgaggcaggtggatcgcctgaggtcaggagttcgagaccagcctggccaacctggtgaaaccctgtctctactaaaaatagaaaaattagctgggtgtggtggcacacgcctgtaatcccagctacttgggaggctgaggcaggggaatctcttgaacccgggaggtggaggctgcagtgagccgagattgcgccactgcattcagcctggatggcagagcaagactccatctcaaaaaaaaaaaaaaaaaacaacaaaaaaagacaatacctctagcaaaatagcacatggaggagagagggccccgtgctgggcagtggctctgcggtaggttattaggggagggagtggcgtggggaggggatgggaggaagtttgctctcctgccctcggggctgttcccagacagggatgactaatgcaggccaaacaaaacagactcctgccctcactgcccccacccgccatctgcccagtttgccagctgggacagggtctgtagggccacccaggtggctttgtgtgtgtgtgaggggagcgcctgttcagtgggaacggccctcccacgccctcctgaacaatgctgcaaggcgactcagcccagggaagtccgcagaggctgcatgtcaatccacccagttaacaggagccctgctgtccacagagtgtggggtacgtcacgcgcttggtgagccggtgacccggcttcaaatctaggccctgccactcactggctgtgtgaccttaggcaagcagcctccttctggggccccagtgtcctcgctggtggaaagtgctgtgagtttcaaaggaggccacagagagagctagcttgggaaggtcaaaatccctgtgcattagtgttgtgaccaggcagacgctgcttctggactccttctgcttcagaggggacctgtttcttctagtttgtgtaccgtctcatactgtcacccgattttctcagatagtcttggaaacaccacgtgttcccctcctgcacaacacggttaagtcagaactcagtgatagaactgctggaccagggccaggcgcagtggctcacgcctgtaatcccagcactttgggaggctgaggcgggtggatcacctgaggttgggagttcaagaccagcctgggcaacatggtgaaaccccatctctactaaaaatgcaaaaaactagctgggcatggtggcacatgcctgtaatcccagttacttgggaggctgaggcaggagaatcacttgaacgcgggaggtggaggttgcagtgaaccgagatcccaccactgcactccagcctgggcaacaagaatgaaactccatctcaaaaaaaaaagaagaggctgggtgcagtggctcacgcctataatcccagcactttgggaagccaaggcgggtggatcacctgaggtcaggagttcgagaccagcctggccaacatggtgaaacctcgtctctactaaaaatacaaacattagctgggcgtggtggtacatgcctgtaatctcagctactcgggaggccgaggcaggagaattgcttgaacctgggaggtggaggttgcagtaagccgagatcataccactgcactccagcctgggcaatagagagagactccgtctcaaaaacaaaaacaaacaaacaaacaaaactgttggacagggcactgctccccagaagtgaattcttcagatacctgtagataaactcccttagtccagtcccaggcatcatatctgatccttgcagtcatccttccattagtgagatgaaaggtgagcgtctaatcctcattttacagatgacactgggggctccaagaagctacgctttgtcaagggtcacaaatagtaagttcgcagcagaatgagggccagcaccaggcctcctgcctgtcccttgaaggcctgttggcgtgggctctagagcgctggctccgacaccaacaggcatgacttcctatgtttcccttcccttactggctctgtgaccctaaggattttttttttttttttttttttttaatttgagacggagtttcgctcttgttgcccaggctgaagtgcaatggcgcgatctcggctcactgcaacctctgcctcccgggttcaagcaattctaccgcctcagcctcctgagtagctgggattacaggcatgcgccaccacgcccagctaattttgtatttttagtagagacagggtttctccatgttggtcaggctggtcctgagctcctgacctcaggtaatctgcccgtcttggcctcccaaagtgctgcgattacaggcgtgagccactgtgtccgacaagacagctatttaagctttgaatgataataccgcctccttcatgatgataatgacccacagcatttattatataccagtcagtgttccaagtgctcaacccattgttaacctttaaccttcaccaccatagtcgatgccatcatcattcccattttacagatgagaacattgagtcacagagaggtttctgtgacttgccaaggtcatcaggctgataggtggcagtgttgggatttgaaccccggcgatctggctcaagtctatgctgttagcccagcggcgctgttgcctcacctgaggctgctgtgaggcccgcccctggccaggtgtgatgtgtgcaggcccagcacgggccagcttttgctgctgctcctgttactaaccccctgtaaggccaggtgctctttatctggccctgtcttctgacctttgcttttctgtggatcctgttttccttgtttctataggggatcaagcttgaagagcagaagccgggaccccagaagaacaaggtgggctgggtgggtgagggggtggccagacggccctggtgaggggctagggcgagaggaaggcaggaggggctgccgggatgctggggtcttctgtctcacacctgtctaactctgactcgcaccacgggccgcttcacgactgccttgttagaccagtgcacggtgggcagcagaggggtcctggcttgatgccttaggacagcttcagagcaggctgggggtggaggcctcggtgggacctcaggcttggccgtttggcccggctcttccctaccctgtgcagtgtgtaagggtgtcaggctctgtgccccgggttccagtgggcagtcagctctcagcttcccaacccaggggtgccgcttatcacttggaggtcagtccgcctgcctggaaaggggtgctgggggagactaggggtcattttccggaatgagcgttctaggatgagaagctggtatcacgaggggtgagaagttcagcaccttcggacactgcatcatcagctggcagggtttatgtttgggttctgtcagtttggagaagaacatgggggatgttagattccagagctgattctgagctgttcttccatcgaatgttcctccctcaaagcccccccacaacatatcccccttgcaagacctggaaacagtggtcagactttacgggcactgccgggactaacggtggcatcatctggtttgtcttgcaggacgactatatcccataccccagcatcgacgaggtaggtgccctcccctcactcccacctgccctgcagcctgctctgggtcccgtccctggggaaatgatggcgatggcctgtgcccagccccccaggggagagaaccttgggcctgggacctctcttcctgtctttgcctttgtaacctcagcttctccatgtgttaagttgggggtgctcatctaggcctttcagccctggggctacagggttggcgaatgaagctggaggtgttgtggggcttggaggaggggttcatgtcactgcctttggcctcaagtaccagtgggtaccaggccccactcctgggagcagcgcagaggggacaccgccaccggccccctccctcccctgcggtcccaggggagcgcacgaccctccctctgccttcaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggtgaggctgggggagaggagctgctgggggttgggggcagaggctggggacgctgggagagaggaggtaccaggcggtaggggatggggagaggttgagggaggctgtgggaggctgtgggagaggagctgccaggggtgggggtgaggctgggagaggctgtgggagaggagctgccggggatgggggtgaggctgggggaggctgtgggagaggagctgcggggggtgggggtgaggctgggggaggcttgggggacagaggagctggcgggggtggggggaggggctgggggccctgggggagaggagctggcgggggtgggggtagggcagagtgccccccttttccttggcctcttacctccttcctagtctgtccttttgttgctgcctgctgctgtcttagttggagaggtctgagggcctctgtcctgggataggggacggggcaggggagccatgtaacaatcagggaggcccagtgccatgagtccttgtggggaccaccccccgcaaatgtttcgggaggcgatggaatgggtagtgtttggggtgaaggacggtggctggagttttgactgttcgaggaaaaatgtgttctcacacctcaagaagtctctgtttccatctaaatcacgcaaatctctccgtcctcattcaggcagatcctctgagtgcttgtactgcatagtgtctgcgagcctctgattgcttaaaagtgacaaagttaaatttaaaagaatagattctgcccttcagatttaccaggttcttgatgtactgagggcagattccggaaatctgtagcctgaggccgctttgcagagtctcacgtgacgggaggctgcctcagagcccctgggtcttgttagcatgcagattccagggcctcagtctgatccagcaggtctggggagctgtgtttttcgcccgtgttccccgagccagggagtgacccactggctcaggacacctcccagctcccctgggtggaggtgccagggttcctccttgctgtcttgccccagatagtgtgaactggtgagggccgccccatgggaatgagaatgtggactcggtatcttgtggttaagaacttgcccttcagagtcaagacagctgtgcgtttgaaccctggatctgtcccttactcatcgtgtcatcctgggcagtgacttaaccccccgaccattggttttcccatctgtgaaatggggatgatgttctctcccggatacagctgtggtcaggactgaaggagatagtgggtattaagcccctggcacggtgcctggcgcctcctgaggatccggccgtcggtacctgttaatgtcgttgtcattgtcatcagtagcatccttctcttccttgttgctgtggggcttctcctggtgaaggaggtggtttagggggaacatacctggaaggtttcttcctccttcctgctcacactcagtttctttttttaggatcatctaaacttttactgtaccggcagcagcctggggaacttgatcctgtccgtcaagtgcgaggaagcagaggggatcgagtacctccgggtcatccttaggtagggctgttgcgctgcttgaggccacttctcttccaggcagggctctcatcggtggtgtgggggctgggatgggactcagaaataccagactgaccagtctggtctgggtgcactggctgacggggacaggcctgctggaatcctggggctgtgtctgaagttgcctagcagggagacccacgcgctccaccagttagctgacagtcagaggggcatccaggtctcaaggtcacccagactgtaccccttcctgcccctctttcttacaagtccatggctctgaggaagacgggaagaaaagtagggatggttcagtgtgactcatcctgctgagacacagctccgagtcctgggagagggttcgccagagtgctgcctgtggtatacatcttgccaggaaagatagtgccctgtgtgtttgttgtatgggctgggttccctgagatgcactgatgttcacaacaggagcactgatttatagcggaagccagggcacctctctctggattgtgaccttctcaagggcaggagctggaactggtttctgtttggtttagctaacatgttttgtaaaacctcctctgtaccaggaactgcgataggtgttagagataccatgatggctgagacttggtccctgttctctgaaaggcatatggtttcatgaatttaatgtgtgtcacgggtatgattttagcaatatgcacaggttgctatgggggcacgaaggaatctgtgtcttatttatctctgtccctggttgggtggtgcttagcagaatgctgtgaacctgtcaggctctcaatccttatttgtggagtctaattgaagattcataaaggtatttggaaaagagcaatcacatttttttttcctgcccaaattttgagataaatattggagggaataaggacatataaccccactttgggaaaggtgggggtccgtggtttcaggatgtcgtcagcacccatccaatcttagtttgtttcttatcaagaaaggaagcaattttctctacagaggttcacttggctggaaatcatatttgcaaggcatagaagagtcaattaaatagcaagagccaattttctgagaggttaatacctggatctccatctccaaataggatttccagctaggtgaacctctgtgaagaaaattgctaccttaataaaaatcagaccgagactgggtagcatttttgaataagatgacaatggaatacaaagatctaaccccctttttctaatactgtatcctccattaggactggaaatgctgcttcggggctgaaagctaagaaaaatgccgggcacgcaacacgcactttgatggttttttgtttttgttttgtaatctatgggggcagttaggactaaaagtaggtgaatattgagagttgaaccccagattctcttccttagaaagcagtgttgtggccaggcacggtggctcacgcctgtaatcccaggactttgggaggtcaaggcgggtggatcacgaggtcaggagatcgagaccatcctggctaacacggtgaaaccccgtctctactaaaaatacaaaaaaaaattagctgggcgtggtggcgggtgcctgtagtcccagctactcaggaggctgaggcaggagaatcacctgaacccaggaagcagaggttgcagtgagcaaggatcgcaccactgcactccagcctgggcgacagagtgagactctgtctcaacaacaacaacgatgacaacaacaacgacgacaacaacaaaaagcaatgtcgtatgggaatatatgaagttggagatctagaagaatcctgtcctctttaggagtgagagtgagccctggaatagacagggatctttccacatagaattatttttgttgttgtgggtcaacagcattgaaatcaatgccccaggaagcccagcaagctcaaatgtggctctcccagatggaaagctagtaggtagggtggtgacgagaagccgtaccccagctcggaagttgggcagtcacatcatgtacttggagtgattgccaggccaaattggaaaccagacataagaaattggctccacggtttagcagctttgccagacacaaagaagaaattatccagagatgaaattcccctgctggcggtgactactgtccaaacttcttcctcattccccataggcttctggattttttaacggatgtcccaaatttataacaagcagctctccagtctaagatctaagtattctaacagcctgtgtgtgccatgagagtagccaagaagaatctacccacagtttggagacaatgagcctgtgtagatttcttctgtttcaagtttggatataaagaagaagaagttttatgggtttgtaaaagaagagattctgcctctaaaaaagcataaactagttagagaataacagagttttgaaaagtatttacttttacagaaagccaggtgaatttgagagatttattaactttgaattttccacaaacctctagaaaaaatacacactaagaaagaaaagatagagtgagccaacagaatgggaggaaacagttgctggttaagttagggagataataaaataaaaatggacaaaaagaattttaaatagtatatgaaacagtacaaagcagaatctactttgtagaaaatccagttattaatatggggaacaagcttaagaaactctcacataattcaaaggaaacacaactttaaaatgatgagtgagatgatgatgaatatggagggtagtgagcaggaattacacatatggataattgatgttgtcaagctgattgaagacttaaatctgaaaatcaaaatgactcacccattaacagacaaaatcaatgaaaggaaactaattgctggatgtactttgatgaaaatttagtatttcatagatataaagttactagtagtagaatggaagcattccaaatagtaagagaagacaaagaaaacacactttgtctgtagaaaaagaaaacaaaggaataataaagaaatatgatagaagtgtgcgtacatatgtgatgataataaatataaatgacttaaattcgattgttaacaaagattctcgatttgggtcatctctccaaaaaacctacacaaattgatctatattttattaaagaaagtaactcagaatatttgaaaattgttaagaaaaaaattagaaaagtcaaatacaaaaagaaagcgggattggcaatattaatatagaaaagtagaattcaaggcaaaaaagcaatcagtgtgataaagagggctattatccatcttttcataaaaggtaaaatcaataatgatattttatattgtcagtagtatatattatagtatatgtatatgtacacatgtatgtaatgattatggaaaaattcacagaatacaattgtaatggtagatttttaacacacatcacttgacatatcaatactagggttagaaatgacatttattcatctcaatatcaattatatacatatttttctttatctatctatctatctatatatatatatatctgtttctgtatctaactatcagactttgatcctctaacagattttacttcttttcaattgcctttggaatatttacacaaattgattgcatagtagatcagtggttttctgtggacctgctacatcagaatcattttggatctttaaaacaaagtaaaacaaagcaaaaacaaacaaaaaagcccaacaaacaaaaaccaaaacctagacttctaggctccaacccaaccatttgaaacacacacacacacacaataaataaataaataagatatgtaaagatgtgtaaatatatatattctttttttttttttttttttttttgagatggagtcttgctctgttgcccaggttggagtgcagtggtgcaatcttggtttattgcaacctgcaactcccaggttcaagcaattgtcctgcctcagcctcccaagtagctgggactacaggctcatgccaccacacctggctaatttttttgtattttcagtagagatggggtttcgctgtgttggccaggcttgtcccgaactcctgacctcaggtgatctgccctcctctgcctcccaaagtgctgggattacaggcgtgagtcaccgcgtctggcctaaatatatatattcttatttccttccttatttccacaggattctgtagaattctgtaacttgcttctcttaacaatgtatcttagagatttttccgtattagcatatagagaatgtcttaatttattttactgctggatggtattccattgcatggatgtgaaataatttatttaatacatcccctgggccgggcatcgtggttcacgcctgtaatctcagcactttgggaggccaaagcagatggctcacctgaggtcaggagtttaagaccagcctggctaacatggcaaaaccctgtctctactaaaaatacaaaaattagccgggcgtggtgacatgcacctgtaaccctagctactcgggaggctgaggcaggagaatcacttgaacccgggatgcgcaggttgcagtgagccgatttggcgccactgcacttcggcctgggcgacagagtgagactctgtctcaaaaaaaaaaaaaaaaaaaaaaataataataatacgtcccttgttaatgaccattgccaatattttggtaacacaataatgattaaatgaataaccttgtgcagactcagtttttatggattatgatagtttctcagatgagatagctaggttaaaacataaatgcatttgtattttgatagataacgttaaattgccctctgtaggggctgtgtaaattccaactttcaccagtaatgtatcaaagtgcttcttattccaaagcctcttcagtagaatgtattgtcaaacacttggatttttgcccgtctgatagatgagaatagtatttagtgttgtttaaatttataatcttaatatgaatcatgttggacatctcttcatatatttaagaactgcctctatttatttgctatgaacagtttataagctttgcttctttttaaattgggctgttatttaagattctattttttaaaatcttggctaggcacagtggctcatgcctataatcctagcactttgggaggctgaggcgggaggatcacttgagcccaggagttcaagaccagcctgggcaacacagggtgaccccatctcttaaaaaaaaaattagctgggtgaagtggcacacacctgtggtcccagctactcaggaggctgaggcaggaggattgcttgagcctgggaggtcgaggctacaatgagccatgattgtgccactgcactacagcctgggtgacagaacaagaccctgtttttaaataaataaactaaatcaatcaatccatcaatcagtcgacctatgtaactaacttacttgtaggtaattatcgatagcagctataattaggaacttctgaaccacaaagtaaaactaaatacatttcagagagcaagctctctgctggatgtattcacttacaatttgatgataaaactagcaattaataacaaaataatgatttaaaaaaaccactaaaccactgagaagtaaacaatcccaatactttcttaagtagcttttaggccaaagggaatagaagctgcagttacagaatatttataaagtaatgacatttataatactatacataaaacctatgggttgtattcaaagcaatacttagaaaaaaatttattaccttaaatggtttcctattaaataagaaaaagaactggcaggtgtgttggctcatgcctgtaatcccagcgttttgggcggctgaggcaggagggtcacttgagcccaggagttcgagaccagcctgaacaatagaatggacctcatctttacaaaaataaaaataataataatacagtaaaataaaaataagagtgatatttgcaagttgttattattgttagcaacttctctgtgtctcattttcctcatctgtgaaatgatgatggtagcatgtaccttgaaattattgagtgcttacatgtcctggtgagtgaggaccttacatgctgcagctgctcagtaatggtggctattattattatcaatattgttacctaaagaaagccagaggaaggaattcacaaagattaaagcagaaataaataaactagaaataaaaataatttgagacttgataaacctaggtttcttttggaagaagcaataagataggtaactagctagtcgaatatagatgagaagagaaaataagaatatacaaaattagtcataaaaagatgcatgaccacagatgtgaagaagattaaatgattactaatggatgctgtgttcaactcatgctattaaattgcttctgtttctaattttatttgaaattttatttgaaacagatgcctttctaggaaagtatgccaaatgtaacttaagatgaggtaaaaaagaaacctgaacaaaccggtaactgtggaagaaattgaaaaagttctcaaagaattatctcttcaaatgtttctagatctagatggtcttgcaggaaggtgttttaaactttaaaggagcagattttatgttatttaaactgttcaagagaaaagaaaaaaaaatatggaaagcttcccaattaataatgcttaaaagagctttatgggctgggcacggtggctcacgcctgtaatcccagcactttgggaggccaaggcgagtggatcacctgaggtcaggagttcacgaccaacatgagtgaaacctgaaatgagcctggccaacatggtgaaaccctgtctctactaataatacaaaaaaattagctgggcgtggtggtgcacacctgtaattgcagtgagccgagcttgtgccattgcactacagcctgggtgacaagagtgaaagtccttctcaaaaaaaaaaaaaaaaaaaaaggatctttttgaataaaatcagtcaaatgagatgcaaaaaaagggtaggggccaatattccttacgaatgtagaaatcaatgttgtaaataaaatagcagccccagaaactcaaatctaaatagactaataagagtaattcactatagccaagaaagagttattttaccaatgcaggatggttaatattaggaaattcattcagtgtttgtttacccaaggcttaatatatgccggactttgtctggttgtagagatactgtgaggaatgagttcttgctacttgcccatagaaggcattcagtccaaatgcactgcgttttagagattcttgtttctgttctcggtcttactcatcatcttcttcttagggacagggatcattataggctagtgaggctgatgggagacgtaggtggtgagggagaactgaaggcaatgtggagggtgtgtctgagtgtgtgtagggttgataaatgatgctagagaagtaagaaaaggctagatcctgtaccagtgatgtttaggagctcagattttatcctaagagtcataggagaggtactgaagggagaaggtcatgatcagatttgcacagtagaatgatcactctggcgccgggcgtggtggctcactcctgtaatcccagcactttgggtggccaaggcaggtggatcacctgaggtcaggagttcgagaccaggctggccaatgtggcgaaaccctgtctctactaaaaatacaaaaactagccaggcgtggtggtgggtgcctgtaatcccagttacacaggaggctgaggcaggagaatcccttgaacctgagaagtggaggttgcagtgagccgagatcacaccactgcactccagcctgggtcacaagagcaagaatccttctcaacaaacaaaaggaaaacagtaaaattgttggaactcaagaaataattgtagaaataaacaacaacatgggataaaatctagtctgtttaaataatgaatttatgaattggaagatagacccaaggaattcctccagaacacagcacagatcaagagatgaagtatatgaaaaagaagatatgtggataatagactgggaggccccagcatgtgtcataaagacgttccggaaggaaagaataaactagtgaacaaatatccacaaaaatattagatgagaatgtttcagaattgaagaaaccacacaccgtgctgctgaaagtgatttaaaaacaaaacaatacttctagacatgctgaagtgaaacatcagaaataaaagattttaaaaatttaaaagaattttaaaagctgtctgaggatacagacaagataatctatgatctaatgagaactaggatgaaaatagatttctccctatccatgatagttgttaaagacaatggggcaatatctttcaagtgtttaaaaaaagaaagaaggggccgggcgtggtgtctcatgcctgtaatcccagcaccttgggaggccaaggcgggcggatcacgaggtcaggagatcgagaccatcctggctaatacggtgaaaccctgtctctactaaaaatacaaaaaaaaaaaaaattagctgggcgcagtggcaggcgcctgtagtcccagctacttgggaggctgaggcaggagaatggcgtgaacccaggaggcggagcttgtagtgagccgagatagcgccactgcactctggcctgggcgaaagagcgagattccatctcaaaaaaaaaaaagaaggaaaataaccctcaacctaaaattctatacctagaaaagccaaagacaaaataaaactgctttcagacataaaaaaatggagggaatgtcccactcgggctctttctgaaagaattactgaaggatacacttcagtcaaaagaaaagaaaaaccagaaaagatttaattagaaagtgacaagaaatagataaaatatgttgataaatttaattactgatggtaaaaagtgggatttttttttttgcatgtttaaaaggaggcttgaactaaatttataaacaaaagtagcaaggacaatgggaaggaaaaaatgttcagtggataaaagcatactctgttgttgcttatttgtgcccctcaggagagagaatacaatcttagagtttgatgaaaaaaatataaataggtgtattggaagatacagaaatacagtctatagcaaattagtaggagataaaaggaggattaacaaaaagaaagcaaaaaacaaaacatcaattgaaggtaggaaaggaagagaaaaaaaggaaagaaaacacagggaacagaaaatataaaatgatggtttagaaataatttcaggccagtcacggtagctcacgcctgtaatccccacactttgggaagccaaggtggatggatcacctgaggtcaggagtttgagactagcctggccaacatggcgaaaccccatttctactaaaaatacaaaaaattagctgggcgtagtggcatgtgcctgtattcccagctactcaggaggctgaggcaggagaatcacttggacctgggaggcagaggttgcagtgagctgaaattgcgccacaatactactccagcaggtgacagagcaagactgcgtctcaaaaaaaagaaaaagaaaaagaaaaagtttcaaatatgatagtaattgcaataagtataaatagattaaattagcctattacaataccagcctatcaaattgaattaaaaatatagctatattctgcttataagagacatacctaaagaaaaatggtgtggaaagatttaaaataaaggaatggaaaaagatatgctgggaaagtaccatgaacgttggtatagcaatagtaatatcagacaaaatagaatttcaggacaaaaagactagggataatgtactcctttgtaacctggaatacttcttccccactcctgatgtttcctgtggctagagggaatactttggtgtaacacccgggctctcttcaccctccctgatgggcgtgtttgggagcaggaactcacgtgtgtagctgtgttccttcccccttttcctcttggacagagctgccctgagggtggtctcctgtgcagttaagtctcacctgagcagctccatgggagggggcttgcccctggcccgcactgcctgtgactgggtgggtaagttgggctgattctggtatttagttagacccgtttcatcttcacactaagccgtgtgctcccacgtggtggagtgattttgactccgaacaccttactctgttgtttgtttgcttttgaatttgttcagaaactgggcagggaaagagtcctttttctaggtcccccagaggccttggcctgtgtgattataaagagggcacgttctgtttttcatcaccctgatgttccgtgaacacgctctgttcacccggaatatctaacagtcattaacttgtacttaataacgtcgtcttgaattttaaaaagcaaaactgagagaaatagaaggagaagtggataaacactgagttatagtgggagattttgacaacattgctgagaacccggtggattgagcaggcaaaaaattgtgaggctatggaagacttgaaagatacagttaacaaatttgatcttggctaacatgtattcttgctcttagcaaaagaaaaaaatacattttttcaagctcacatggagtggcaaaaagtaaaagtccatgtattaaagtcaacacatttcaaataatatcatttagattgtgttccttgaatataagacaaattatcaacaattaaaatactggaggggaaaaaatctcatatttggaaagttaaaaactttaaaaaatgactaatggactaaagaggaaatcacaaaagaactgacaaaatatttagaactaaatgacagtgaagatactgtgtatcaaattgtgtgggctgcagttgaagtggtatttagagagagatgtatagttctaaatgcactttaaaaaaagattaaatgagtaagtatgtaggtcaggaagctggaaaaagagtagttgaaaaaactctgaagaaaatagaaggaaggaaataaaaaagacaagaaccgactagtgaaataggaagcaaaaataaaaaaggatagagatggtaaaagaaaaaactcagtcttactagatcttactagtctttcaaaagactagtaagatcgataaacctccagctaaaactgataagggaaaacaaggaaaagatacaaacaggccaggtgtggtggctcacgcctgtaatcccagcactttgggaggctgaggcgggtggatcacctgaggtcagaagttcaagaccagcctggccaacatggtgaaatcctgtctctactaaaaatacaaaaaaattagtcaggcgagttggcgggcacctgtaattccagctactcgggaggcggaggcaggagaatcacttgaacctgggaggcggaggttgcagtgagccgagatccagcctgggcaacaagaatgaaactccatctcaaaaaaaaaaaaaagaaaaaaagaaaagaaaagatacaaatagtattacagcagtaaaggtgaggacgcagttagaaacaaagatgaagtcttcagagaataccaaaaacaactttgtatcaatgtgcttaatgaatgcttttatataaacatataaatttccaaaattgactcaataaggagtagaaaacctaaacattcaccactaaagaatttgaattagtacgcaaaagtatcctcctataaaaacagcaggcccagagatgtcacagactagttttagcaaacctttaaggaatgagaaaatctctttattatacaaactatttcaaaggatcaagctgggcgtggtggctcacatctgtaatcccagcactttgggaggccaaggtgggtggatcacttgaggtcaggagttggagaccagcctggccaacatggtgaaacctcgtctctactaaaaatataaaaattagctgggcgtggtggcgcatgcctgtaatcccagctactcgggaggctgaggcaggagaattgcttgaacccgggaggcagaggttgcagtgagccgagattgtaccaccgcactccagcctgggcgacagagtgagagactccgtcttaaaaaaaaaaaaaaaaaaaaaaaaaagatgagaagcaacccagcaattttataagactggaataacaccttgatatcaaaacctggcaagggaagcacaagaaaataaaaaataggccagtgttgcttttgaacagagctgtgaaaatctaaataaaatacagtagtctcctcatattcatgggggaaatattccaagacccccagtggatgcccaaaatgtcagatagtcccaaacctgattgccgtcaatggaaacacatctgtttatatctttcacccacacatgtcatcctcttttcaccttaactaagcatttatgcactgtgggcataacttttgcagtttgaggtccaacagcaaaactagcaataatttctttttccttcttcacaatttcacacatagaaaattcatccgtaccatggatctcagcaaccttagcatagaatttttttctttccttattaagaactttcacctttcgacttaaaggaggcacttaacagtttctctttgtcatatccaaagtgccagcctcactcatgggccttgtactttggggccgttattagtatgataaggatgagggtggcttgaacacaggcggtgagatactgcaacagtccctccgatcactgagatggctgataagtgactgatgggtagggagcgtgtagggcgtgggtatgctggacaaagggaaaattcatgtcccgggtggatagagtgggatggtggaagatttcatcatgctattcaggacggcacaaaattgaaaacttatgaattatttctggaattttccatgtaatatttttttggccgtggttgactgcaggtagctgaaactggggaaagcaaaaccgtggataagggggactgctgtattaataaattgacttcggccgggtgctgtggctcacccctgtaatcccagcactttgggaggcggaggtgggtgggtcacctgaggtcaggaattcgagaccagcctggccaacatagtgaaaccctgtctctactaaaaatataaaaaattagctaggcatggtggcaagcaccagtaatcccagctacttgggagcctaaggcgggagaatctcttgaaaccgggaggcggaggttgtagtgagccgagatcacgccattgcactccagcctgggcaacaagagcgaaactctgtctcaaataaataaataaataaataggcaacaagagcgaaactctgtctcaaatagataaataaataaaaaaaataaaaaaattcaggatattaaaaataatatgtcagaagtaagtggagtttttacccatggaatcaaaaaacggctcaacagaaatgtaattcaccaggtcaacagattaaaaaccatatggttatctcctcagatgcagaaaagcattcagtaaaatccagcattttcataatgtgctgaatgaatcaggggatcaggctaaatttagaccctcatggtgaatccctttatgaagcagattccatcccatttatattttgagtaagcccagattttgaaatactaggttttcttttcataaaggtttaatttcatgacgaaacccaaatatatccagaagctgtgctcagttctttgggagaacacaaaaacctccaaacaaaccaaaaaataatggcatccttatttgcatttcccgtatttcagtggcagacagatatatcaggcgtgttctgttttttttttttttttttttttttgagacagagtcttgctctgtcacccaggctgaagtgcagtggcacaatctcggctcactgcaacccccacttcctgggttcaagcgattctcctgcctcagcctcccaagtagctgggattacaggcacccaccaccgcgcccagctaatttttgtatttttagtagagacggggtttcaccatattggccaggctggtctcgaactcctgacctcgtgatccaccctctttggcttcccaaagtgctgggattacaggcatgagccactgcccccagccaggtgtgttctttaagtagccacctccccagcatgcctaagtaggattccgttttcccacaaggcaagtgtgatgtgtggttgggccacctgaggccgatctggcctcagagaatcctgaagccagtgtcctatgtgctgtgatctcggccaccttcctcttggactgtttctttccttttcttcttttttttgaggtggagtctcactcttgttgcccaggctggagtgcagtggtacaatctcgactcactgcaacctccgtctcccgggttcaagcgattctcctgccttagcctcccaagtagctgggattacaggcatccgccaccacgtctggctaatttttttgtatttttagtagagactgggtttcaccatgttggacaggctggtctcgaactcctgacctcaagtgatctgccctccttggcctcccaaaatgctgagatgacaggcacgagtccccgcgccctcactgactgtttcttagggatgtccttttttctcccgtcttgtgcaggtccaaactgaagacggtacatgagcggatccccttggctggactgagcaagcttcccagtgtccctcagattgcaaaggtgagaaaccaacccgtgagagatggtggcttcctctctcagcccagggctggcctctggaatgggggtgcaggtatatcctgggtaggctcagcccttagagaaggggaggccactttactctttggccattgactgcactgataggggtctgggagggctgtgggcagatgcctctgtctttcctacgccctccatagctcatccttgttgccgaggctgcttaggaacagtatcctccatggtctctacttccaggtagttcacagctagtttgggaagtgagagaagtagaaagacggggctggatgtggtgagtgctgtaggacttccgtggaggggtgagggcgggtggcctggggaaccttcacagcagaggaaagggctgagttgggctgaaggatgatccagattgagcacccccttgagtaaggaggctgcgaacctgagaactgagttagcaaagtgggtgagcaagagagtcagctgggttggttggaccctcactctgggagcaggaatgtcacagaattgtgctggaaacctttggtggcagttgtgggctggatagtttttggccttgtcttcaggccagaacggtgacgagcctcaggctttgtctaatcccttcccacacttcatcagcaaaccccagaaagggcggttgacttgcctgggcacgtgttagtgagcagcagtcagaatccccgcccaggcctcctgacccatgtgcctcgccctcccatgccgcattgtccaggtgggcagaggagcccagatgtcctctacagatatcatccctgacctgcgtcttcttctcccttctcaggctttctgtgatgatgcagtgggactgagattcaatcctgtcctgtaccccaaggtaaggaccttcatgctcccaacataggggccctgcagcttggcaaggatttgcagacctgtggctctttggggagttctctgcatcatagtggggtttcgtggggtctccataataagcttccatgtctccctctctccctgcccaccccttcacaaactgctccactgggaacccaacctcagccatgcctaggtctccagcccagctgaattggtccccaggctgctgtgaaggtgacagagggtagcagtgttgtagcttctccaccacacctcattggtacctccctgaggccagtgctggaggtggacgtgactctgtagctgggggctggtgcagatccagtctgctgtcacagaggggcgggaagtacagcaggcagacaccaagaagagaaaggccagacagccgccccgccattgcctgtgttactgcagctctccggccatataagcctctgctgccttcatttataaaccagctggttttctgatatcagcttcctttgaattggcctgatactgaccccagttctgatatgggcgtgtgagtgggaagaagagcaataataataaacccactgaggaataattatggcacaagaggactgaagtcacccatggacagtgaattgcttgaaattggccacaggaaaagacccagtgcatcgactgcgtcttcatgggccagcaggctctggagagggacaacggaagcagagctgtgcttctgagcttctgccgtgggtcacgctgcagcggctgaggcctgctgggaccggctctgtctatcctctgagtcccaactctgacaaccaggacccgtgagatgaaatgtctggtgaggaagagaggccccattccagcagagacatccagaatcccctggaacaaacactctttttttgagactgagtctcgctctgtcacccaggctggagtgcagtggcgtgatcttggctcactgcaacctgcacctcctggttgaagcgattctcctgcctcagcctcccaagtagctgggactacaggtgtgcgccaccatgcccagctaatttttgtatttttagtagagacgggcgtttcaccatgttggccaggctggtctcgaactgacctcaggtgatctgccctccttggcctcccaaagtgctgggattacaggcgtgagccacctcgcccggctggaacaaacactttcagtgttcaggattgggcatgccactctcagaagcagccgtgtatccatctgcagtggctgagcgaatggcggagtcctttcctgcacagagcctttcgtcttccacgtgcctctgtttagctgttttagcatctgttgataccaggagtatgctacgcttcattgaacattttctctcattgagactgacctcccctttataattacaactgaatgagtggggtttaaccagacattaaaatcccatcataaaggtctaacttaactaccggtttggcaattttggttgtcaaatcttagccaccgagaggaccaatggtgtttatttgcagagttctctctatcccttggaaagcctcgggccttggtcataatggaagagcagctgtattttcatgttttctgtatctgaaggaccgctgagtccggctgggatgttcatctggctgagatgcacgcatgtgtgtgtttttaaaatttgcagagtttagaacgttctttggacgttctccatggcctggtgcctctccctggcagggcagctgttcctcccctgtgactcacccaggcaggagtggaggctccagggtcgggcagcagcgccgtcgctgggggagctgcgaagcgtccgtttccccagacagctgacagctgagagcctcacagagacacacagtgtgtggcaacctcacacaggccgcagattccggccaataagtcgttcctggtttgttcttcctctcgcataacgcgtggttgaatccctcctttttttttttcttttttaaatgtcacatttaatgttttcaccgctgtccttcaaatctaagttgtgcaaagtgaccagaaagtgtgccacggtaattgaccagcctctgagattgaacctttcacactggtgcctttttgggctctttggacgctaaacacgtttctcattcaagtgcgttgacatgcttcagttgggttgattctcaggagcgtcataaaaaacaaaacaaaacagaaacaaagatattgcgccatctttgtttagtaatttaatgtttgtgtctttcgtagcaaataattacttcattgaagttaaaacttccaaacataacttattaatggtcttcaaattcagctcagatcactcaagtcgaaagtactctgctaagtacagataatttaaaatagctttaacagttaattgtccataacacacaccaaggtttttttcctagaccaactgtaagacgatccattactattccttgtacaggtgaaaaatgatactcagttttcttgtctttttatttttaatgtaaaagttggaagggacgttcaaatttcaagtctccacactgagaatccctcctttttattgctgaggttatcccaacagctcccagatcttttcttcccccagtaagctggttcagctctgatatttctggagggtcatatagatgatgatggtgttgatgatgatgatagctgctctgtgctcagttctttctttttgaatcttcataaccacacatctgcgtttaacagatgaggaaactcagctccagagaagcagctcactcaaagctacataggtaaaaacagtggattcaaaactagagtttaggctgggcgtggtagctcatgcctgtaacctcagcgctttgggaggctgaggcaggcggatcacaaggtcaggagttcgagaccagcctggccaacatggtgaaaccccgtctctactaaaaatacaaaaattagccggtgtgatggtgggggcctgtaatcccaactactcgggaggctgaggcaggagacttgcttgaacccgggaggcggaggttgcagtgagccaagaccacgccattgcactccagcctgggtgacagagcgagactccatctcaaaaaacaaaaacaacaaaacccgaaaaaacttggagtttaatttttctgatcccagtcatcaactctatgatgcgtaacggaaaattagatagaaccaggagtcaggttttaaacatttcctctttgcatattgtattagggtatgttcctccttagcgtggtctccttagagacctctcattttatgcagaggggactgaagtttggtcaggagcggtgacttgctcggactcatgctgctgattagaggtggaattaggactagagttatccttgctgaccagttttggggttttggcttcactttttacaccacagattcaacactagggttaagtaagctgctggacacatgtgcccgagccttgactggcacatctggatgggagtggaatgagtgatacagaggtttggttcctactggggaagcccaagttttagaagctagctgactttggagctgcggcctgactgtctacttattatttctctctctctccctccgtgtatgtggatgtttcataccagggaacacattctctccccaaatggatgcttcccctgccatgtgcttcctcacttgcttccaaatttaacaaatgttgattttttttttcttgccacattttccaggcctcccaaatgattgtgtcctatgatgagcatgaagtcaacaacacattcaaattcggagtcatttatcaaaaagccaggcaggtaagcagcaccatccataccggtgactgtatcccgtggtttctcacttaggactctttttatccccacccagaacacaggagtcctgacctgcgttctgaagcatttggaatacaacggtcacatttaaggtatgaattagactggaggtggcagaactttccagcaagggtacttcttacaaaaaggcctgcacgtccttaaacagtgatgtttttttttttttaatatagcaaattctcattcttcctggctgcctcgtcttctacgtatttatgggctgctggttataagaaaaaccagactaggtcaagggaatggaggagcataggctgctctctccttgcccaaatttctccccactgggaattagctttttctccccaaacttgagtgatgtgatggagccagctgggtgcgtctcttcacaactctgttccgtgacatcatgttggcagcttgaagtcaaccatggtggaagtatttacactatggaaatttgcaaacaccagggtttctatcttcctcctttggagagccagtgactcaaaatatgccagcacaccactgctcagcctctgtgttttgtagccctcacacgttgctttggagttaactggccagaaccatgtttctcaaagtgtgtttcatgaatgcgagtctgatggtgtactctgtgagcaaatgacctggggaggggttgtcacttgtgtgggaaccttttaaaggcttaaagaacccccaaggtaaagggctctttataactttgttgaacttagtggtttccatacttacggacacaaacttcccatcttccctacctctttcctaccatgaacatttattaacatcccaagtagaggggttagctgaacacactgtttcctcaccgagactctttgagagaaaagttccacacccatttcatctttgtatcatctaagagcctagcatagaaatacaccttcatataaatacactccactgttaggtgagttaatgaacgaataaaaatgttggccctactaatggcaggttaatagtatcttctgatactatttgtatttttttgcatgatggtatctttcttggttagacgacacctgatgttctcatttagagatattggcccttaagagacatgcgtttgcttaaaaatattctaattatatgaagagtttaggatctgcaagacgaacactgatgaatcttataagttaagggagattattcaggtagctactataatcattttcacatattacatttttattttatacagctttgctaataaaaccccctaattaaagttctttgcttgtggaatttaccaaagcggatcttataagctgattataatccaatgttccagcaaagttataattactgaacatgagccatccgtctccgagagggagtctgtgtattgtttatgtacctgatgctgctgtggaggaaaaagccaagaagataatttttttttttttttttaagaacctaggcagattgttgttttgcaaacctgcagctgggggacatttaatatgaacatttgttgcatcaaagccctatgctggtctctgggtataaatgagcctcacctaactctcgtgtttgctgttcactgtgctgtgcatgctgggggatacggtgactaagacccctccctgagtgcacagtccagctcaaggccaggatcaaaataatggcaatactactactctcaggctggatgtgaatcttgcaagagaagtgcaggtcccacagcacacgctgcattgtttttctagtgggagatgtagtttgcctggaagcagctgctcttccacagtctggcctcatgacctggggcaagtaggacatgtggctagagttgtgacgccttcatggcatgctatagatcagggattggcaaacttttttgggtaaagggccagatagtaaatatttttagacttcatgggccttggagtctctgtgacagcctctcagctttgccttggtggtgcagaagtagcaatagacaatagataaatgagttggcctgtctgcgttccaataaaactttatcgataaacacaggcagcaggccagacttggcccatgggctgcagtttgttgactccttctagagtgcggtgtttcccagccttcagacattcacagaccatatccaggatctgtatcatagcatttgttgcaccctatgccactgttaagatctttatcacaatattttaacgaaatattttctttaaaaagttttgttttaaacttacatacatttattttttatttttatttttatttttttgagacggagttttgctcttgttgcccaagctggagtgcaaaggtgtgatctcggctcattgcaacctccgcctcccgggttcaagcaattctgcctcagctccctcgagcagctgggattacaggcaggcaccaccacgcccagctaattttgtatttttagtagagacggggtttcaccgtgttggtcaggctggtctcgaactcccgacctcaggtgatccgcctgccttggcctcccaaagtgctggtattacaggggtgagccactgcacccagcaacatgcatttatttttaaaggaaattttatatcactcctctaactggaaaaccagtatcatgaaatgaaggtaattctaaaaaaaaaatactgtaaaaagcaaaataaaattattgaaatctaccagattctgttgcctgttgaaggcatggagcccaagttctgctttttgttgttattgttacaattacctactgaagacattctcttgaagtgattgggtaggctagagtgtctttgtatcatctgccgctcttcatggcagcctgtgcatgtttgcagagccttcagctgtttgtacatcctgctactgtgggtagagcctgttgatcaggcagtgtttgaaggctgttactgtttgcagagcttgctactgttttcagctttgttttttacaaaattagccaggagtggtggtgggcgcctatagtcccagctacttgggagtctaaggcaggagaatcacttgaacctgggatgcagaggttgcagtgagccgagatcgtgccattgcactccagctggagcaacgagcgaaactccatctcaaaaaaaaaaaaaaattactaacctttttatctttaggtatttgtagattcacatagagttgtaaaaaataatacagcgagatctcatgtaccctttacctactttccccgcaaagtaatgtctgacaaaacgatagcacaataccacaaccaggatgtggacatcaatctcccagctccagtccgtaacccctgacaaccactcatctgttctccaacttctaaaacattgttatttcaaaaatggtatataaatgtagtcatatagtgtataaccacttgagattggcttttttccagtcagcaagattaatccaagttcttgggtgtatcaatactgtgttctttttcattgctgagtagtactctgtggtattataactgtaccacagtttgtgtttaaccatcacccactgaaagacatttttggctattatgaataaagttgctgtgaacatctgtatataggtttttgtgtgaacataagttttcatttctctgggatacatgcttaggaatacacctgctgagttgtatggtaattatgtgtttagttttgtaagaaactgccggccgggcgcagtggctcacgcctgtaatcccagcactttgggaggccgaggtgggcggatcacgaggtcaggagattgagaccatcctggctaacacggtgaaaccctgtctctcctaaaaatacaaaaaattagccaggtggtagtgggcgcctgtagtcccagctactcgggaggctgaggcaggagaatcgcttgaacctgggaggcagaggttgccgtgagccgagattgcaccactgcactctagcctgggtgacagagtgagactccatctcaaaaagactctgtctcaaaaaacaaaaacaaaacaaaaaaaaaactgccaaacagttttctagtgtttcttctcaccagcagtgtatgagtgatccagtttctctataacctgccagcatttggtgttgtgactgttttttattttagccattctgatagatgtgtagtggtatcaccttatggttttaatttgcatttctctaatggttaatgatgttggacatcttttcatgtgcttatttgccatctgtatatcctcttaggggaaatgcctgttcatgtcttttttttgagacagagtctcactctgtcacccaggctggagtgcagtggtgtgatctctactcactgcaacctctgcctcccgggttccagcgattctcccacctcagcctcccaggtagctgggactacaggcacgtgccactatgcccagctgatttttgcatttttagtagagactgggttttgccatgttggccaggctggtttcgaactctggacctcaagtgatccacccgcctcggcctcccatagtgctagaattgcaggcgtgaggcaccgcgcccggccgttttcatgtcttttgaccattttctaaatggatttttttttttaactgttgggttaaaaacatttttaaaaataacagctttattgagcacatcagcataattcttgtaccatataattcataatgttatgtaatttatatctcaatgaagtgtgcagttcagtggtttgtagtgtaaccacagaatcgtgcacctgtcctcactaactccagacattttcatcacccccaaaagaaaccccacactcaccagcaggcactccccatccccctttcctttagttcctgccaaccctaatctaatttctgtctctacagatttgcctattctagaccttttataaatggaatcatcatatgtggccttttgtgtctggtttctttcactcagcgtaatattttcagtgtttatccaggtcgtagtatgtatcagcacgttgttccttgttcatggccaaataatattccattgtgtggatagcccacattttgtctatctattcatcagatggacatttgggttctttctccttttgggccattatgaatagtgctgctattgatattcatgcatacattttctgtggacatgttttcatttctctttggtgtatacctgagagtgaagttgctagatcatatggtgactctatgattagcctttggtatatacctcagagtgaagtttctggatcatttggtgactctgtttagcctttggcacatgcccgggagcaaagttgccagatcatatggtgactctgcgtttagcctttggtatatgcctgggagtgaagttgccagatcatatggtgactctgcgtttagctttccatatatgcctgggagtgaagtttctggatcacatggtgactctgcgtttagcctttggtatatgcccgggagtgaagttgccggatcatatggtgactctgcgtttagctttcgggacctgcctgggagtgctgttgccagatcatatagtgactctgcatttagccttttgaggaactgctggactgttttccacagtggctgcgtcattttccattttcagcagcagcgtgtgatggttctgatttctccacaccctcaccaacacttgttattgccttttattgcctttatttttcattgtggccatcctagtgggtgggaagtggtatatcattgtggttttgattactttagagttttcagagttctttattctttttttttttttttttgagacggggtctcactctgtcacccagaccggactgcaatggtgtgatcttggctcactgcaacctccgcttcccaggctcaagcgattctcctctctcagtctcccgagcagctgggattacaggcacccaccaccatgcccagttactttttgtatttttagtagagacaaggtttcaccatgttggccaggctggtctcgaactcctgacctcaagtgatccacccgcctcagcctcccaaagtactgggagtgagtctccatcagtccctcctctctccaccccagtcccactgagggcagctatggtggatgtgctgggagacagggagaaaggaagaaagggaccaggtacctgggcatccatattccttcctttagcatcagaaagaatttttctaattcctgcccttattcctgtttctctttcagaccctggaggaggagctatttgggaacaatgaggagagcccagcttttaaggagttcttggacctgctgggggacacgatcacactgcaggatttcaaagggtgggttttagccaagtgacggctccagctccatcaacaagggcactagaggaagggcaagacagctcagtcctcagggagcacgtgtgagttaaaaacacacaagaaatgagggatggcttttcagggtcttgtcgctcactgcatttctaaggaatcaggggtccaaggagtgatccagtgtggcagattcccctgaaggcgttcacgttcggccctgggccccgccccagatgtgccttcctacttacctttggcccagactgagaatggaaggaatccaccttccctgtcactcacctgccaggtgtgtgggaaagggagccccgtgcagttttggggggaaatgacctattttattttattttttatttttttatttttggagacagagtcttgctctgttgcccaggctggagtgcagtggtgtgatctcagctcactgcaacctccacctcccaggttcaggcgattctcctgcctcggcctccggagtagctgggactacaggcgcccgccaacacgcccagctaaggtttttgtatttgagtagagacggggtttcgccatgttgcccaggctggtcttgaactcttgagctcaggcaatccacccacctcagcctcccaaagtgctaggattaccggcgtgagccgccgcgcctggcctgaaatgacctattttagataatacacaaagaatgcatcatgaggagctgatgcaaatataacagttcctcaggcaggagtccatacaacagtctatgcttttttttttttttttgagatggagtcatgcgctttgccaggctggaatgcagtggtgcgatcttgactcatggcagcctttgcctcctgggttcaagcgattctcctgcatcagcctcccgagtagctgggactacaaggcgcgcgccaccatgcctggctaatttttgtatttttggtagagacggggtttcaccatgctagccaggatggtctcgatctcctgacctcatgatccgcccgtctgggcctcccaaagtgctgggattacaggcgtgagccaccgtgcctggctcagtctatgcttttttaagtgggcagtaagatagaacattggggccgttgcttggaaaactctggcccttgactttccttggccaagaccgcatttgggatgagtccagacctggccagcctgttttgtccttggtggctggcagatggctccaggccccagaattctccatcccagcagccagattgacatgagctcctcacatcgtgtgaaaatacctagcccagtgcctggcacacagcggatattcactaattgctttcttcctctgcttccttctctgtccttccttctttttcctttcctctcttcctccatcttctccctccctcaaggtcatcacggctgtctggggtcagtcacacctgggataaaacccccgctccatcacttattagctctgtgactttggataagtgacttgacctctataagcctcagtttcctcactgtaaaaagcgagataaagggctgggctcagtggctcacgcctgtaatcccagcactttgggaggccgaggtgggtggatcacgaggtcaggagtttgagaccagcctggccaatatggtgaaaccccgtctctactaaaaatacaaaaaaaaaaaaaaaaaattaggcaggcatggtggcaggtgcctgtcgtcccagctacttgggaggctgaggcaggagaatcgcttgaacccaaaaggcagtggttgcaatgagctgagattgcgccagtgcacttcagcctggtcaatagagggagactctgtcaaaaaaaaaaaaaaaggaggtaaagatagtgtcagccctaaaaggttttggggggattaaaataagataatgggctgagcgtggtggctcacgcctataaccccagcactttgggaggctgaggcgggcagatcacgaggtcaggagattgagaccatcttggccaacatggtgaaaccacgtctctactaaaaatacgaaaaattagccgggcgtggtggcacgtgcctgtagtcccagctacttgggaggctgaggcaggagaatcgcttgaacccaggagatggaggctgcagtgagctgagattgtgccattgtactccagcctgggtaacagagtgagactctgtctaaaaaaaaaaaaataaataaataaataaaaaataaaagataagataatgctcacgaaacacttaagtgctgttcagggctagctagtcacgattgttattgttcttatattgccaccttccattgactttgagatgctatcattataagacacatcctgtgactttaaaatgtgaaaaaacggccaggcatggtgggtctcacctgtaagcccagcactttgggaggccgaggcgggtggatcgcttgagcccaggagtttgagaccagcctgggcaacatggtgagaccctgtcattaacaaaaatttgaaaaattataaaaattagctgactattgtggtgtgctcctgtggtccccgctacttggcaggctgaggcgaggaggatcgcttgagcccaggaggttgaggctgcagtcagccatgattacaccattgcgctccagcctggatgacagagtgaacccctgactgaaaccaaaactaaacgtgggccttagaatagctgaaatacagtatagtaagcccagaaggtcctcagagttatgaaattctatccctttattttatggaggcctagagagactaaatgaattgtccacgatcacgtgctgatttagtggcagaagcaggtctagaacccggagctcctgccccctgtccagcattctttctgccatgccagcctgggcacattttctggcttgtattgtagtgttggggatgctgagattctaggtccatcttatttcattttcttaaaggaacctgcatctgctgaagactgtgatcaaagctggcagccgtgtgtataaaggcagaagggacaactcctggaagcccacccagttccttagagcttttctttcttgcctgtgaggagacagccagagaagggacttccctggatactcccaagcgggatgctgcagtggttgggcctgtatcttagggactagctaggcagaagttgagcatctgccacctcttctgactgactccagatgctcctctggggctccccaccagccaccaggatggctggctgccctagctctgggcagaggacttggacatggccttgcagagagcaaagaaaggccggcgccccaccttgggggaatggcaccggggatgggcatttgtctgggattgtggatggatgcgcttccttcccatataaccagcaagtgtggacacggcacagccaaggcttgagatggaggttctgctttgtgattgattggttgattgattgattgatggagtcttgctcttgttgcccaggctggagtgcagtggcgccatctcggctcactgcaacctccacctcctgggttcaagcgattctcctgcttcagcctcctgagtagctgggattataggcatgcaccaccatatctggctaacttttgtatttttagtagagacgggggtttcaccatgttggccaggctggtctcgaactcctgacctcaggtgatctgcctgcctcggcctcccaaagtgctgggatgacaggcgtgagccactgcgcccggccagctttgtctaaataatgggtttgtgggtagagtgccagcgctgatatacctggaagaacagatctacctgcttttcccacatcacagcctgctctgccctcagctctcctgtctcctctgctgcgtatcctctgctgcgtatacttaggggagcttgcattaagttgcccactttgcctcactctcttttctccccatctcctgccctgttttgttgacagtttccgaggaggcctggacgtgacccacggacagacaggggtggaatcagtgtacacaacattccgggacagggagatcatgtttcacgtttccacaaagctgccatttaccgacggagacgcccagcaggtaacctggtttgggagggctttgggagcccagggcgggcgaggtgagggcctgcctctggtctgacctgctaagaggctgtggccgtccccatattcgttcccgtagccggccattcgttcagctgcgcagcagcgtcacagtccgttctgctgtgtttctggccgaggctgtgcctcagcggtccgttctgttgtgtttctggccgaggccacacctcaggggccctgggcgggaggcggggcagagcttgtgtttcttccacgttgactgatgggaaaactgcagcccatggtggtgacaagacttccttgaggtttctccgtttatcaggggcagagcccagggcagagcctgggggccctggtcatagagggtggtggcaaagggtgcatggtggggtttgcagatgggggcctgaagccgcctgtgccactttggagcgtgtgactctgggcaagccagttaaccttctcatctataaaatggggggtaacaccacccatggtagagggtgattgtggggattacatacatttctgactagggttcatacgatgcccaattcatggctggcttcctatagaacagctgttcactgtccagcccctggtcattttgtcccccttcctgccccagtgacggaaggctggttattgcgtgagaatccttccccacccccagccttcctcatctcacaggctcctctctcaccacacctgtgggaattcagccttgacctccactagggagacctggacgagacccctgtccccactgctttcctgccgtgccccccgtttgctgctctgacagccgtgcatccctggggagagccgcggctggttcctggctgttacaagcccagttcccccagcctgccttctgccccttttcagtctgggaaaataagaaaatgcaggcaggcctttgcccaaactctgacctgtgtgtctctgagcaggaactggggagggagcacagatgtaaaattgtaaacatagtgcctggcttcttaggaaagaaggaaattggcaaacgagatgatgagttggctctaaaatagctactgaatgttccagaaacaaatggaagcagaaatccttttgtatccaaagtgggttttcattcaacctttcacctccagcccctctgttcccttatggcctctctcacctgctgccccggcctgggcctgaggcctgttctctctgggccttctcagtcttatgtgtgtttcttgggaaatacaccttggcacagggctcggctcttggcggggactgagtaaatattaagtttctcttcctgagaaatggaaagatgcgcgtggagtaagtgaggcaatttgtgtgaaagtgcccagcacagtgcttggtgtaaaacaggtgctcagtgaatgagaaactcagtgtgaagggactgagcattgggcctgcatgcagtgggtgcttaacaaaggaacaaatgcatagacaggcacctagccaggactcgacatacaggagcgggtttttgtgtgtgtgtgaggagggctgtcactctctcacccaggctggagtgcagtggtgcgatcatagctcaccgcggccttgaacttcaggacagggttaacatttgatatcatgcatgaacagcccaacatggttccagggacacaccaggtgcttggtggccgagatcacacccagaagcacctggccctgcttgggatatggagttatggttgggatcctccttccatcccacctacgccaagctgggtgagcagtgctgtcatgatctgccacctcatcactctcattcacaccttcaagaccccctgacacgtctcctcctccaggaagccctctcaggttgctttccagccctgtaattttgcccttgcctctgtctccagagctgtcagggatttcatgcacagcagctgacttagcccttgctggctggtggctttgttagttttctcaggtggcttcacctgtgtttgtatttctcccagatcaatgacaggctctaccagggcaagaccccgccttgccttttaaatattcttgccaagtcctgagtcagggatctgcatgctgtagaggtcagtaagatgctcgctagcctctacctaacgacttggccatcttccccattttttttttcctttttggtggcttctaaagattgaaagaaggttgggcacagtggcttatgcctatcatcccagcactttgggaggctgaggcgggctggtcaggagtttaagaccagcctggccaacatggtgaaacctcgtctctaccaaaaaatacagaaattagtgggtgtagtgtcacgcgtctgtaatcccagctactcgggaggctaaggtgggagaatcacttgaacccaggaggcggaggttgcagtgagccgagatcgtgccacggcactccagcctgggcaacacagtgagaccctgtctcaaaaaaaaaaaaaaaagaaaaaaaaaagattgaaagaagaacccccctggttttccccaaataggaaagcaactcaaaagatacacaaagcacgaagcgtgttccatgcacttctccccttgctgcctggcattggtactgtgctttcatacttaaacttccaaaacaacaaccacgaactcttctcactcagaattcagttttcctgtgtgcaaaggaaagtgaacccactctttccccaaaacatctttcatgattttcctaactggcttataacctctcaacactttttatttagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtaaggagaacgccttgttggagggagtggtgggcctcgacacctcaccctgtgtggatgctgtgatatcagaggacactagtcctcagcagtcagagattctccatgagtttgcaggtttctggggtttggagctagattctgggtagggaggaccttccaaggccacctgatcccccttgctgcctccgggctcaatggcatctcacttgaggattgaggaggtgtgagtgtagtatttggaatttggtgatgccatttgctcgctgtgagtgtagtatttggaatttggtgatgccatttgctcgctgtgagtgtagtatttggaatttggtaatgccatttgctcgctgtgagtgtagtatttggaatttggtgatgccatttgctcgctgtgagtgtagtatttggaatttggtgatgccatttgctcgctgtgagtgtagtatttggaatttggtgatgccatttgctcgagtaaggcagagctggaataaagaaagagcgtggaaaggacgagcaggaaagggtagcgatagaagggtgctaacgaaggaaaaaaagaaaaaaatgttgatggtgagggtggagaggaggggcctggtagaccctggccactgggtaaggccctggcctggctgttttggacaaatgatggatcttaatttaaagacctccagggaggcagatacgcaagcacctgggtctgaacctcccaagcagtcacgggtctgtcagatggctcgaaatcctcaccggtgcagatgacagcgagacagggcagctcattgcccctgcagtcccccgctccccactcctcatggctggatctctgaccctccctcctctgctccacgagaaagaatctccacctcttgggcaacagtctcttggtatcacagtgctgtggcgggcatgggactcaagggcgttggactgaggcaggctttcaaggcaagggttaggcagtctctgactccctgcagataaatgcaaaatgctgaatttgtgcctttccttggattcctgaaaagagaggccataccttaaattctcaaagcgctccctgctccgcaaaatatcaggaaccactgttctaagggggaggaaagatgagcctgtgattgccaatgggtaaccatgaggcctgaaaatgtttcccgtcaaataatttcagcccatcctgattcctggggttcatgaggccacagcagttcaactcagttaagtgcaaaattcacgtcagcttttaaaatgtgatgtgaatcgtcagaagaaaataaaaagaggctgggcacggtggcgtacgcctgtaattctagcgctttgggaggcagaggcaggaggattgtttgaggccagaagttcaagaccagcctgggcaacatagcgagaccctgtctctaaaaaaaaaaaaaaacagaacaaaacaaaataaaacaaaacaagcaacagaaacccaatagcaaccccctcctgttgaggctgattccttcatgcccaggctcatgtgtccctgccattgagcagttttagctgaagctggcgaagacatggtgtgagcatttattttcttttcttttctttttgagacagagtcttgctctgttgcccaggctggagtgcagtggtgcagtctcggctcactgcaacctctgcctcccaggttcaagtgactctcctgcctcagcctcccaagtagctgggattgcaggctcctgccaccatgcccagctaattttttgtatttttagtagagacggggtttctccatgttggccaggctggtctcgaactcctgaccccaagtgatctgcctgcctctgcctcccaaagtcctgggattataggcgtgagccactgtgcccagcccatttcttgaaggctataggatcacctgctttgagtgaaatgggcattcacttcaaacagctgctcgattcaagtgttggttgaagcaagttgacttactcagtgcctactgtgcgccaagctccaggctggaatggggctcgtggaggtaacagaatcagcctcagggccttcctgatgccggagaaggggcagaagaagcagggagtgcaggtccaagcaccaggctgaagtggggctcgtggaggtaacagaatcagcctcagggccttcctgatgccggagaaggggcagaagaagcagggagtgcaggtccaagcaccaggctgaagtggggctcgtggaggtaacagaatcagcctcagggccttcctgatgccggagaagggacagaagaagcagggagtgcaggtccaagcaccaggctgaagtgaggctggtggaggtaacagtatcagcctcagggccttcctgatgccggagaagggacagaagaagcagggagtgcaggtccaagcaccaggctgaagtggggctcgtggaggtaacagaatcagcctcagggccttcctgatgccggagaaggggcagaagaagcagggagtgcaggtccaagcaccaggctgaagtggggctcgtggaggtaacagaatcagcctcagggccttcctgatgccggagaagggacagaagaagcagggagtgcaggtccaagcaccaggctgaagtgaggctcgtggaggtaacagtatcagcctcagggccttcctgatgccggagaagggacagaagaagcagggagtgcaggtccaagctccaggctgaagtgaggctggtggaggtaacagtatcagcctcagggccttcctgatgccggagaaggggcagaagaagcagggagtgcaggtccaagcaccaggctgaagtgaggctggtggaggtaacagtatcagcctcagggccttcctgatgccggagaagggacagaagaagcagggagtgcaggtccaagctccaggctgaagtgaggctggtggaggtaacagtatcagcctcagggccttcctgatgccggagaagggacagaagaagcagggagtgcaggtccaagcaccaggctgaagtgaggctcgtggaggtaacagaatcagcctcagggccttcctgatgccggagaagggacagaagaagcagggagtgcaggtccaagcaccaggctgaagtgaggctcgtggaggtaacaagatcagcctcagggccttcctgatgccggagaagggacagaagaagcagggagtgcaggtccaagcaccaggctgaagtgaggctcgtggaggtaacaagatcagcctcagggccttcctgatgccggagaagggatagaagaagcagggagtacaggtcagccactgggcagctgaactactcaactgcttcttttaatagacagttgaagaggaagaactactgggaaggatccttggaatgaagccatgtgataggagggctcccagaccctctggcagaacgaggcctcctgtagacgtttagcatttgcttctctttcccaataggaaatgcatctcagctaaccagcttctccactttcccgagaccttagccgagtggtgcactcatacagagaaaaatcagagatccaaaaaagcgccaccccacctccagctgtggtgctagaagtctttacccactcttcttctccttttttttttttttttgagacagtctcgctgtcacccaggctagagtgcagtggtgtgatcttggctcactgcaacctctgcctcccgggttcaagcaattctcctgcctcagcctcctgagtaggtgggattacaggcacccaccaccatgcccggctaatttttgtatttttggtagagacggggtttcaccatgttggccagaccggccttgaactcctgactttgtgatccactggcctcggcctcccaaagtgctggcattacaggcgtgaaccatcatgcctggctgtctttactctttcttctaagccacaaagcacagcattgtcctcagaggggtgatgagaagcaggggggcagggcttcccggaggagcaggctgtggtaccttgatcgtgcactccacctgccaggcagacactgaggctggaaggccagacgtgtgaatgaggccagggagggggaccagccttccaaggcactccccaaagcgctgtccatccacactcccggcagcaccccaggtaattagcagactgcgaggaggacccggttagatcccccagggggcctgggtgaagcaggaccttagctggcccctgcaggctcaggggctgtggcaaagaaggctgagatttcctctgggactgagtaagccccaggaggcctccactggggagggtgagctgaagaaagaagagtataaaggagggacagggttgggtgtgtgcaggaaggggtcctcttctgtccacggaggggccgggctgcctggggttctggtcctggcactgcctctgctgcgtgaccttgttccttccctctctgggcctctagttttgtctgtgtgaaatgaggaagttggattagacacctgcaggctgctagccctgacatcctgcgggagggaaggaggcgtgcttgggtgtgtgtgtgtgtggtgggttgcaaggtgctttggggaaactctatttcaggagccctttactgggtgcaggtcagcaggggaagtgaaaaggccactgggcgacagtggttaccccttaccagctgcttgctcatgccaggcacggtgctgggtccttagacgcacagtcttgaatcctgacaagcccctggtgagacaagacctctcgctagagggaggaaatggaagctgagagctgaacccacttaaggcctgaggccacagagccagggagctgtggctgaggtcctgtctgggtctgcttgcggtcttggtcattgagccatcagagcaggcgagaaattggctccacggagtcgggtgtgcacgaagcatcactctggattatttttcagaaatgagtgtagtcctcatcctgcctgcttggaaggaaagtccagctcagccatcaccaggactacccctttccctcccccctatccctgcctccctctccggaagtcctcaaaggtgtcaggaatctcaggtgaagcccaccgccggggagggccctgtctttgtagccccctccccgtttcccgtcacgacttgtctgttgctcggacgatgctctgtgtgccaccgcggctcccaggccactcttgggcgtggggcctttgtcacgtttgaagctttctgaggttcccagtgcatcctcatgacccacaccaagctccttcctccttccagccatgcaggtcccttccccagagtcacctgcatctgcctctctccctccctccaagccctcgctggaggccctcgctgcatttagaaaacaggaaggtggggctgtgttcaggcaacttctgctttcagtccagtgacccagatgtccccaagaggggggaacaacaaaggcctggccgcctggttggaatggggtcaagagaggcgcacaatgaggatggaaggtgaacgcacgtcgcaaggaagggccctgtcctccgtgtggcccacagggctctgctgtgggactgtccagctggagggttggatggacttgaggatgtgtctgaagccacttacacggtcggcacagaccactctaatgcaggctggaggaggagggggagtggggtgggaagggcagagctggggctgccctctggcctctgtcccaggtgcccacggtctgcagtctccccatagccttcccacacccccacccctgattctggctctgtgactgaattcttgacctgggccaccggtgcctggtgggtggtggtagggaaccgggttcagctgctggagcccagccagaaatcacgtcagccgaacgcgcaccatttcctgactcggggcactgcagtttgggctgggcagacagcctggagcttgagaagagaaagcccgtattgaccagctctctcccgctccgtttcccctccggactctggcagggcctttccttggctcggtgcccagctgcctgctcacccggcctggcagactctgcatctgctccacttcacaggccggggaggctggcagcacgccagggctgggctcacgtcagcggctgtgtagggaagggagggcagtctcccgagagcctcacagcctcgtgggctgagaataggtgaagtcagggcacctctgtgcagagggaaggcggggtgtggggcccgtcccacgcctgggcgacccccatgcagcgaacctcgaggccgtcactctaaagctcagtctcactcagggtgccagaggtgcgcgccccaccctcagttcctagcctgggcctaggactggctgaccccgtgtgtggggccagggctcccgaacacgggtccaccggctgcacgagagtttccggggggccctacccttccgattcggcaggtttaggccagagcccatgaacccagtctgtatttttaaacacctgaagcaattttgaagcaattctgatttatggccgagctgaggagtcaggcttgggaagagaaccccagagacgggtcgggagaggtctggatgctctgttcctctgcggctaatcacctgtgggacttgggggcttctctgtgtgtctctgggcatctgtttcctcatcagggagaacagttctccctgtgccttctcagtaggattagcgtcacggtcgaatgaggtcacgagatgccatctcccgggcacttgtatggcattaaaattagggtcccagccctgtccagtcatcttgccaaacctgcttctggcctccaggaatgcagatgagaggctgcggatggccccacaccgtccggccccacttctaggaacagggtcagggcctgtgctggcgatgctcacaggagtattttgtttgtgttctgggaagaggaggagggagaaggtgagtagctttgtaaggagcgtggctcccgtaggggcagcgctcgtctcttccctccaggtccgtaccatgactctgtttcactcaggtctctgtcactgcgcgggaagatgtgcccacctttggtccacctctgcccagtccccccgttttccagaaggtaggacactcttccttctgcccctctcgcatccacgatgccaggtctcagtgcttgagtagcaatggttgggatggagccaaattcaggctgggaacattagggagctccttttgcaggttttggggggaacctcctttcttggggtctctccccacctctttcatgctgccagtctggcccagcataggaccacttgtcagggtgtttgacactggggttgcttttctgctgaaagacgggcttttatgttgagccccggtcaaggagccttgggcaggaatgagctccagtcgtggaagtgccactgtggcttcccaggaccagggaagcgggtttccttgttgggatatttgcaagtgggcttggcctgggctagaaatgatccgctgtcggaagggacttttcaggggttctccccatggccccggctctgcctgcctgtcactgtggctgaagaccttctggcaacagccgagagtgacagacctgaggtccgtcttgtctcttccagggcccggaattcagggagtttctgctcaccaagctcaccaatgccgagaacgcctgctgcaagtcggacaagtttgcaaagctggaggtgagagtgtggtttctgaaggtctccctcctgactgctgggccacctgttagccagcctcatccagggctcctccatcttttttttttttttttttttttttgagacagagtcttgctctgttacccaggctggagtgcagtggcatgatcttgggactcaccacaacctctgcctcccgggctcaagtgattctcctgcctcagcctccctagtaactgggattacaggtgtgcgccaccacgcccagctaatttttgtatttttagtagagacagggtttcctccatgttggccaggctgatcttgaactcctgacctcaggtgatccgcctggcccagcctcccaaagtgccgggattacaggcgtgagccactgcgcctggccaatcagtccttttttttttttcaagacagaatctcactctgtcacccaggctggagtgcagtggcccgatcttggctcactgcaagctctgcctcccgggttcacaccatactcctgcctcagcctcccgagtagctgggactacaggcgcccgccaccacgcccagctaattttttgtatttttagtagagatggggttttgccatgttagccaggatggtcttgatctcctgacctcgtgatccgcctgcctcggcctcccaaaatgctgagattacaggcgtgagccactgcgcctggcccaatcagtcatttttaaagcacctactatgtgtcaggccctattctgttccctgggatatggggataagtgagacagtttctatccctggagagtacacagggtagtcggggggtggggcagggggtcattactaaatagatagttatagtacagtgtgccagcactaggctgggatggaggtcagcacagctcagatagtgactgtttctgcctgtaggggacagagggtgtgttcagggaaggcttcctggaggaggtggctcatgcacagctgaatcttgatatcagatgaaccttctgccaggaggaaagagtggggaagggagggctgatctggcatggtagacagcatgagcaaaggtcaggaagaaccagagcctgacgtcaggagggagctcctgagggtttgctgtggctgaaggacccacgggggctggaatggtggagactcagccggagatgttggttggatcagatccagaagggctttgagctcgggacggtgggctgctggtaaagcgcttaggcaggagagtgaggggctcgatgtgtatgccagagggattgctctgacagtggtgtcattgagaacgatggtgacaaggacaggttgcagggcaagaggtgcaggaaggcggccagttagaagctatttacaggaatgcaggagagatgacaaaggcttatactgtatggaaggaaatggtttagggtcaaggttgggaagacttggtggactcctggctgtaagtgttgtgggacgtgggattgattgtagggtgactcttgggcctttggcctgggctctttgatgacatggtggccaagttgtgcctgcgaaggccgggttgctgaaagggccagtcctcatctgtgtgaatagcggcccctggcatccatgtgcatggctctggacgaacatctggatggagaggagcagtggggagttgggtgcgtggatgtggagctggggcagagggccgggctgggattcactcttccttctgctcctctaccaccagggtggagctgtggcagtggtgggacgacccagggagaagggcagggggagtagagcaggaggccgagcacgcagccttcatcttagctgcagcatttgtgagcacgaagctcagctcagcagtaggtccacaccgttgctgggccgggctgggcagaatgtcagcctccaggccaggtgtctggagctcacaaggagcaggcacatctctgctctcagagccagcttctccatccccaccctcttcccttctaggaccggaccagggctgccctcctggacaaccttcacgatgagctccacgcccacacacaggccatgctgggactgggcccagaggaggacaagtttgagaatggaggccacggggggttcctggagtcttttaaggtatgagcgtcagagtgactgatggttgctgtggggttgggattggggaagaaaggaagtggtccaaggtccatgggatactgatcccagagcccaagggccagctggaggggtgacaggaaacgtatgggtatcctaggtgtttgcaaagggcagggccgttaggaagtgtgtgaggctggagcagccagcagttttctcagcagcctccccatccttcctctatctgggtcatctcctccgggcccagaagtctgttaagcagggacaggtaaagaggtagcagtaggagaggagctggagcaagccaggaacatcggcgctttcacctgcctcctcctgggttggggagcccagggcagaatggcaggagcgaggaccacagcccttacgggtcttcgtagctgctgtgggtgccacagtgattcttcctagccagccggccgagcattggaagacctggctgggcaggggccatggaactataggcaagtccctttggactttgccaagggaaaaaaactaactagaaggagctgctaaaggaagcagtgagctccctgtccctggaagtattcaagtggagctcggacggcccccgagctggcgtgtggtagaggtttttcatcttatgcttgctgagtgcttgttggtccacgcagcacgtagacccagcatctggctcgagcctggctgtcagcctgtgcaggtggcggaacgggtcttgttatattcacgaacacacgtggggacaggatgagagacgccacaggcctgctcaggtccttacaccgaggcagagttagagcctcatttcaaacgcaggtcttctgattcttaggtccgtgtgctgctggattgcctgttagaaggtgatttggaaactcccatctgggggcattatgtgtgggactttatggggaattatgtgtagggctacacccacctctattaaaaccgcagctctgtgggatcctgggcagtctttcaagcctcttaaggtgcagctttcttgtcaacaacataaggataggaagcaggacccctgtcagagccattgtgcgagttcattgataccatgcctggaaaagtccagattgcctggaatatagtaaatgctcaaaaatgtcagctgttattacagttgtataaagtgaaagcttcacacacattatcccacctggagattcacaactgccctcagtgccctgtgaggaaggctattatttggggtgtaataattttggtataatagttcatactcagttttaataatgataggcatagtattatatgggaggaaaccaagcctcaaagagacagaatcatttgtgggagcaggtggagttgaatccaggtccgccggattccaaatccgacaccacctcccacttcctgactttgttaagattccacccgcactagcctgggcccgggcaggcctggggtcagtcccccactgcccggctggaccgcagagagcagggcacagctcttcctaccctagttggggccagctgccaagatgcctcttggggttgggaaaaggagctgagctgcttgtccaggctggtgggtgattcctggggcacctgtttcagtgctgatggacagtgggagcccgggtgaaataggagaaattgggagatcaagacggaagagggatgcagaagaagaggaacgggaggagagagggcgccaggtcagacaacccagcgagagaatggagagtgtgagatgcggtaaacaggaaaacgggcttgggtctggggaaggcaggaaggggggcaccacattaagccttccacaggctctagacttccttccagaggctccaccacactccatagcccacgtatcaaaacattctgcatccctcagtaaatgtaatttatgcagaactataagaggtgaggccaggtgccgtgcctcacgcctgtaatcccagcactttgggaggccgaggcaggcggatcacgaggtcaggagatcgagaccatcctggccaacatggtgaaacctcgtctccactaaaaatacaaaaattagccgggcgtggtgacgtgagcctgtaatcccagctactcaggaggctgaggcaggagaatcacgtgaacccgggaggcggaggttgcagtgagccgagatcacgccactgcactccagcctggagacagggcgagactgtctcaaaaaaaaaaaaaaaaaaaaaaaagaaaagttgagctgcagttggggagccaacataatgttgtattttgtagacatttaatgaagcacttgttttgagttttgcaggtttcttgtagtattttggagttaattggtttttcaggtttcaagtatttctatatcctggagatgcttgtaggctgtggacactctgcccatggtgcccaatggaggaggtggtccagcagctaaatacaggtggcaggtataaagagagtggcctgaggccgctctgtccagtcccccgcctctggcaggagtcgcagttgatctgtgcttgactcgagggggtctgacgtattcctagaggggcttacaagagaggaaacactttaagactttatcacgactcatctttgatccagtgatccagggaattcttttcaatactaaaaccctgcaactgtaggttgaagacaggcctgcttccagattctgctctcacacctacctgaggtagcaccgtggggcgtgggagagactgtgacagtcacacagagtaagcttcagggccctgacggttgtgaccagattttttttaaatttttttattttttaattttttttgaggcagggtcttgctttgtcacccaggctggagtgcagtggtgcaatcttggctcactgcaacctctgcctcccgggttcaagtgattatcctacctcagcctcctgagtagctagaattataggtgcccgccaccacgcccggctaactttttgtatttttagtagagacgaggtttcaccatgttggccaggctggtctcgaactcctgacctcaggtgatccgcccacctcagcctcacaaagtgctgggattacaggtgtgagccaccgcgcccggccatttgtgaccagcttttttccctcccacctggggagcacgagctcctgttccctgtccctttcgtcattgccctcacatctcccaagcatggaggcctgagctggggacaggccaggctcagccgaatggagccctggggcctggggtggattctggtgtttaggccatgcctgtggccaggcctgtgtgtctggcccagctcaggaaaccatccctagttttggtatttttttttcctgggcaccttgggcggtgctgctgtgtcaacaggacgttgcttagggagttcacccacaccttcctgggatcgctcttgaaacaagtgatacctgaaatgttccaggaagaaaagttacaggcctttatctcttcctgtcaaagtttttttttttttttttttttgagatggagttttgctcttgttgcccaggctcaggctggagtgcagtggtgcgacctcggctcactgcaacctctgcctcccgggctcaagcgattctcctgcctcagcctcccgagtagctgggattacaggtgcccgccaccacacatggctaaattttttgtatttttagtagggacaccatcttggtcaggctgatcttgaactcctgacatcaggtgatccgcccatcttggcctcccaaagtgctgggattacaggcgtgaggcactgcgcccggcctccttcctgtcaaagttctcatttcccaggctgatgggagcataactgagaatccccagggctgaaagccatctcagccatccatccttgcccctggtgaggctgctgctcccccacgtcagcactgacccttgatctttctcctgagcagcaggcctgccattgccctgtgttgtgccgcctggcacctcaccccgcttggagcagttccttacagctcacttctgtcctcccagctgtaatggaagcgtttctcccatgagacacagaacagttggcttttggacatctagacctacttttcaagctgaactgcttggagatagtctcaggaatctgctggttctacaaacacttctaaagtttgcattttcacttagatctaaaaaaaaaaaccttccaattataaagactgaacgtttggctgggcgcggtggctcacgtctgtaatcccagcactttgggaggccgaggcaggtggatcacctgaggtcaggagttcgagaccagcctggccaacgtggtgaaaccctgtctctactaaaaatacaaaaatcagatgggcgtggtggtgcacacctgtaatcccagctacttgggaggctggggcaggagaattgctcaaacctgggaggtggaggttgcagtgagctgagattgcgccactgcacagcagatccagactgtgtctcaaaaaaaaaaaaaaaaaaaaaaaaaacaaacctaaagtttgcagtgatcactccaaattaagagatgttcctatagggtaaataggtaaggcctgaagtcagcactgcatacgcagcccatggggccactggggttgggggtctgtgagcagattctcgggagtcttgcgagaacagctttcacgatgaaagagctgtacgttatgtttgaacgatgctgatctctagaccattttccagtgccattctcagttactgccagctgttgatgaggttgttattggtccgtaatgcaatgaaaagtgatgatacttgctgtaccgacgtcagatggacgtagagcacgtgcaggccacattttgagaaatgctgagctcacccagccctccactgacctcatcgcacagaggtggagcagaggaccggggaggagaaggctgccgggctggctgtgatggacccgggaccgtggcaagctgggagttgccaggttcatttctcccagcctttgagggactgtgatagttcatgccttggtctgacctgacccctagtggcaggaggggccacagctatccctggcagtctttgtggccccgcagtacctgcagggaggtacctgtaagccggtccccctagcagtgccagtgatggcaggtggagcacagcagggccccgccaagaatccttggtctttggcgtctttgccccctccttttcctcctgatggggagttgtgatgtcaggatggccccgctgttttgggggtccacgagagagctcaggccttgtgcttggccctgctccactcctgggtcggagtcatggtctcttggagcagagttggcatctgtcttgcatttgccccgctagagggacagaagacccggtgctgactcctcacacttacccagcctgccgcctcctcacacttaccttgctgactccggcggctgcaccaggactaattgaggagccagtgtcctccctgacaccagcctctgagtttttcttttcttttcttttctttttttttttttttttttttggtgggagccttgaaaattcgtggtttctaatcatccttcagtcatccaccagttgaattgtattttcaacctggaccagtttttaatatacagggacccttttatctggagcccagggttctgggtttggatcctggctctatctcttacctgctatgtgggcttgggcaataatttacccttcagaactttttctgtccaatgcctgtcctctctgcatctcagaattgtagagattcaatagatcttgtatgtgaagctcatgagaccagatactgttacacaggagttactatttcccacatggaatcctttctgggaaagagacagggaggaatacaatcacgtgtcactcaacgacgggaaatacgtcctgagaaatgacgggaatacgtcctacgacacacgtcggctatagagcccgtggctgccagcacagacctggatggtctagcctaggacacacgtcggctatagagcgtgtggctgccagcacagacctggatggtctagcctaggacacacgttggctatagggcgcgtggctgccagcacagacctggatggtcgagcctaggacacacgtcggctatagagcctgtggctgccaggttacaaagctgtgcagcaggttcctttactgaatattgtaggtaattgtaacacaaagacaggcatttgtatactaaacatctaaatatggaaaaggtacagtaaaaatatagtattagaatcttaataggaccagtgtcatctatgcagtctgttgactgcagtgtcattgtgtggtgctggactggattgcagaatataaatgattagtttggaatgtcatgattgatgatggtgttgtcaacgcacaagggcaccaagagaatgtaaagatgctgattttttttttttttttttttttttgagacagtctcgttctgtcacccaggctggagtgcagtggtgcgatctcggctcactgcaaccccagcctcctggattcaagcaattcttctgcctcagcctgccgagtagctgggattataggcacacaccaccatgcctggctaatttttgtattttttacaaaaattagagatggggtttcaccatgttggccaggttggtctcgaactcctgacctcaggtgatccacgtgcctccacttcccaaagtgttgggattacaggcgtgagccatcgcccctggccgagatgctgagatttatggagcacttaactcattcatggaacctggctgcggccaggcttggtggctcactttgggaggccaaagcaggaggcttactggagcccaggagtttgagaccagcctgggcaacacaggaagaacctgtctctatttatttatttattttaaaaaaggaagctcgccgctcctccagggacacctcagtgtgccaccacccctgtcctgccctcagttgttcaaagggtacatggctttatgatgcttgcgtgacggggtaaatagaacgcgctgactgttttaaccatgcggtaggaaaactgttgctaggtgaccctgttctatggtatagagagggagtgagagatgtccctccaggggcatctttgactcagataagagatgcccgatcaaatcaggggtatgaagctggtgggctacacacctcactgtcagtagctcatctagggggctgtccggtttacaaatggccctcctgagtctgcatcccttgtcaggatagaaaagcaggcaggatggggttctttgcccttcccaagcttggagaaatcctgacgtccagagagcccagggagacctgttgtttgggtcaggagcagcagccctgccattttcttgggaccactttgctgtagacccagctcttcctaagatgactcaaggctgggcgtggtggctcacgcttgtaatcccagcactttgggaggctgaggcaggtggatcacgaggtcaggagttcaagaccagcctggccaacacagtgaaccgccatctctactaaaaatacaaaaattagccaggcatggttgcgggcgcctgtagtcccagctactcgggaggctgaggcaggagaatctcttgaacctgggaagcggaggatgctgtgagctgagatcgtgccacacgctgtactccagcctgggtgacagagctagactctgtctcagaaaaaaaaaaagatggctcaaaagaggaagggaggttgtccacatgagaccatctgtaggttacacatggggtgtgtgagccaacacagttgtacaggtgtgcacaggtgtgaatccagaggggaaggggagcggggcccacaccttagtccttctgcatcagctttctgaagctggagttctgagagcagcctccctcgactagctcacactacgataaggaaaattcatgagctggtgtccaaggagggctgggtgactcgtggctcagtcagcatcaagattcctttcgtctttcccctctgccctccctggcttgtcagctttgtccctcaggcttggcccctcgtggccctaagatcattgtcatggttttgtctgctgacaaaacactgctgacatgttaaatcttttttgggaatcattgagaaaacctttccccagcgcacccagtggatatgccctcctctgccactggcaagaggataggctaactgactgccttaggcagatcatgacttaatcctgcgtcccatggaggaggaggacacgtttggctagaacctggctctgccagtggggagctcagggagcagaggtgttgatacttgtatgtgaacaacagataatattcgtgtccaggagtctttgcccttgcagaagcctggacaactgattaatccagaaggagcaccccacaggctctgggtctttcagcatcgcccaatgtgaggaatatgtcttgggcattcctcagaggcagaggccatgtcctacacatctcgactttcctgctgcgggtctcccagttcctggcacagtgctaggcacgtgagcagcctgcagcaggtgcttgttattaaccgtaagagtagccacacttatcagatcattacgatgtgctgggctgtctcctcagagccctgtgtgtattctcacaactactctgtggtgtagacaccaacatctctttcactctaagtctcagagaagctgggtcacctgcccggggttactcagctaatgcgtgctggagtagagggcccagaagcccagatacaaatcctggcagtgaaaccctaaagcctccatgcttttgactgctgagttgcattcctgcccggccagatccagtgactgatggaatgatcaaagggttactggagagaaccttctcttcctagaattctcacaccatctttgaaggcctttggagccagagagagcatcatccagggggcagccagagtcccctgggacttcttttgtcaggaaatccccccctgaggtggagccgagctctgcttcaacacagcactctgaggggtggttgtgccttcccgggtccatccctcccgtggctgagtaatcttggtttttagctgttctcactctcacatgtactttgacaaagccttgacctccctggtggtcctctcctgggtacttcaccatttgccagtgtgccccttgctcctgggtggcctgagcagctccgtgccccccgagaccctgcacttctgccaggctgagggtgcatctctttcagcacctccatcagaccaggggccgtaacaaaggcggatctgaagcccctgcaagtgggaggggcggctcagtgcatggattgatgcacagatgagtaagagaccctcacacacttgcacccatggccagcatattccaagttgcccagagcacactttgggatacaatccagtgtttattacagatggaggctcagttttctggaaaagagtcaacttgtggtcagacacctgagtgtgttgaatccccaccacgatgctgggtgtgaaacatagaattcccattttacagatgaggaagctgtagcttagagaggttagtaactaggtcagtgtcgcacaggcttggcgagctccaagcctcattttccttacctgtaagatgaagataataacctttgtccaccgtgcaggggagctggggcgctgacccctcagattccctccagccggggctgtgccttgcctccacccatgcccagagtgtggggcagaatatggaaacatcctctgtaagctggagtaactagtatgggcctctgtgaccgtgtgtgtgtgtgtgtgtgtgtgtgtgtgtgtatgtgtgcacgcatacgtgtgctgagggctgtgtctacagaccccacgaggagggcagagtcatccggagagcccgggtgctgattctcaggcccttgttctctccccgtagagggccatccgcgtacgcagccactccatggagaccatggtgggcggccagaagaagtcgcacagtgggggcatccctggcagcctcagcgggggcatctcccacaacagcatggaggtcaccaagaccaccttctcggtgagtgctggcaggccccggggcggcaagtgggtcccagggaggccccccccagacctatggaggaagagtgcccccacccaggcttgggcaggtgacttgatcagggcaagctggatgatggtgggaaactgaggctgcttgggggtgaccctgacccctgacctctgaaaacggtcctttggagcctccatcctagacagcacccggggttgacccagatggtgctagaagccctcctgtcctgttctcttgagtttccttgacagctagacctcctcctcggggccagccctgcagtgtggtcctggggtgtgttttgctgctcaggggctcgggacccatgactgtgagaggggtgtccttgctttgttattattaatggcagcagtagccaccccagcttactgtgtaccaggcactgagctgagtaacctgtagacacaatctcacctgcttcccatagcagctgcccgagatgggtgctgatgtgttctcctgttcccatttgaggaaaaggaggcccgctggggctcagtaacttgctagaggccactcagctaagcttaagagctgggatttgaggccgggcgtggtggctcatgcctggaatcccagcactttgggaggctgaggcaggtggaccacaaggtcaggagttcaagaccagcctggccaacttggtgaaaccccgtctctactaaaaatacaaaaattaactgggcgtggtggcgggtgcctgtaatcccagctactcaggaggctgaggcagagaattgcttgaacctgggaggtggaacttgcagtgagccgagatcatgccactgcactccagcctgggtgacagcgagactgtctcaaaaaaacaaaacaaaacaaaacacaaaatcaactgaatttgaatgcgattctgctggatccaaagtctgtgctgttcatcaccatgtgtacagttcccaagggaagggtcctgcaggcctgtgagtttgggcctgattgactcgtaccaggggctgggaaggggagggaatcatgtagttgggcctttcataaagcaaagtgggccgggcatggtggctgaggagggtggatcccttgagtccaggaattcgagaccagcttggggaacaaagtgagaccccatctctacaaaaaaatgcaaaaattagctgagcatggtggcacgcaccagtagtcttagctacttgggagactgaggtgggaggatcacctgtgcctggggaggttgaggctctagcgagccgtaattgggccactgcactccagcctggatgtcagagtgagaccctgtctccaaatctaagtaactaaagcaaagtggctttggatttgtatagactaggattttcctttcttttccttcaaaatagcagaacatactcaccatggaactaattatgagtattataaatggcctcgcataattaatttaattgactaaatattttcctagctattatcttgcttccccctgaaggtgcatggcgtgagcagagcagggcctcatctccatcctgtggatgaggagactcaggtcgggtctcattgctctcctgaggtgccataacatgtgcatggcaggagctggggcctgagttggaggcttggtggcctctagaggttggttccaggctcccatctgccctcctcaaacccccaccactcattgtccactgtgaggccaggcagctttccaaagcagaaggcgtcttggctgccgccaaccgcccattggtgcctgtggccctggctctgcggctctcagcctgtcttgttattggaacgcctgcgcggctccatttgtttgcgaggaatgaaggagagtcaggagtcctcaccctgccagtgatttgctggaagacctttggtcttcagcttccttgccggtaaagtgagaggttgaaccaggtccctccagggcctccctggctctgtgcctctcagcctgtgtcccccggaattgttctgaccttctcaatttggtgggcctggccctgtgttcctccaacagttgtggtctttggtggatcatgacctgggaccacaaggtttggcttaacacagggaaggaggctgtgactggcctgagtctccaggtctcagcttcagttacatagatctcaaccttcctagctgtcttgctattttctggggtctcttccagaccaggagccatttgtagaccagggaggaggatgaggggataggagatcggtgtttgggccgggagcactcattttggcaatttcatcgacagcctccagtggtggcggcaacggtgaagaaccagtcacggagtcccatcaagcgacgctcggggctcttcccccgcctgcacacgggctcagaaggccagggcgacagccgggcacgatggtaactgttgggaaacccctaccccagcctgacttgcggggtctgtcaaccccctccactgctacagctgttcagtgccctaccttgcagggaggagctttgctcagctttaggagatggctctgccttcaggcacctgtgtgtcccctgtcactcactcagctctttatccaaagaggcggacttggccagtctctgcctgggaccttccagagttactcttgccgcattttgacccaggctagaaacattgcttggattcttgtttctttgcctcctttttcaacgctcactcaaatggcctgtcttatgggagccttccctgattctgccaggcagagttagttgcaccttcctctgggcttctaaaaggttctatgcttttttctttttaagcaactcatatattacattacattgaacctgttcttggtaattgtctttctgattcttttaaaaaaatgaacacacagtacttgtgcatatttttggggtacgtgtgatattttgataaaatgcataatgatcaaatcaaggtaagagaaatatccatcacctcaaacattgatcttttgagttaggaacattcaaattcttttctagctattttgagctatgtaatacattattatcaactatagtcactgtattgtactattgaacactagatcttatttcttctatctaactgtatttttgtacccattaaccaacctcccttcatcctgccctcccccgccccttcccagcctctggtgacaccagtcaactttctatctccacgagattcacttttttagctcccacatatgaatgagaacatgcgatatttgtcttttttttttttttttttttttttttgagacagagtctctgttgcccaggctggaatgcagtggcgccatcttggctcactgcaacctctgcctcctgggttcaagcagttctcctgtctcagcctccctgagcagctgggactacaggcgcatgccaccacaccggctaatttttgtaattttggtagagacggggttttgccatgttggccaggctagtctcgaactcctgacctcaagtgatccacccgccttggcctcccaaagtgttgggattacaggcgtgagccaccgcacccggccacggtatttgtcttttcatgtctggctttcacttaacataatgacctccaattctacccatgttgctgcaaatgacaggattacattcttttccatgggtgaataatatccattgtgtatataaaaaagattttccttatccgcttatctgttgatggacactcaggtgggttctgtaccatggctattgtgagtagtgctgcaataaacatgggagtgcagacctcttccatgtactgatttcctttcttttggatatatttaccctgcagggggattgctagatcatatggtagctctagttttagtgttttgaggaacctccaaacactgtagtgtctgtagtggctatgctaatttacattcccaccaacactgtgagcatttccctttctctgcatcctcaccagcattctcaattgcctgtctttttgataaaagccattttaactggggtgagatgatagcttattgtggttcccgtggtgggggcagatgtcacagactccaaattattaaagacaaataataacagatgtcaggatatggagaaatgggaaccctttttcattgctggtgggaatgtaaaatagtgcaactactttggaaaacagtctggcagttccttagaaggttaaacatagagttaccatattaccaagcaattccgctcctcggtatatacccaagagagttgagaacggttgtctgtgaaaaaaagtttacatttacatttctttgataattaatgatgttgaatgttttttgatatacttgtttgctatttgtatgtcttcttttgagaaatttctattcatgtttcttgcccttaaaaaaatcacattatttgtgtttttgctattgatttttttgagttcctcatatattcaggttattaatccttgttggatggatagtttgcaaatatttcctcccattctgcagattggctctttacttggttgattgtttcctttggtgtgcagaagctttttaacttgatgtaatcccatttgtctatttttgcttttgttgtctgtggttttgaggtctcatctaaaaagtttttgcccagacagaccaacgtcctaaagcatttccccaatgttttcttttaggagtttctttgtttcatgccttagatttaatccattttgatttgatttttatgtatggtgagagagaagggtctggttttattcttctgtatatggttatccagttttaccagcaccacttactgaagaatgtatattcttggcacctttgttgaaaatgaaatgatcatgtggtttttgttctgtatggttaatgtgatgtatcacatttgttgatttgtggatgttgaaccatccttgcatccctggaacaaatcccatggtgaattgatcatggtgaatgatctttttgatgcattgttgaattctgtttgataatattttgttgaggatttttgcatctgtgtttatcaggagtactggcctgtaactctctttttgttgtatccttgtatggttttgatgtctttctgattctttaattgatgagcccatttgttctttatttcagcagccagcatttcttgagtggctgccatgtgctgggcacagtgctgaatgctcagacaagtgctacaaaacatataagcctgtcctccagaagttcacagtcttgtaagggaaagggcggcatttggttgacttccaaattcccaggttttctgcctatagccctgggtggtggcaccatgttctgaagtagggcttgcaggacaagaggcagggttatggagaaggatgaaaagctctgtttggaacctgtgcatgggagtttttgtgaaccaacagtagagatgtccagggagtggtcagagttacaggtttttaaaaatttttattttacttttttcttttattattatactttaagttctggaatataagtgcagaatgtgcaggtttgttacataggtatacatgtgccatggtggtttgctgcacccatcaacccgtcatctaggttttaagccctgcatgcattaggtatgtgtcctaatgctttccctccccttacccccaaccccccgacaggccctggtgtgtgatgttcccctccctgtgtccacatattctcattgttcaactcccacttatgagcgagaacatgtggtgtttggttttctgttcctgtgttagtttgctgaggatgatggttttcagcttcatccatgtccctgcaaaggacatgaactcattcttttttatggctgcatagtattccatggtatatgagaggccttgaatagagaaggagagttgggaaccaatagggtagaggtactgattaacgattgcttaattaatatgaccactggagaggctcagtagagtaccacatttaagggcaggtggagaagggaaggtggtgaagctgactgggaaggaaagatgagagaagaggaggaggggatggagtctctgaagccagaggaggagaaattccaggaagggaggacatctgtgtcagacacacagagaagtccagcaaagtgagccaaacccctggacagattgacaggaggttattagcaacctcatcaaatgtgcattgagacacttcacacctctaggatggctttaatcaaaaagacaaatagtaacagatgtcagagaggatatggagaaatggaaacccttgttcattgctggtgggaatgtaaaatagtgcaactactttggaaaagagtctggcagttccttacaaggttaaacatagagttaccatatgaccaagcaattccgctcctaggtgtatacccaagagagttgagaacagtgggccatgaaaaaaaatgagtccactagtacaactagtgtacagatactcatggcagcactatttatcatagcccaaagtggaaacagtccaaatgtccattgtctgatgaatggataaacaaagcgccatctatccataaaatggaatattattgcagtaaaaaggaataaagtcctgatacaagctacaacatagacagaccttgaaaacattatgttaagaagccagacaaaaagaccataacatattatatgattctatttacatgaatgtccagaagagtacaatctacagtgatggcttcgggattgggtgggagttacagggagaggactaggaagtgattacaaatgggtccagtgtttcctttaggggtccaaaagtattctaaaatcagatggtggtgatagttgcacaactctgaataaactaaaagccattgcattgtatactttaaataggtgagttctgtggtgtgtagattctgtctcaagaacactattatttaaaaagtacattgacggccaggtgcggtggctcacgcctgtaatctcagcactctgggagcccgatacaggcagatgacttgaggtcaggagttcgagaccagcttggccaatgcaatgaaaccccatctctactaaaagtacaaaaattagctggccatggtggtatacgcctgtaatcccagctgcttgggaggctgaggcaggagaatcacttgaacctgggaggcggaggttgcagcaatccaagatcgcaccactgcactccagcctgggcaacagagcgagactcagtctcaaaaaaagtgcattgaggacacggccatcccatccccaacagccagcacagggagcactgtgggcactgtccatggtctttgttacactaaaggagaaggatattgttggctgagagtaccccttgcttcccagctcccagggcagcctcctcatgtgggaccaggagctcgtattctagtctatatgaaggatggccccccgggacttcccaggagtccatgtgtattgggtggttcctgcggtgggggcggatgtcatagactctgccatattccctgctccattccccacggggccctctcttgacccacaactccgccaggtgtgatggccagcttgggtgagagagatctgggctagaggccgtcaagccaggactcctgcttggcagctctggacttcaccatgaacctagaatagtccctgttgtagggaccgggaaaccctgtagtatgccgccatctctggggggctcaggtgggaaaggacatccaggcagtgatgccaggcgggggcgctctgaccccactgcccctcaccgtgccgagagaggctctgcctggggccgtggatggggtgggggttgagggctgtctccgcggcctcactcctcatttccattccctcagtgacagcacatccagcacacccaagaccccagatggtggacactcctctcaggagataaagtctgagacctcatccaatcccagctctccggaaatctgccccaacaaggagaagtaagagagtgagggtgggaaaggccagcttcggccacgtggagccctggaacacgccctctgcctcctggccagctgagagtggccatctcctgcctctggaactctccagaacacaaaggccgacgggtgggggcgtggggagccgccagaggtcccggggaggaccctgggggtggagggctctcgcgtgtgacccgggctggcctcacttcctattccctgcaggcccttcatgaagttgaaggaaaacggccgtgccatctcccgctcctcctccagcaccagcagcgtcagcagcactgcaggggagggcgaggccatggaggagggcgacagtggggtaggtgtgccccgtccacccttgggcaggcactctggggcgtcagccagccaccctccttgcattaaaacggcactgtggatcgaagcccatgtcagtctttgcagaggaaaggggaagaatggaaacgagaggtgggctcgttggccatcaccaccccctgggcgcagtgggtgaggggacctctctctcagagtgacatagcagcagcagagggcaggggccagacccgatggtgccctgccttggggttcctggctggagtggtgagtggccagtgccccagggggctgggtcaaaggtccttcttggagcaggatagcttggaaccagggttgaagtcagcaggaaagaaagagcaggcccaagtggggagcaggaggcagcggctgtcctgggcttttgggggctgcctcaggcctgcgtgggcgcagctgccgagggtgggctggcctcgctcaccctgcctctctcctcagggcagccagccgtccacgacctcacccttcaagcaggaggtgtttgtctacagcccgtccccgagcagcgagagccccagcctgggggcagctgccaccccgatcatcatgagccggagtcccacaggtcagtggcatctggtggtgtgtgtgacgtcaccaggagggcaggctgtgccctgtccactgttagcagggccccagccacgctgaactggccagttttcacccctcctcccagctgtgaggccctccgctctgtgcgcccgcctcttctgttcatcagccttaagatgcccaagttcctaagctcttcttacactgagagttgtgaagctgaggcagagagttgaaggccttgtgggagatcccacagcggaggagtcgggattggcagtgggaaagctgagcactttccattagcccttctccccacctgccagtgctccaacccttctccccacctgccagcgctccagggctgccagggcccgtctgtcatgtcgggggtcttgataatacaagacgggggaagggctgcagggggagggaacagcatgtggaaaggcccagaggagaggagagagcgggtattccggaactgcacgtgttcatggcagctgggttcacagagccaggcgtcagagaggccggagcgttgacaggctgggtcagccccgggccccgggtgaggattttgttctgctagcggccactgttggagtgtttgaaggttcttaagtagggaagcaccatctggagttgagaaagtccattttggctgctgcagctgctgagtgtagaatggattagtagagagcaggagcagaggggagggatggaggggaggggagaggaggggaggggagctgcggcagaagcacctcggttcaggagagatcaaggaggtaaaatgtacgggctcagtagcaggggttcagagagagcaggagtctgggcgttttggggttctgtgatccctgcagttggtcagaataggggggccagcacctgagggccgttcaggtagacctgtgcggtgggcactgctgggcgggtgctccgggtctctgccctcgtgagggcagcacaggactttgagcctgggtccaaatcctgggtctgctgcttactagacatgtcattgggcgagtcaccaagcctgtctgtgcctcagtttctccaagcagaaaatgaagggaggggaagagtcgtgtctgcctcagagggttggttgtatgaagatgaaaggagctcatgcttgtacgaggcctggaactgttaacctcggtgttggttaaagaatgggaatgagacaatagtgtagtcagcggttctgagccgggggcagtcttgctaccccatggatgtctggcaatgtctggcgacatttttaattttcacaattttggaggggtgctactggcatctagtgggcagaggtcacggaagctgataagcaatgtacaggacagccccctagccacatcagacaaataattctctgaccccaaatgacattcggttgaaaaactctagtctcaatggtagaaacacaggaagggccaacaggccttcagggtggctgaagccaaaatgttcctggggttcacacagcgaagggatgttgcaaagggaacctgcagggtcagagatgaagggaagatcgtgattccacagccagtgaccctttgcatgcgtgtttctcagtgagtggaagagttcacgtgcctcctctcattcagccccctgtggttgggcagctgcggagctgggttcaaatcctggttgtagcattgacaggtccacgtctctgagcctcagtttcctcatctgtaaaagggggtggaaatacaaattccctgattttttttcgagatggagtctcactctgccacccaggctggagtgcaatggcgcaatctcggctcactgcaacctccgcctcccaggttcaagtgattcacctgcctcagccttccaagtagctgggattacaggcatgtgccacatgcccggctaatttttttatttttagtagagacacagtttcaccatgttggccaggctggtctcgaactcctgacctcgtgatccacccacctcggcctcccaaagtgctgggattacaggcgtgagccaccgcgcctgacctggtgtttttgttttgttttgttttgttttctaaataagacttaaatattgaaggaatgaatgaaagaatctgtaagcaagcctggcccccacttggtgttaaataaacgtcaaagtaaggaaggttttgagtaaaggaattagagagtctctgcaggttgctgaaggtcaccgagggcggaagggacctggagcgggtctggtgacttatggccggtgcttcccacaccacacggtgaggctgcctcttacacaccttttctccacacagtatttaaccccgatgggctgcttttcacccccagcccacgaaagatgtgcttggtacccactggatcagggtgggcttggggggatctgggaaccggtttcatgctgtttggctgagtctggggagaggcagggtggagtggggagaggtggcctgacgtcctgacgtacagtctccataatgtcagatatctgatcatggtcatttcctacctgggcttcctggggcacagaagaggactgataggttacacagaggtgttgtagccctgggtggaactcctcgattcgaagcaccacgaaccagccagcagcttccaggaaggctgcactaagctttccataccctcggccagaggacagccagaaagtcaagtggccctcctgccagcggggcacagcgggaaatgttgacaccgggctctgccaccactcacacacacttaacggaattttattatacgatggatgtcaaacccagtgtacaaatactagataatattctttaccataagtcccatatgtccaactgattctcacagaatgcttttagtggtgtttgcttcacctttttatctgtagccaacttaaggctgcaggagatgaatgtgtgtaattctgacatgaatgtggactgatattaccatgtttgttaataagtattttatatgtatatattatatatacatatatagtatatacatataatatacatatgttatagatacacataatatacatatatgtatatattatatatacatatatattatatgttatatgtatatacatatgtataatatatattatacacacacacacacacacactcactctcatggcgcccggccatgagtattttgtattaagagaacttcattcgtcagtgacatgagtcatttccttgctgtatccgagaaaagttttcaaaccccggaaggatatttcctcagttttcttttgtgctattcacaatgtaatcgctgcagacacagcatgttttgaagtttcatgtaaattcctttttttctattagttccttaagtctagacaacaaaacaatcaatcaagtcatgatttgtagcatgtaccagtttctgtggtgtaaatacacttgtcgtggctgatctcaagctactgacgtgatgtcctcgaacgtggacttgggaagaagatatactgtagccaccatctttagggtgtttctaccacatggatacaatagacgtaagagcacagataatcgtaaaacagagaaaaataagtaggaagtgacgaatttcaagtatttattacctctgttgaatataatttattgaactgtaagcttatatataattcaactttaaaaaatggcctgagttgaacaaccagctcaccacaattctataatctaggagttggctctcgtgggtcggcacaggtcagctagggtgcctggtcctggtggagggcaggaggcccccttcccctggcctccctagccagtccccacacacagccccagtggcctccacagctccaccctcctttcatggccgttctttttcttagatgccaaaagcagaaactccccgagatcgaacctgaaattccgctttgacaagctcagccatgccagctctggtgcggtaaggatgcgcctcccacaccccacactccactttctgcagaggcccagccttccttcctgaggccagaggaagagggttcagacatcccagagggggctccccgaaggaggcaggggaagctctggggacgtctggctccagcaggtgcaggccgtgtctccgggttccagccacctttgccacaactcccaaggtggagctacacctctggacacggccaggcccagatgtgaggtgggaggtgctggttcctgggtcccccagtcccttcctgagctctccagactatcgagagctccaggcccagttgtgaggtgggaagggctggttcctgggtcccccagtcccttcctgagctcaccagactatcgagagctccaggtccagatgtgaggtggaaggtgctggttcctgggtcccccagtcccttcctgagctctccagactatcgagagctccaggtccagatgtgaggtggaaggtgctggttcctgggtcccccagtccctttctgagctcgccagactatggagaactccaggtccagatgtgaggtgggaagggctggttcctgggtcccgaatcccttcctgagctcaccagactatcaagagctccaggtccagatgtgaggtgagaaaggctggttcctgggtcccccagtccctttctgagctcgccagactatcgagaactccaggtccagatgtgaggtgggaagggctggttcctgggtcccgaatcccttcctgagctcaccagactatcgagagctccaggtccagatgtgaggtgggaagggctggttcctgggtcccccagtcccttcctgagctctccagactatcgagagctccaggtccagatgtgatgtgggaagggctggttcctgggtcccgaatcccttcctgagctcaccagactatcgagagctccaggtccagatgtgaggtggaaggtgctggttcctgggtcccccagtcccttcctgagctctccagactatcgagagctccaggcccagttgtgaggtgggaagggctggttcttgggtcccgaatcccttcctgagctcttcagactatcgagagctccaggtccagatgtgaggtgggaagggctggttcctgggtcccgaatcccttcctgagctctccagactatcgagagctccaggtccagatgtgaggtgggaagggctggttcccgggtcccccagtccctttctgagctcgccagactatcgagaactccaggtccagatgtgaggtgggaagtgcttgttcctggggtcctgaatcccttcctgagctcaccagactgttgagagctgagtgcacagagccgccgtggaagggacctgtgctgtctggttatttaaactcctgtatggatttttgttgaaacagggtcactaatgtgaaagtggagtccttcgcctgtccaaggtgggttgagtgaatgtcctgctgtggccgtgaggggggacgtgtgtttcttttagatcagggaactagaggccttgtaacctcagaatggccggagagatgccgccagctggggatgtccaaagagtctcctactcgcccctgaagacctgcaatggggaaggaggggcagatggcctgtgtgcggatgggaagggggttcccagtgacactggactagacgtactagttaggcctcccttccaccgatggggtctggttcccgcaggcagaaggggagtcgcccaagcccgcttctgacccaggagggaggagttcctgagggctcccttgctcccctgccctcaggcagctgttccctccttgtgtctttggcggaggccctgggctgaggtgtgttctccctccctgtcgggagtcagcactgtgagggaccaccccaggaggcctcttcccctgcctgctttgagggggcacgtggtttgagcagagtggccgtgggtccagctcgcccccatcaaggcctggatttctgctggggaagtcaccagagacccatctgagctcccagccctctccccacatggggcttcaggggtcagagtcacagctggagccaagaggaggggtacaaccgaacccactctgtgttcaacctgatttatgaaaaagcagaagacaaatgggcatatggaccttcacccccggctcccatcacgcactctggacgccactgcccaccaaagccgtggctatgcgcagcttctcgggccacgcaaggtggggcacccttacatcaggtgccctcctgctcctgagtgtatccagtgagctgtagccatgggcaggcgtgttccccaccccttgctcccgacgtccgcgtcgtcccctccttcctgtacggaatgttcgctcatcgccgcctcctccttgtctcctcagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggaggggggcatttggctggaagactggaatttaattgccatcgtctttgattttgtgacatttctgcttggaagtgtgaactacccccccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtc

SEQ ID NO: 37878 - DNA, 3561 bp, Homo sapiens
agcagtccccgggcttgcgcggcgcggagagggaggcgccccgcggcggggcccccactcggtcagcccgcgcgtcggtccccgcgcggccgccatgacctggagcgccacggcccggggcgcccaccagcccgacaacaccgccttcactcagcagcgcctccccgcctggcagccgctgctgtcggccagcatcgcgctgccgctcttcttctgcgcgggcctggccttcatcggcctgggcctgggcctctactactcctccaacggcatcaaggagctggagtacgactatacaggcgacccgggcaccggtaactgctcggtgtgcgccgcggctggccagggccgggcgctgccgcccccctgctcgtgcgcctggtacttctcgctgcccgagctcttccagggcccagtgtacctctactacgagctgaccaacttctaccagaacaaccggcgctacggcgtgtcccgcgacgacgcgcagctgagcggactccccagcgcgctgcgccaccctgtcaacgagtgcgccccctaccagcgcagcgcggccggcctgcccatcgcgccctgcggcgccatcgccaacagcctcttcaacgactccttctcgctttggcaccagcgccagcccggcgggccctacgtcgaggtgccgctcgaccgctccggcatcgcctggtggaccgactaccacgtcaagttccgcaacccgccgctggtcaacggcagcctggcgttggccttccagggcacggcgcccccgcccaactggcgccggccagtctacgagctcagccccgaccccaacaacaccggcttcatcaatcaggacttcgtggtgtggatgcgcacggcggcgctgcccacgttccgcaaactgtacgcgcgcatccgccagggcaactactcggccgggctgccgcggggcgcctaccgcgtcaacatcacctacaactacccggtgcgcgcgttcggcggccacaagctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaattttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaacttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatt

SEQ ID NO: 37879 - DNA, 4478 bp, Homo sapiens; identical to SEQ ID NO: 36894

SEQ ID NO: 37880 - DNA, 34720 bp, Homo sapiens; identical to SEQ ID NO: 37157

SEQ ID NO: 37881 - DNA, 147666 bp, Homo sapiens
gacgtcgctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggtaagcggcgacggtggccagtgtttacctgtgaaatggggaaggggccggcgccagcccgtcagagaacatcatctgtacggaaggtgggcctgacccttcgccgtgggctccagggcccgaggagcagcggggatcctacaagtgccctcagagtaggagctgtgctgactcaacagagtcccaccacctccggctgccagtgcctcgcctttcgcagttgccacttgccactcgcccctggcactggtctccctcctgctgtcactcccttctaactcatcgctcccttcttcgtgtccccttacacgctactctgtggcagcgttggcctttccacgttactgctggttcttgtgatcctatggtttgccctaggtctcctttctctggtccctgggctccagggccctccgcctccgagctcggtcagcaccctggggttgttgctcggcccgaccggtttgtttcccaccctctactttgactgcttcatgaagtggacttttttatctcaagctgcacatgtatggctcagttgggtcatccccctcccccacatccatcaccttttcggttaaatcgtggtcatcacaaagttcagtttagcatctgccaccttgatttgcgtgtggcccccttgttactccctatggaatagtttttttctttggacctgaaatggaagtagggcaactatgacgaaccaatcaatttcccttttctagtgcctaatgggcattgcaaaaagccgactttttgaagaagtagagtttgcctttactagcaacactttaaggggaagaactaaatcggtgcaactaggtacttgacccaggttagcccagttatgtgttgtagtatctgcaggtgtaggtgtcactgaacataaaatactgaaccttgtgatttgatgaaatacctttttcgaagcctttcactttaagtactgtgaggatcctgacgtgaggaactgaccggattgggcatttttatgggctgaactgaataggaaacagttttagtgggcaatgggaagtattcctacatgggccaaaaaggaaatacaaacatttgtaggtgagtggcttttattttgtgaaaagtgatggtaaagcacgtacttgcctgaaatttcaggtccttggaacgtgactaactttgaggaactttatactttgctgtttgtacttaatctaagcacagagcctggcatatgataaatacttactggttgattgtaacttctacagtacgtatttttagttgtttgaagttcattttatatttctaaattctacagatttttcattcttggagttaattgagattatggttatagcataagtttgtgttgtgattagcagtaatagattagaaaaaagagttataagtagcagaagtttcatttttaccttaagtgtgatattttagtgggaacagttagccttataataagtgtttagtgttgtctctaatgtgtaatattatatgatatgatcttttccttaaacttagcttatgttaacatgtttcagagttttaatactttcaaatgaactacttgtgtgtctgccagtaaaatgatttggaaagatggagctttctcagcttctgtattttaatgcaattttgcgttttagggaaatattttaaacagtaaatcaatgataatattaagtaaactgtactttagtactttttgtgtgaacactgcacaacttataagtggcagaagcaggattccaaccttggcagttgccacctagcccattctgttaacttttctagattgcctcgccaaagtaagacccagattaaattgtactaaagtcttccctatagttttcagtagtcgtttatagattaggaaactgaagccagagactcttgtccaaggtcaattattaaatattagtgacagtcgaaactggaatctcatctcctaactctcagtagagagctctgaccgttttgctcagctgcctctcaagtagttttcagctctcttgatagattttaaaacatgctattgtacttccttgtctgaatattgtcagtaaactgaaaatgattattacttaaaaaagactttctgctttaccttagctttttttccttttcattttttaaacaaggcttctaagcctcgtaaactagtcctattttgagatattttagatataaaatttcactcaatattggctactacaaaattagtgtgagacttcctttttattgcttctgctagacattgctgacttagatcagcagcttttaggagatgtgatttaattcatgttaggtctcaaaatgtgtagtgatgagctgtgctatgaaagattctcctgtctttatattagtcatgctcagcaagcatttactgtgctcagaaagtggtgaattgtagtatgtgcctggattctttacatctcaacactgaggtaggtgatatccccattaaccaatgataaaacaggttgagaaagttgaaagagcttacttagagttgtataaagaatggaggagacagaaatcatatttaggtcctcttattccacattgtgtgctttttatgactcagtgtggaatgcatcattaattttctttgtagctgataaaatcagcatactatttttatttttttttaaccaaggtgaggatactaagtacatagatacataatgagaatagtaatgataagtgttcatatgaaacttttcagttttgcgttttgtgaaaatatatctttttttttttttttttttttgagacggagtcttgccctgttgcccaggctggagtgcagtggcgcgatcttggctcactgcaacctccgccttccaggttcaaactattctcgtgcttcagcctcccaagcagctgggattacaggcgtgagccactgcaccgggccaaaaatatatctctaattgaaaccttttcagaaatgagaagccacacaagtgatcaattaaggaccattttatattaagctaaaatggaatatcactcagttgagcaaactaatatgtacattgaactttgagcctatgaaatatagattaatgtaaattgaaagtatagctcccatatagttctcgatgtaaactttttggcttcaatttatattattttatcttaaatacaatggaattatttagaaaacttgctagtcatatttatgtatgtattttttttttttttgcattttacatacagggatgagctgtatgtaacgtctagctagtttttttttttttattttattttattttttttaatgttagtttttttccccttctgttgtccttgctcctgttaggacttcctgcttctaatgtgactcctgctatacttggcaaaaaatttgtcatagtgtacatgaaagttacttgtttaatattcactcctcactctccctctatcccttctttttttttctttttttttttcttttcccctaacagtaaacttcatatatcgaaattagagcatgggatgtttgtttacctgagaatttgttttaattaatccgagttttcacaacattagaagataatgaaatatttatcagtgaatttttatcaaacacacttttaaacttttcttgataccaggagcaattaggattataattctgagcatttattattacagaaaactaaaggtaagaaatgtgggaaaatgtgctgaatacattccagtgttgtggcatactttggaggttgtttttgcatggaaaccagttatcaacgtgttgtcacttgtcctgtgttttaaaaaataataaacagtgtagctatttaaagctattagttgtttgagttgtctgtaaatatgaatcattaagtgactattaaataaaaatagtttctatttgtgttgttacttccatccagatttgttgctttttcaatattaacactgattctcagagttaacagatctgatataaatgggaaaaggcaaaaaatgcagcactttgagaagttccaggttaatagttgttaagtaaaaggttttgtagttgaaataaatttggaggatatttgcctaaagaaagttaataggtttcttctctggatgacttaacatagttagtttttgataggtgatttattttcaaagaagatgatagaatttacagcatattgcagagtcatttaaccatggaggtgaatacactttcttgtatttcacttagggaaatcctggagtgatgagttacgtatcaagaaaggctccctgaacatccaggggtccttttgaacacacacatgcacatacatcatacatccacgctcacacacagttgtcttgcccataagtgcttagtaaaatattatgacttggttttgttgattaatatatttgtaatagaaatactcttggggcacattaatctttaagctatataagctatttcttcaattattaatgacactgcaagagctactaaccaaagcaagaagaccataggtccactggcattcagaggtgtcaagaggtaggaaagggattttataacgggagtggaaggacatcagtatctaaaatgagtttggcttgccactctacacacagccttacttggcatcttttgacaaaccaagaggaatattgataaacattcttaaagaattttttctttttaaatattattttaattgacagtcatttttatgcatttatggggtacagggtgatattttgaaatgtgtgtacaatgtggaatgattaagtgcagctgaataacatatcaccttgattattttctatggtgagacaattgaaatttagttatttaaaaaataaaatacatgattgttgacagttgtttaattgatctaaaaatttcttccttctatctatctgaaactttgtactctgagcagtatatccccattgctccctcttctccaggctctggtatctgtcattctgctgtctacttctgtgagtttgacttcttaaatttcacatataagtgagatcgtgtggtatttgtcttcccatgcttggcttttttcagttagcatgatgttctccatgttcgttcatgttgtagcaagtgacagaatttccttctcttttaagcccaattagtattccattgtatctaccaccttttcttcatctgtttatccattgatggacacttaggttgattctttgtcttggattttgtgactaatgctgctgtgaacctgggagtgcagatatcctttcaacatattgagttccgttttttggaaatatacccaggagtgagattgtatggtagttttatttttaggtttttgaggaacttacataccatttttcataatgtttgtattaatttgcatttctacctacagtgtacaagaattcccttttcttcacattcatggcatcacttactctcatttttttgattatagccattctaacaggtgtgaggtgatatctcattgtggttttaatttgcattttcctaatggttagtgatgctgagcagtttttcatgtatttgttggccagatttatgtcttcctttgagacatgtctattcaagccctttgcccattttaaaaatggttattttcttgaaattgtgttgagttccttttatatttagtctgttaaccacttatcacatgtatggtttacactttctcccaagttgtggagtggaaaagtgtatcccagctctggtagatatacctctttctgtttttgttatctctgggcccccagcagattgggtggtgcctgcccacatggaaggcagacctccaggtagtctactcagactcacatgctaatctcagtctcctctggaaacatcctcacagacacatccaaaggaatgctttaccaggtttttaggtattccttaatatagtcaagttgacatctaaaattatccaccacaatgactttacagctttccctgaatgaggttctcagattatggctttttaaactgtgctttgaaattttgtggtttcatagaccatgaagtgcctcctcaattgattgtaatctggaattgactttctatttcagagtcaggtttaattttggtgtcacaaagccttaaatatgtgtaaggagaggaaacgttgaagcaagcagatagctcttaaactgtttaacgttttaaaagtatttggaattaaatgaataaataggctggagtgatagtgataaatactgtgtctatcaacaaattatacatatggcaacacacaaacctgtatgttaagcactataagggatgagtctcaactttatcacttatttatgatgggattttggggaactagtttgaactttctaagcttttaatttccttctgtgtaaaattggggtaatagcacctttcttgctgttcttacattgttatgaagatcatataagatgatggagggtataactttgtaaattgccagtcattatagaaatagtggtagtacatcgggtttttttttttttctgtatattccttgtactaatgaatgtaaatcctaggctccatgtagttttattgctcactattttcttggtggataggtgggtgggtcctgaggggaaattaggaggggagtctcctggctagtggtgcagttacaggggagacagggaatagactaaaagaagtgaaagagaaaaaaggggatagtttcttgtgtggttggtaaaccgatttcaatgaatgccttaaagcaagttctctcttttttttttttttctgagacagagtctcgctctgttgcccaggctggagtgcagtggcgcgatctcagctcactgcaagctctgtctcacgggttcaagcgattcttttgcctcagcctcctgactagctgggactacaggcgcgtgccagcacgcctggctaattttttgtgtttttagtagagacggggtttcaccaggttagccacgatggtctccatctcctgacgtcatgttccgcccgcctcggcctcccaaagtgctgggattacaggcatgagccactgggcccggccgccttaaagcaaagttctaaaaaatgttttgaaaaagatgatttatttgagggttaccagtcatttgtctgtacatattcccaaacatttgtgggaagaaaaatcttttatttttaatcagacttggtaaatccttgaaaagctgttattaaggataatgtttataaggcttttgttataactcgtgctggagattgatttttatggattgatttcttcaccaaacaagagtatgcctactttgtactaggcacatgctgataagttctagtgttgaagtggtgagtcagttgggaaacctgtcctcagaaatcactatcagcgctaaatttagcattgtaccacttaggccatcaaagtgggagccttgaggtcttttgtcagaataaaatgataccactaaagggtgaaaagttaagaggggaaaagattggagaatataattaaaagataactgtgacttgggttagctttacaactcctggtaaatctactagtttggatgagacagcagctctgaaatggatttcttgcaattgaagagtcaacctggtgaaagtagtacttgatcctgctgttcccacctccatgtgttatgtatatatttatttgcttgttacatgtttttccctaatagagtaaactcctgaggatgggcctcataggtgtactcccagagcctagaatagagcttgatacttagtaggcctcactaaatatctgttgaatgaatgaatgttgaatatttcctcaagaaaaattaagattaaagtgaaaaattacggagatgaaattgtcagtgataaatttaaaccatcatattaattacccttaaaggattggttactatctgttcattagacattttatatagtaagtacattgtggttaaatattgtgtttaagagcaatgggacaaaaaaaagttgaacctgaggcttttagttaggaatgaaattctgtcttaatttttcctacagggaaaaatctgattaggttgttactttgatataaccaattataaatgcaagagggacttggattttgttttgtatctcttactacttgatattatgatttcattaatattacttaaagtttaattcctaaactagatacatttaaagaaagctttgtctgtaatagtacaataatgctgattttcatggcactttgttgactgtttcaatttgtatgacctttgatgctatcttgaaagtttgtaagtatcagtaaaaatttggccgtggtttcaaagttggaaattttgggggtccatttttaaggagggcagctgctaccacagtctcttaactaaaatgcgtctctgttcaatgttggagacagagtactgttatgtcgtttgcccatctgtaattccactgtatattcagaaataatatataccagaaaagttcaataagatgattctgctctgttccactgttcaagtagaataatggtctgtaaatatacttatgagaggatcatgtatattaactggaataattcaccattgtttacttattgcactgttttctctgatttcctaagggatctttttattctgatgcatctgtgaagaccctaaggtgaatccagctttgctcttgaccttagctgtgcattgttggagaatccttggttcttattccatttaaacctgaattggtattatacctgaaatttgggggctatttttagcctgactggcttagcataggaaagagttgtgattctttgttttgtgatttcttttattttcgagctagagttgtggagaatggcctttggattcattgtcctgtgaagtttggaaattataaaactgaagttgtacaattttagtggaagagttaaatgtgaaataaaatttcaccgtatttctgttattacataaatattaggaaataatgttctgactttaagatgtgatattgtgttatccagtgtttctccaagctgtaatattgtattttgcaatttgttctcttccagagtttgagatagcttgttttctcagaatttttctcagctgagaaacacaactggtgtttaattcagactgcaactattaatataatcagctattttacatgtggtattaattactaacatctgatctttttcttgtatggtacccaactgctcaacacttaaagtattgcaatagtgttaatcctggtgggagtcaggagagtaaaataaatgggctacaatgacagtctccagcctttttggcaccaagggaccggttttgtggaagacagtttttccacggacggctgttggggggaatggtttcgggatgaaactgttccaccttagatcatcaggcatgagagtctcataaggaatatgcaacctagatccttgcatgtgcacttcacaataggggtagtgctcctatgagaatctaatgtcccagctgatctgacaggaggctgagctcaggtggaaaagcccactccccgccactaacccctgctgctcacctccttctgtgcggcctgattcctaatgggccatggacctgtaatgctctgtggcccaggggttgaagggcagaacaccacaaagttacaggaaaagaaactgaaataatatactttccaaatagtgagtattggttgcataaaggtttagaaaaaccaagtagacttgagagtattttatgatgcattaaaaatgtattttatgaatctgaaattccagaaattaataacagcagctcagaatattcaatcatataataggcactaacacaaaatttatgtgatgatgaaagattatctttatactaggattcagtgttaatcatcttttttatatatgtatatatatctcctctagtcccaaaccaaatattcctaatttctgaataaaaatgtatacttttggttaagagtgatggctggtgtcagattatttggatttgaatctaagttttctcgattccgagcattttgaccttggaaaggttgctaacgtttcagagcctcagttttcttatatgtgtgacttataaatgaatggtactgacctcatagggttgttgcaagtattaagtgaagtaacacatgtactgtgcagtgtttcctacagtaacaataaatctttattcttatttctttattcttattctttattctttattcttattcttattctttattctttttcttattctttattcttatttcctctgatgtaaatagcaagtggtttattttcaaaacttagaatttaatatgtttgaagttgttttagtgttctttgattgaggtagttttaaaatgtcaagagtaatcctgtatgacccagatgatctaattctttccttacttgctatctcagtttttactaacttctcaatttacgtattgcatttccaaagtgaatactaagagtgagatttagactgaatttcgggaggaaatacaaagggatgacacctgtgtaatatgaattgatcataaccacaatttttggctaaccagtatgtttcttttggacactaaaacttttactgtagatgaaatgaaaaggaaagattgtagtacacttgcatattatgcttttgaaatgctattattgtagttttctgacatgagaagtactatggttcttgtcagtttgataaagttttatgtaaagtggctctcatttatataagctcttctgttgaattgtcttagagcataaaggtgaggagtgttaaaaatctttttttttaaaaatatgtagttgacttgagtggtgttaatagtattgtgcagtaggtaaagagacttagggctaaggtattacaaataaaatttgtgctgatataaatttaaattgtagatattaagcatatacataatttcagtccctttatatgcagcagttgcttatcttttcacataataatagaataaactattatactcaaggagtggggtcttctgcctgttacagtaacattttacttagttggagattatgccattaaggtcctttatgggtgaatctatatctctctctattcctttatatagttacactctatgctttccatcttttctttcttgtcactgatgctttgtgtatttgttgatttgttttttctcctttctgtattcattattcttctctgtgtctacaggcctgcaagtttctctctcagggtatattccctagcctttaatctttctaccccttctcaaatagattaaaaaagccaaaatagaaaatttaacttctattttttgttatactttataggtttgaaaaatgctttttattgttaatttaaaagggtaacaaatagaatggtttatatacttttttcatgagcagtagagcccagtataattttctcatataccccttatctgaatttatcttgattgaaaagacatcatcttggacttaaatgaacactattaatcttactttttattgtgagttaaaagaatcttgtagtattttcagggtcagagtcattgttctgatattgagttgttgctaactttagaacataccctgaaagttatcttaacacctacaaaatctacatcagattcctaaaaagcatcaaggattttaagatgttagtggcgggttagtttgttctgtttttttctcataattgaattttttgaatctaagttaatcagttgtgtttgattatttagatattatgtgcagaattttgcccatcctcccttttaaaaaaccttgagagtcagtgtaaagtaatggttcaagaacatgcttgggttttaagccaaagctcagttcatgctccagttttatcacttagctgttatttcttaaatctgtagaatagttagtataacttatgtcatagaattgtgagaactagatatagttaaagtggttagcaaatcctagccaactgtaagcacttaatatatatatttttttagagatggggtcttgctatattgcccaggctggaatcaaactcctgggcccaagcaaccttcctgcctcagtctgagtagctggggctacatccacgtgctgctgtgcctggccaagtaagcacttaataaatgatagctcctattgttgttttagagggtgctccttttcataagaaagaaatgaagtgttaataccatgcattgaggatctagctttctctgctgtggtaggattgtgttgctttgatttccccttggagtctgtattatggagaaaagcagaagtcaaaacttgtaaatattaggacttttattgtattgtagtcctgtatgaatgagagatggatggggggacatttgtgaatatggcctgttttatcttgcttttgtaccagggaactgctgtgataaaagttttgtgtactttatttagtagaggaacactttgtgagtggaaatcttctgatatataaactaaatttgttctaactcagttaaaggaattgaaggtgaatttccatgtaactgagcttatttttagtatgaggtaatgatagaaatggtcttgatgcttgaggattttaagtactatcatgtggcccaaacagagtgcttaggaggtagacagaaggttagaaatgccaagtgtagtgttgtattatgtcaaaataataaattttattttggtttagtgtcataaggacaggcaatctaaagagaacagagtatttatggaataggaaaattattgagaaacctggacagtcaagaatattttaatttctggctgagtgctgtggctcatgcctgtaatcccagtacttcaggaggctgaggtgaaaggattgcttgagcccatgagttctagaccagcctgggcagtgtagggagaccttgtctctgcaaaaaattaaaaaattagccaggcatggtggtgtgtgcctgtagtcctagctactcaggaggctgaggcgggaggattgctggagtccaggtgttggaggctgcagtgagctatgatcgcatcactgcactctagcctgggcaacagagtgagacactgtttctaatatatatatatacatatatatatatacacacatgcacacatatatattatatatacacatatatattatatgtacacgcataatatataaacatatatgtaatgtatatatatgtcaaaaatgtcaagagcatagtttatattttttaatcttgtttagcttattaaaacaaaaaatttgacataagtttttatctttgcttattacataggtgaaaaattacattcttgctttaaaattttggatttctttgattgctggtaaggtagataatcttttcatatgcttattagccatttatatttcctgttttgaattgctgttcataccctgtttttctttggagtagtagtctattcctttttcttttatgagacagggtctcactttgtcgtccaggctagagtgcagtagcacgaacacggctcactgcagccttgacctcctaggctcaagtgatcctcctgcctcagccccccaagtagctgggactacaggcacgtgccaccatgcccagctgatttttgtatttttgtagaaatggggtttcaccatgttgcttaggctgatctcaaactcccgagctcaaagtaatccatccacctcagcctcccaaagtgatggatttacaggtgtgagccactgtgcctggtctggagtagtagtctgtttcttaatgatttataaacatctgtttactcatggattataatattttgttgcatatggtgcatgtatttttacaagtatatgtatactttctgattttgttttgttattaggaaaaaattaattttatgttttcaaatatgttgatctttttctatagattttgcctttctaaaaatgacctttcccagccctagatagtacaacaatttacctttttttaagccagaatttccaagcagttttctacatattgttagtatatttgtgatgtgttttgtaggggaaaaatattcctaatttaaattaattttttatatagcacactttcaaacatacagaaaccctgaaaaaaaatactgtcactagcacccgttatacagttacctagatttgttaaaactgtcatatttgctttctctctactttcttcgtatttatcttctgttaccttagctctatggatgtgccccaactttctctgttatttttgttgttattatagctcaactattttaaggtaaattgctgatattatgtcactttttaaaatgctctcctgaatctcccaggctaaagaatttaaaaaatacctataaccacaacattattgttacacctagtaaaattatcggcaattcccaattataatctaatacttggtatgtgcaaattttcccagttagaaccaggttctaattcagtaatgtgattgttatgtttctttaatatagaatacctttattcctcctccactttctcctctttttctccttttcttttcctctttctcctcctcttttttccccttcttcgtcctcttcattgttgtgagagattgtcctgtgcattgtaggatgcttagcaacatccctggcctggtctatgatagtgccttccctaacaaggtgtgataatccatactttctccatacattgccaagtgtctcatggggagcaaaattgcccttggctgagaaccactgcactagagatagtaccttattttttaaattacttattttttagaattgcttttattttgttttatcttgaatctgttttgttcccttgatctgtatgtctgtcctttagcctattctgcttatgtattttacttctctgggttgtttagttgtaatttgaaaagtagctttattgagatataattcatataccatgcaattcacctaactaaagcattcaattcaacggcttttgctatattcacagagttgggcatctgtcatcaaaataagttgaagtacctcattactccaaactgaagacccctcctccttttactccacacttctttctccttcacacagcaggctatcactaatctgtctttatggttttgcctattttttttgagacggagtctcactttttcactcaggctgtagtgcagtggcatgatatcggctcactgaaacctctgcctcccaggttcaagtgattctcctgcctcagcctcctgagtagagtagcaggaattccaggcacgtgccaccatgcccagctaatttttgtatttttagtagaaatggggtttcaaccatgttggccaggctggtcttgaactgctgaactcaagtgatctgcccgccttggcctcctaaagtgctgggattacaggggtgagccactgtgccaggccggttttgcctgttttgaacatgttatatgagtggcgttgtacaatatgtgggcctttgtgactggcttatttcacttagcttgttttcaagattcatccatgttgtatcatgtaatgggacttcaaatttatttttattgccaagtaacattccattgtatggatatactacattttgcttatcctttcatcagttgctggacatatgggttatttctgctttttggtcattacaaataatgctgctgtgaacatttgtattgtgtttccacagtgttttttgtggaaatatgttttcatttcttttgagtctatacctaggaatggaattgctgggttatacagtaattctttaaccttttgagaaactgcaaactatttttcaaagtggctgcactattttacatttctaccaggagtgtaggaaggttttgttttctccatatcctccagaacacttgattacagtcatcctggtgagcgcaagtagcatctcttagtggtttttgtttgcatctctctagtgcctctagagagcaccttttcatgtgtatatcttcatatttcatttgtatatcttctttggagaaatgtctattcaagtcttgtgcccatttttaaattgggttattcatgtttcttactcagttttaataattctttgtatatttcgagtagaagtctattaatcagatacatgatttgcaaatattttctcccatttatgggacagcttttcattttcttgatggtgtcatttaagcacaggattttctaattttgatgtagtctgatttatgtttaccttgttgcttttggtgtcaaaagataattatttaaattctgtaatgcattaaaaagttagcttcattagtggtgtcaaatagcatatatacaagataaatagataaaagaagagctgaagttaaaccattatagttttccccaaattgagttttgaataaatgtatttttgatgaattctatcatatctagatggtgtatatatttatagaatattttattgaggatttgagggcagtgggggcttgggtttactttgtagcagtgtcgaataattaacaacaaccagtgtactttgtagtggaaactaagaccccagtaactttaaattctgcagtgtcctcttccactgccctattgtgagtattcttcctgattagccacaactccgagaagaagaggactcccaaaagtagaaactagtatttgtttctctgttctccctgcatatgtgatctgttttcttctccttgcttcatgatctcctggattattggggtgctttctgttattttttctctcagcacattctctctgggttttggctttggagatccctactgggctgacccgttcttttagcaacactccaggtctaagaattatagctcaaatcatggtattcttgaggatcgtctgtttttggtccagctgcctcttaacagagtcacttggcagcagtctgtttgccctcattgctaccaccttcctaatgttacaccttttctcattgaggggttttaaaagttttatttgccatttaaatagttaaaccttgacagtatataaatacatattcattttctttttaaaactttctatatacaagtctgttttaaagatcctgtgtatagtaagttatttttcctgattattaccacaatttggaccaactttcttgttttgctttctcaaacaggatatttcatgttttttcacgtggtggagtacaagttttgggacagccttatgacttttgcatggtagaaataaatgttaggagtaatgccttcacttaaatattttaaatgagtgttaactgaatgtaaatgagttaaccatgtggtgtgttctttgtagaaaagtggtatgtgctatctaaaaataaaatattatttgcaatgcatttttttgtttataatactacctgctacttgaaaagtaaaccagtgtgaaagtgtattaagtaaagttaaaatattgtttaccgttttcattttaaaaacagtctgcatgtctactttcatacctttttctgagtaagcacatatgatttttcattacattttaaaaaattactcttaaaggtagtgttgtgaattatgtttttctgccttgataattttctctttatctttttttcccagtagtttttgtttattgctacacttcgtactctaaatcttctccctttctttctgctctgaagatagtagttgcccagtgaattgactggatacagaaaccagggtcaagctgaacataaatgttatgatgccaattaatgatcagaaaggaaaataaacttgtgaagatgttcactgaagaaaaaaatctcgatttagaaaacattggtttagatgattaatcagaagttctactctatttttgttttacttagttaacacatacttactgggagcctactttgtgtggcagatgttgttatacttggcatgagacaacactgaacaaaacatacacagtttatgccctcaggagacttacagtatgtggtatatacatgagggcagtgggggcttgggtttacatgtagcagtgctgaataattaacaactgctgtgctttgtagtggaaactaagaccccactagctttaaattctgcagtgtcctcttccactgccctgttgtgagtattctccctggctagccgcaactagaacaggactcctccaaaagtggaaatgagtatttgtaaccctgtgctcactgcctgtgtgacctgtttactccattagtaggcaggcagttccaacataatgtgataaatgaggatatttgctagagaatggttggaatggtgaaccatggagtccaatctagataggaaagtgagtacagaagtgggttatgtaaatgagggtgtgtggtcttgtagtgtctaaagtgaagttgtagtgaatgttggtggaggtgaaatgcttatgatattaaaagtagcatatttgatggattatccacatgtatgttaaaataactgaaggttattcagcattcctgatagagaagaatgtttatggattagtagtgcatacatcggtggttctcaaaagtaactgcatattgcaatcatctggggaacttcacaaactaacaatgctcttatatcagctttcctgaacattggaaattctgatgcatggctcacatacctagctattttgatttaatttgtatgtggcgtaagctgggtagtgggattttaaaatccccctacttccccaggtaatgctaatgggcaggaattatacaggaacaacaggggcttttacaggaaatgggctgggagttatggttttgatcgtgaccctacattctgaagttgggtacatgattaatgaaagaataagcagcctttgtttgagagagctgcaggagaagcagcttttacttgaagcaaaaatagtgaagttgtcggggatatggaagtgtttgttttgactttggaacagagtgatcctagagggaaagtttaggagggatggaatcactgggaaattgtataagggaggaaaaagcaagaacagtacagtggtcagagtgtaggagagaatcgataactgaatgtatttatctctctatgatgaacaaggataacaaggcttagtgggttcattattagtctagagaacacatccagcagtcctgtagtgcccaataattgggaattgggtaaacagttcttaggagtcagtccagaccttgatagactgaatttcataggaagtcctatccttgtatcctctggtaaggggtttggattgattgtgcaagatctaaggagagccctagagtttggggctgttgtcccacaggctcctgatagtggttggagtcttttctaacactggcgggggaggctgtgaagtcttaaggtttggtcagatttgttcttctcactccagtgcgctgcttggctgagtacacgctgctgcaccaaatgatggcaaagcctttactatttctttacttttatacttcatacttttcaggaacactttaaattgtccagttctagatttgtgagcaactatttataggtttcactttttcaacatacaagaaatgatatagacttagagtgaaaaagggccttatatattatctaggcaaactcttcttatttatgcattagaatttttatgcatagagaatcaaagtgaaattcacaaagaaccctcttacttagattaaagtataaacggtatatggggctggaaatttataattgctgcactgattcaaagtttttgtaagaataaatgggttaactgcaactcattttattaatttgacacgtaacttgatttctgtattttttcactgttaaactttgaaatataagagcatcagacatcaccgcccacagagtgcttcaaatttatttttcttttacaattaaagaaagcttttaaaagtacagtgtatgtgtaggctttaagagctactctagttatgcaagagaactatgaaattgcttttgaatgaagagttcattcaaaccttctcaaaaatattcaaatatatttttggtcagaataaggtaagtagtaaaatggtaaatttggtaacagtttgttttagaaataagaaaattgctaagtgaaaacaagactttcacataattatagtatatcatgttaactagtaattaaaacccatgtgcttttactaagcgaaatagatatcatgattaaagcttttatacttttaaacattagtctattttgcgtatagcgatcttatttcacctgtgtttgaattgtgaaacgcaaggtaactttttgaggctatgacaccagatagatgaagcctgttttaagtcatggggatttaggccacatcaaaaggatacttttttttctttttaaaattttattctttactcattcattaatttaattaatttatttagagatgggggtcttacactgttgcctaggctggttttgaactcctggcctcaaatgatcctactgccttggcctcccaaagtcctgggattacaggtgtgagctaccctgtccagcccaaaagtaaacttttagtagctgagtgacatacatttttataatgtatcttttgtattcatgttttagatgttttagatgtgcaagataaaaactgaagagcaattacgttaaatgatgcttgtttcgctttcctcctcctgagttgctttcattgacttatctgatgtttaggtggatatgaatagtatcaatttttctaaaactcgggtatttgttatagaactctgcacattagatcaattgtctgtcatctaggggtacatttctaagttgtgttttatagatacagtttcagactatttgtaggaatgctattaagatttttctttggctatggtaggtgacatcatttggctgagaatttctaaccaaaattatttctactgaactgtatggtatgaaattctggtaactcaggacaacattagttatgttggaatatattcgaagctgctttctgaggaaaattttggcttttatttgactttgctatagtatgtcaccttataatagggtggtgagaacactaagtaggttatttagtatttatggcttttctgatttttaggtgtatatggaccaactatttttgtttttcaaattattttaagttcaggggataaatgtgcaggtttgttacatgggtattttgtgcattgctgaggtttggacttctattgactccatcagccaaatagtgaacacagcactaaataagtagtttttcaacccttggctccctccattcttcccctcttttgcagtggccagtgtcttttggtcccgtctttgtgtccgtgtgtacccaatgtttagctcctacttttaagtgagaacatggtagttagttttctgtttttgtgttaattttgcttaggacaatggcctccacctgcatccatgttgctgcaaaggacatgatttcattctcttttgtggctgcgtagtatatgtaccacattttctttatccagtccaccattgatgggcatctaggttaattccatgcctttgctattgtgaatagtactgtgataaacatatgagtgcagattaccttttggtagaaagattcattttcttttgggtaaatacccagtaatgggattgtggggtccagtggtaattacatttttagttctttaagaaatatctaaactgctttctacaggggctgaactaatatacttccaacagtgtattaacatttcctttttctccataacctcacaaacatctgttattttttgactttttaataatagtcattttgactgatgtgagatgatacctcatttgcttttctctaatgattagtcataagcattttaaaaaatatgttggctgcttgtatgtcttttgagaagtggctgttcatatcctttgcccatttttaaatttttttttttttcttgttgattcatcttaagtttcttacggattctggatattattcctttgtcagatttatagtttgcgaatgttttctcccattctgtaggttgtctgtttactctgttgatagtttcttttgctgtgcagaaggtctttagtttaattatgtctcagttgtcaatttttggtattgttgcatttgcttttgaggacttataaattctttggctaagccaatgttcagaagcgtatttcctaggttttgttctagggtttttacagttttaggtctttaattcattttgagttagtttttatacatggtgagaggtagtccagtttcttttgtatgaggttaaccagttttcccagcactgtttattgactaggaggtcctttccccattgtttatttttgtcgatgttgtcgaaggtcagttggttgtaggtgtgtggctttatttctgggttctctattctggtctgtgtgtctgttttcataccagtaccatggtgttttgattgttgtagccttgtatagttttaagtcaggtaatgtggtatagttttaagtcaggtaatgtgatacctattttcttttgcttgggattgctttggctattcaggctcttttgtagttcatatgaattttagaatagtttcttctaactctgtgaaaaatgatgttgacactttgataggaattgcattgaatctgtagattgctttgggcactatggccgttttaacagtattgattcttctattccatgaccatggatttttttttttcctgtttgtgtcttctctgacatatttctgctgtgttttatagttctgtttgtagaggtcgttcacttccttgattagctgtattcctaggtatttttttctttttattgctgttgcaaatgggattgtgttcttgatttggtttttggcttgaatgttattggtctatagaaataatattgatttttgtatcctgaaactttactgaagttgtatatcgggtctaggagtcttttggcagaatctttagagttttctaggtatagaatcatatggtcagcaaagggaaattatttgacttcttctttttctatttggatgcgttttctttcttttccttgccggattgctctaagacttctggtactatgttaaataggagtggcaagagtggacatccttgttttgctccagttcttaggggaatgcttccagcttttgcccatttatgatgatgttggctgtgggtgtgtcatagatggctcttactattttgaggtatgatcctttgatgcctagtttgtgaagggttttatcttgaagagatgttggattttactgaatgctttttctgaatatattgaggtgatcatatatggtttttgtttttaatgctgtttatatggtgaatcacatttattgatttgcatatgttgaaccatccttgcatgccaagaataaagcccacttgatggaggtgaattttctttttcatatgttgttgggttcagtttgctagtattttgttgaggatttttgcatctgtgttcataagggatattggcctatagttttccttttttgctgtgtctttgccagaaattggtatcaggatgattctggttttgtagaatgagttagggaggaatccctcctcctagtttttttgagaatagtttcagtaggattgttactaactcttctttgtatatctggtagaatttggctgtgaatccatctggtccagggtttttttttttggttgatacgttcttcttttgttactgattcaattttggaacttgttatcgatctgttcagggtttccattttttcctagttcaattttgggagtttgtgagtttccaggaatatttccatttcctctagattttcttgtttgtgtacatacagatgtttatagtagtctgaggatcttttgtgtttctcttgggttgcttgtaatgtcacctttctcatggctgattgtggttatttgtgaatcttctttttctttgcttagctagctaatgatccgtcagtcttatttatcctttcaaataaccaacttttgattttgttgatcctttgtatgttttttggctttcaatttcattgagttttgctgtgattttagttatttgctttcttcttctagtttatgagtttattcttctgctcgtttttggagtttgtttttgtttttctagtttttttaggtgcgaggtgaggttgttaattggacgtctatctccttggtgtagacgtttagtgctgtctagtcctcttaacactgtgtttgtcgcaacccagaggttttggcctgttttcattttttaacaaatgattttgttttctgtcataattttcttgtttacccaaaagtcattcaggagcaggatgtttagtttccatgtatttttttgtggttttgagagtcatcttggtattaatttctatttttagtccactgtagtctgagaagatacttggtatgatttcagttgttttgaatttgttgaaacttgctttgtgacagagcaatgtggacagtcttagagtatgttctgtgtgcagatgagaagaatgtgtactctgcagtcattgggttaagtgtcctgtagatgtctcttaggtccaattggtcaagtgtcaaattaacttaaggattttttggttagttttctgccttgttgatctatcttatgttgtcagttggatgttgaagtccctattattgtgtgactgtctaactcttgttttaggtgtggtagttgtaggttagctgaaagaaaggacgagagagagagacagacagacagacagacagagacacacctccaaggtcaggtgagtaagttccttcacctgttgggctgctccaccacagtcagaggaggcagccctgatcttaaaaagtgtggtgtttatatgggggagagagaccctggggttgtttgtcggttgactttaccgcatatcattgacgggcttacaatataggaatttacaagagggtgtaacttaggtttatccacatttcttgtgacctccccagtgccgcccagggggctgtaatcagggttttgctcagcaagtctggtgaccttgctgtggcgcctaggtaagggttcaggaatgcagctgcagagtattcagggtaagggtcagctgcatagaggggcgggggtcctggggcagcttgtccctaacagtagtaattttataaatctgggtgctccaatgttgggtgtgtgtatattgaggacagttacatcttcctgttgatgaacctttatcataatataatgctcttctttgtccttttttagtgtttttggtttaaagtttgttttatttgatacaagaatagcaatccctctatcttttttgttttccatttgtgtgatagatccttcttcaaccatttattttgagcctatgggtgtcattacatgtgagatgagtctcttaaaggtagtaaaagaatgggtctttgtttgcccaattgccattctgtgtcttttaagtggagtgtttattccatttacattcaagggtaatactgatatgtgaggttttgttcctgccatagtgttgttagctagttggctttataatcttgattgttagttgttttatggggtctggagaccatgtgcttacgtgtgcttttgtgacagcaagtattgttattttgttttcatgtttagaacccccttaagcttctcttgtagggccagtctcatggtggcaaatttctttagtgactgtctgggaaggactttatttcttgttcacttatgaagcttagtttggtgggatatgacatttttggctggcatttcttttctttaagaatgcttaaaatgggccccctgtctcttctggcttgtaaaatttctgctgagaagtccgctgttagtttgatgggtttgcctttataggtaatatggctcttttctctagctgccttgaagattttttctattttggatggtctgattactatgtgtcttgcagattgtcatcttgtacagtatcttgcaggatttctctggaatttttttgtatctgtatgttgatctctatagacagattggtgaaattttcccgaattatttcctcaaatgtgttttccaagttgcttactttcatctttttcaagaatgccaataaggcataggtttgattgcattacataatcctgtatttctcgaagtctttttttttttctcccatttccttaaattcttttttcttttgtctgactgggtggatttgcaggatcggcctttgaactttgaaactctcttctgcttggtctagtctattcctaaggcttccaactgtattttgaaatttttcaattccagacgttctgtttggttctttcttaatacagctatgtcatcttttgaattggattgtttttctggcttctttgtgttggatttcatctttctcttggacctcattgagtttctttgctccatatatattctgaattttatactgtcatttcagatatttcattctggttaggatccattgctagggagctagtgtgatcctttggatgtgacaaaacactggcttttgtattgtcggagttcttgtgctggttccttctcatctgagggagccgatgctgcttcttttttttttttttttttttttgtttttgttaatttgctattgtttggctcgggctttttgatttttaatttctgttttcccttgagggtatgactgacgtatgttgcttgtgatcagttggctttgtttctgggtgctttcagagggccaaggctctgtatgggttccttggttgcagataaattcatatggtggttttgtcagatattgtttattgtagcaacatatttttgtttggtgttatgatttaggctgcagtccagtaggtggcacttaagattaagaattggcaggtgggctcttaactctgcacatgcttaccctcagcagaggtggaggcggtggagaagcctgaaaagtgctccacctttggtgagggtgtgctcacctttggtgagggtgaagcttctggagaagtctaagaaatggcccctttcagaccccgttccctggaccccagtgggaagagccactgctgtctctgcaacagtgcactggggagtggtggggattaagagattaccccctcttcaagttcattcccagattttggtggtccctccttttgtggctggcaccacacttgtgtttcctttgacccaaggtgggttttggtggggtgctctcccttctccctcaggggcagtccctgccaagggttagatctccatgggagtggagtctgcctccctcccgctcctcagaactagtgagacactctccctgaactgtccatgaaagcagactggggtgcccagcagtgacacacatagaccagttttaggttgcagagctgtccctggctgcgagtcttgcatcctaggagaaacctcagcttcacaagtctcttcctgctccagtcctgtgatgggaaagtctaatttcagtgcttgctgcttgggtgctttccacactcgccactcaattctgactgtgagggtcctttccccactccagggcaagtgcttcagtctctggcctgagactaaaatgcctgcaatggctgctgctgccaggttgccaaacagtgacttactttgcatgagcccagattagaaatggcatcctctggctgggtgtggtagctcaagcctgtaatcccagcactttgagaggccaaggcaggtggatgacttgaggtcagaagttcaagaccagcctggccaacatggtgtaaaccccgtctctactagaaatacagaaattagccaggtgtggtggtgggcgcctgtaatcccagctactcaggaggctgaggcaggagaatcacttgaacccgggaggcaggaggttgcagtgagtcaagatcatgccacggcactccaacctgggcaacagagtgagactccatttccaaaaaaaaaaagcattttcctcttattcccatgcctgggaaaatgcctgcagcttttcctggtgtcttttcctgtctcagtctctcagccttttcccagtttagtgtcagtgtttgggagaaacagggcgctctcccatggcctgggttgcacagatccccagtggaaaggtgagtcacagagggatactgactgtccctttcatgtactggagcttcacttacttttctcagccaaatgctgtccctggggctgcctgcccaccttcttcttcctgggttctggggtgttctttgcattctggtgaatcctgttttctttcttgaattaaagcttgcagagttgatctttatgcactattttgctaattccaagtggctgaggcacactcaaaacctctaatccacaatcttgggaaaaaaatctgcctggattgactctgattgcaaatatagaatgccaacatttagtgacctcagactatgtgatactcttgagtatctctcaaagcctgaaagaactgatgctggggaagatgcccaagacttatttagtctaggctttttgtgtagattctctctctctttttaaaaaaatctacttatttatttttgattctctgatttctatccttgggtatagtttgaccgctaaaagataataatcttaataacatattgtactccttgtagcattgccttcattgcattatcttttaatacttacatcaatttttaagtaaagtcgttatgggaagcaattatgttaaacttttttttttttttttttgagacagagtctcgctctgttgccgtggctggagtgcagtggcgcgatcttggctcactgcaatctctgcttcctggttcaagcagttctcctgccttagcctccagagcagctgggactacagacatacaccactacgcctggctaatttttgtatttttggtagaggcggggtttcaccatgttggccagtctggtcttgaactcctgacctcaagtgatctgcctgccttagcctcccaaagttctgggattataggcatgaatcactgcgccccggcaattatgtttagctttctaatgactttcctgaaaaactgttgctgagaacgttaagtactacttcacactttgtttttcagatacattcctatatgatacaattctttataaattcagtgctacagatacagttaatgagagggaccttggatatcatgtgttttcaactgttgtacagatgaagaaaccatggcttggagaggtcaacaaaaagtagctagcctggaacctggtctagaaattgtgtcttctaacaacaggcccagttttgttttgttttgttttttaacgtttggaagttgagttagcattgacataatgtaaaattagccatttaaaaatgagtgattcattggtattgagttcattcaccatggtatgcaaccaccacctctaattagtgtcagaacatttttatcaccctaaaaagaagactgtatccattaagccattttcctcttccgccccagcccgtggcagtcaccaatctgagttctgttactatggatttatgtattctggatattttatataaatgaaatcacacaaactgtggcctttgtgtctggcttctttcatttaacataagttttttaagctcattcatattatagcatgtactagtacgttattccttttcatggctgaattataggtagataccacaatttgttcattcactgataaacatttggggcatttcctccttttggctatagtaattagtgctgctgtgaacatgtgtgtacatgtttctgtttgagtacctggttttaattattttgggtatgtacataggagtggaattgctgagtcatatcataattctgtgttcaattttttgagaaactgccgattgttttacacagtggcagcaccattgtacatacctccattttgtttttatcttccttgtcctccatcatgctgagatcatgctgacttgaaaaagaaagccaaaaattagtcgttttgtttgaggtacgaactctcggtacatcttttgcaacagatttttcaaccagttttatctgttatttttccagtggtttattgaattgtattttgttttattcctttcattcaaactgaggtgaatttcttttcccttattatatttatgttcctaaaacctatgggaatgattttggaggtctaattaaatatcagtctatttattgcacaaaataaaaggaaaataatcaaaaagaaatagcaacactgaaatagtcttgggtactttgaaggagttatgttaggttttaattgacttaagtacaggtcagatctctttgtcttctacctttgctctaggagtcagtttgtagggctcggttttgagtgtccttaaatttgaggccatcgtattgctgtgacatatttactaaaacaatttcttgtattatatttgatcaatggatttgtagaaaacgtaaatggcttaagataggttaaatactattcaaatatgtctttttcaacttttaagttcaggggtacatgtgcaggatgtgcagatttgttacataggtaagtgtgtgccatggtggtttgctgcacagatcatcccatcacctgggtattaagcccagcaaccattagctgttcttcctgatgctctcgctcctcccatccacacctgccagacaggtgccagtgtgtatttttcccatctgtgtgtccatatgttctcatcattcagcttctacttgcaaatgagaacatgcagtgttcggtttttttgttcctgcattagtttgctgagaataatggcttctagctcgacccatgtccctacaaaggatgtgatcttgttagtctcttgttcctttttatggctgcatagtattccatggtgtatatgtaccacattttctttatccagtctatcgttgatgggcttttgggttgaatccatatttttgctactgtgaatagtgctgtagtgaacatacatgtgcatgtatctttataatagaatgatttctattcctttgggtatatacccagtaatgggattgctgggtcaagtcgtatttctgcctctagtctttgaggagttgccacactgtcttccacatggttgaactaatttacactcccaccaacagtgtaaagcattcctttttctccacaacctcattagcatctgttgtttcttgacattttaataatcggcattctgactggcgtgagatggtatctcatgttttttttaatttttttttgattagcatttctctaatgattagtgatgttgagcttttcatctgtttcttttgcaaagtgtctcttcatgtcttttgtttgtttaagggctttcttttaacacacagaacatcgttccttgcttcagtgcctactcatattatggtctctttatcagttattctgttcttcacctggctatatccttataattcttggagactaatcttaggtgtcgcattttccaagatgcttcctctgactgacccccctgccccaccctttctagctgagtcagatgatatgttccttcctaaagtcttgtaataactgaagcatatgtcattttacttactgtattgttttgtaattatatgtatgttgtctcctacaaaactgtgagctttttgattccaggaaaactatgctttatttacctttgaaattgcagaaccttactatcctaggcacatgatagacttcagtaaatgtttagtgaatgaatgaaagaagcttctagtttagaagaggcaaatatgcataaataactattgtagaattgtaaattgtgcagtggaagcagagaatacaatgaaaaatatatttgggaagagtgtgaggtgtttatgagggaaggtttgcttcatgggagataacaatttcagctggttcttgaggggaacttgatagaattttttgctagggagtaaaagtaatccatcctagagaacagaagcaagagagcaagtcatgatcatggaaaagccaagtattttagaatctttctcaaaggtcattttggcagtaaggaggatggaatacagggagaagcagtaatgatatagtcatgcagctataatgaaggttttgtgtcaagctttggctgtgaggaagggaaggtttcaaaagatacttaagatataaaatggtcaggcaggccctgatagctaattggctgaaaaattccaagaggataatccaaggcaactctagaatttctcttctcagtaattgggtaggtattgatgcctccttttaaaaaagtaaaggaatataggaaacatttgggatcttgaatgaatttaattttggacatgataagtttatgatctttatgacaaattcaggtaggagcgttcagtgtgtagttgaatataagtttctgaaactcaggagatatttctgagctggaggcacagttttggaagtcacagtacatatgggtggacatataaatggtggactagaaaactcaaggattgcatatctagtaagactataagaaggtaaaaacagaaccctgggaattgcaagctttcttctgcttaaaggtaatcaagggcatacttgcaaactagtgttaatttttcttggtcccttttatttcctgtatgctttcccaactttaatcaaaatggcagtaaaattatgttgagatatcatgtcttggactcagcatcagataaaccttatagcaagtgtggggctgtagcagtactaaaacattcatggcttattttcagggggggtgttgctgcctactcagttttatccagttattgccttgcaggtgtgcaattccaccgattcctgattccagatatttctgtttttcaagaaaagccagaaatcctgatttttacagatttttaaatgcttactcagaattttaaaaagtgctgttgttggtcaggtaaaacattgtcagtttctgatccctttctcaatccttacattctctgtaacaaagagcaactagtatcaccttctgaggtattgaaatgtacttgtttctgttgcatactaggatgaaagaaaaaacttgactggaagctccagaaaattatagtggaaaaggagacagactgagtccctgggcttagaagatttagagattgagtgagtaatagaggttataagtcagatgggctgagacccatctttagtgactgtactggcagtgaatcaatcattgccacctttggctccttgtttgctgaggtcttgttgtttctgggacttgaaactggaatggtttttagggaggatttttttctattattttgtcctgcatattttagtacaaaattataaacacaatacaaaaaatacttggtgtttcgccccaagaacataaccaacatgaatggaaatgtttctgtcagcttgtggctttcaaaatctgaacacctgatacaccaaatgaactcacaggatgatttgttagggctgactgtattatctttatttatttatttatttttgttgaatcagtttaaagaatttttacaggaagtctcctatttattctatagaaaaatcaaggaggtaattggaactgacctttggctcttctgttggttgaccctgtggaaataaagagttatgattccttgagtttgtgtgttcacttttaggaacagatttctctggaagtaaattccacttgtataacaattagatcttacagttaaaaattataattaaaaaatgtgtcacaagatattataatttgatcattgattcttgctctaaccaccttttggccatatcagattatgagaggaagttaaggagtaggcctcctgagtaaaggaggtgtgattttttttttctttgaggtgggagtatagttggaactaaataaactacgtgtgaatttaccatatcaactaaaattttgatcaaatggtttttttaaattgtgtggtacatattttatatatatttatagtttcccttaaggttttctataccagagttgttgatctattatttccttatactaatgttagggatgataaaagctatgagatgaatctaagcagttaattttaatatcatgtggaaatagttttgtctatgttttattaaatgtcgaatgaattgtgacttttacattttttttctctttcatttgttcttttgggcactgataagtctaaccatgtatcagtttattataattcatggctagtgccatctggctgtcgttctccctcttttgtaaaatcatcttgtacttgtgattatttatatatggttttaaaattactttttggaaactcttgaatagtgcatttatcccacacaaactagtatatgttgagtaagaatcatattctttctttattatcatttataaatgaaatatttatatatatttagacatgccagagcaaggtaaagtggtatatgctggtagtcccagctactcaggaggctgaggtgggaggatcctgtgagtctcagaattggaggctgcattaagctgtgatggcaccactgcattccagtctggaagagagtgagagactccatctttttaaacagacaaaatctgtaaaagtgtaaatagccttgagcgttgggcttaggttcactaaacaaatgttattttatattctcctgttgaatcaagagttttaaagagtactttccctgtgggtacactgttgagcagcctcaacatttgtgaatatttgttcacttcaagtttttgtttttggaatttaccaaaactttagcatataaagttagtaactggttttgggtagtactattttggtggaaagaattgggtaattgtaaataaaggagattaatttttattgttcacctgcaaaactgccttttgaagacaatttaaaaggagttctaaaaatatttaagctctaaaggcattatcttttctgtattccccaaacactctgtgaatcaatgtggtatttactacacttatgttatcattacatgtatattttacctttttagcttctgagcatattaggggcagaaactgcctcattcatctttgtatcgttaaggcctagcacatacccacctagtaacaatagaatcaatatgaagcctccaaaataattgggttggaggacagtagtttttatattaaatgtactcatacccacacataaaatagaatactaaggctcattacttagtttcatatttaatttttttcttaattgtatagccatgcatatgttgctgcactataaactaatcataggagtatatagcattgtatctgaagccatcaggtgagactgaggaggaacactttaaggtcctttgccttttcactgtcctttccctccttcccttggtctccccttttctctcctttttccattccttccctcatttcacttgtctagttagtaattttcatacttaatgagcagcttctgtgtacttggccttggttacattattatttgatgctgaatgagacagggttccacatcaggagcacattttattgaaattacctggagaagaacgttcaacttattgtacatagaataacgtgggaggaaaacagtctgtacttgttataagaccactcttcttatggctacttatttttattgttgaactatatatataatttctgtgactcaagttggcactgaagtagtatcaactaagattcttagccctgtttggcagccttaagccatataatgtatttaaatataccaggtgaatataagttggagagtggttgaccccattctagtgagattgatctcagagtcgaagttcctttctatggtagttctgacagtctattctaagatagctggtataaaacagctgatctaaaactgcattttccacttaacccccactctccacatgaaccaggataatctacacctgaattagctgaattaagcactgataacctaggcctaaattaagcactgataacctaggcctaaattaagcactgaattagttgtgtgattgtgaagagttactgaaccagtctgctacaactagacttgagagatgatgtcacaactcagccccttcatggtgctgatgggtattctggatcaaagagagggttagtgattttgcaaaggttatgcagaaagttagcggcaatctggaatctgtgatttctgactcttaagtattttattatgctgcctttcctatcataaatatctttttaggatcaaatgagataaatgtcagtacgccttgataggcagaaaatatcaccagataaattatttctacttcctttctttggtcaggatgcatatgtgattttttgcattgccatttcttaattttcagaatcatggaagtcgaggtcattttttatgtttttttgtgtccctgagttcaaaccaacacaggtagattatctaagcatactagtaagtagacaccctttgaaacttaaattttttccattatgtatttagaagatacatggataaattgattttcagaccaggaatttattatattcacttattgcaggtagttttctgactactttcttgggaggcatattaagctgattaatatttagataaaagcattcatttatgatattaacatttttttctgtgacttttaagacaattgtcagctgacaaattttatgggttaaagagtcaagatttgtttagtatcagatcttaccctgatagctgtgtgaccttgggcaatttttaaaaacttttttattgtttaactttgcataataatagtgattaagccaaaattgaccttggactgtgaactcatttactccccacagtaaccacatgacataggtgaggaaatgaaggcatgtagtggttacacaactaatggtaaaggtgagatttgaattcagctagtcctaactcctaagtctgtagtttttgagcactatgctgctgccttctactgcttcataagttgttctgaggtgtatgatttccacagcattttagattttaaaattgtgattaagattttatggcctagagattaatttagggaaaattataaatatataattgtccttccttctaaacagttttggtagcttgttagaaatgagagaactataggccctatcccagacacactggatcataatctgcattttaagaaactgtatttaatatccttaaagtttgagaagtattgcagtagatgatcttgagagtttcttccaattcacagttgtgagtgattctgggaccagtcagcatggatatctcaatgttgattattgtatttagcaaagaaaatggtactatattaaagtagcagttcccaacctctgtggcaccagggacccccagtttcatggaagacaatttttccatggcctgcgaggtggaggggatggtttcaagatgaaactctcccacctcagatcatcaggcattagttagattatcataaggaatactcaacctagagccctcacatgcacagttcacaataggtttcacgttcctatgagaatctaatgctgctgctgctctgacaggaggcagagctcaggtgctaatgctcgcggcatgctcacctcctgctgtgcggcccagttcctaatggtctgcagcctgggggttggggactcctgtattaaagaattttaaaaatgtaaatcactgtcatatagatttgtctgtattctttggattccattataggacaactcttgagataatacttgtttgaatttgtgaaaggtttcttatatagaagaaaattaccctaaattttatcctgtatcattttaggaaataattagaacccaattatttttatgtggcattagatcaaatgtttttcctaatttatctcactaataagattataatgtcagccagttatacatatgagaacacttagaataacataacttgatttttggacaattcgctattctgatgtttcaatgaacagtttaacatttgaagttaactgttgtaatagattaactaccaagcaaattagcactgcacttgcttgattagaaaagcctaatttttgtagtctgtggaatttaaaaatttctctcaaacttaattaaggaaagaatcttttttttctaaaaaaaaaaaaaaaaaaaaaaaccatgacagtaatgactgttttttcactgttaaattatcacctggcacattgcagaaattcacagaatagttgttgaatgaatgaataggactttggtttaggtgattttgctactgttttcaaatgaataataaaacacctgttagaatatgaaaagttgagtttttagaaaaatcaagtatttccccttgttgacaaattggtgcatgaatcttctccatatcaactcattttgactcttttttgaaaatttctttaattgtgaaagatatgatttgtacataagagagaataaaacatttatacagtttagtcctaacaactggttaaaaaatagaatactgggggatgcagagcaggatggccaaatagaagcctccactgattgtcctctccacaggaacaacaaattgaacaactatccacatataaagcaccttcataagaaccaaaaatcagggactgatcacagtagctggttttaacttcatattgctgcaagaggcactgaagatggtaggaaggacaatattgaattgtcaatgccacccctccctcatcccctggcagaagctgagtggtgcagagagaaaatctgtgcacttaggggagggagagcacagtgattatgggactttgcattggaactcagtgctgccctgtcacagtggaaagcaccactgggcagaacccagccagagcctatggatgaagcatttggaccagtcctaggcagagggaattgcccatcccagtggttggaacctgagtccagcaacccttgccactgctggctaatgtgctcgggggtcctaagtaaacttgaaaggcaggctaggccacaaggagtgcaattcctgggcgagtcctggtgctgtgctgggtttggagccaccgcaccacccagtgagacaccagctggggcgacgaagagagcacttgcaccacccttcctcccaccccaagtagtgcagcttgcaggtccgggaaagactccttctctctgcttgagaagaggagagggaaaagtgaagaggattctgttttgcaacttggataccagcttagccacagtaggacagggcaccaggcagagtcctgaggcccctgttccaggccctacctcccagaccgcatttctagacacacctttggccagaagggaacctactgctttgaagggaaggacctagtccgggcaagattgattgcctgctgactaaagagcccttggtccctgaataatcagtagcagtaggtacccaggcagtactttccctgggccttgggtgagattcagagacatgctggctttagatgtgacctagtacatttccagttgtggtaactatgcggggggacttcttctgtttgagaaaaggagagggaagagtgaggggactttgtgttgcaccttagctaccagcttggttacagtggaatagagcaccaagtgggctcttggggtccctgattctaggccttggctcttgtatagcatctcatgacctaccctgagccagaggggagcccattgccctgaagggagagtcccaggcctggcagcattcaccacagctgacagaagagcccttggtccttaatgaacgttggtagccaggcagtacttgccatgggcctggggactgtgcttgctgtagggagagactcctctacttgtggaaaggggagggaagaatgggaaggacttcatcttgtggcttgggtgctagcccacctgcagtagagtagagcagcaggtagattcctgaggtttccacctccagaccctggcttccagaagcatctcttgacctgcccaggaatgggagaaactctccaccttgaagggaaggacacaagcctatctggcttcactgcctgtagattgtagagtcctagggcttcaagtgaacataggcagtggccaggccatggttaccacaggcctcgggtgtgacccagtgctttgttgacttcaggtatgatccagtgccatcacagtggaggtagcaacagggttgcttgtgtcacccctctcccagctccacacaactcagcagagagactgactctgtttgggagaatgtaagggaagaaagcaagagtttctgcctggtaatttagataattcttccacatcttatttaggaccataaaggcaataccactacaagtctttcagagccacaacattagtaggcttagggtgcctctaatgtatatatggctacagttactagaaacatagatcacaacacccaagttcctttgaatacctggaaagccttcccaagaaggactgggacaaacaagcccagactgtaaagactgcaataaatgcctaactcttcaatgtccagacatcagtgaacatccacaagcatcaagaccattcaggaaaacattggcctcaccaaatggactaaataagacaccacagaccaatcctggagacagagatatgtgtccttttgggtggaaaaatcagaatagttgttttgaggaagtacaacaaaattcaagataatacagagaaggaattcagaatcttatcagataaatttaacaaagagattaaaataataaatagaatcaagcacaaatcttggagttgaaaaatgcagttgacctactgacgaatgcatcagaatttcttaacagaattgatcaagcagaagaaggaatgagtgaacttgaagacaggctaattgaaaatacacagaggagaaaaaagaataaaaaggaatgaggcacaactacaagatctagaaaatagcctcaaaagggcaaatttaagagttattgtccttaaagaggaggtagagagagagttaggcgtagaaaatttattcagatagataataacagagagcctctcaaacctagtaaaagatatcaatattaaaatacaagaaggttatagaacactgagcagatttaacccaagactacctcaagatacttaataatcaaactctcaaaggtcaaggatgaagaaaggatcctaaaagcagcaagagaaaaagaaaaaaacatggaatggtgctccagtacatttgccagcagacttctcagtggaagttgtacaggccaggagagagtggcatgccatattttagtgtggattaggaacttcagcaaagtattatcagaggaactgagtgtctctgtactttattctaaataactatgtcctacttacccgctcttagaaggaagtcagaggacacttctgtaggtgaaatagtattcccccctgattcagagagaagagagcatggaggcagagcagaaacttcgttagcaggcattctgtcctttggttaaaagataaaagtggccaagatgtggaaaaaggataataaaacacaaaggaataagagttgtataactctgagggacgtaaaagaaggtatgattaatggaaaaatgtcattttggggtaggaagactcagtattatatgtctccctaaataaatcttatccaggatttctgtttatttgtcatctaatcatttagagttgcttagaccagccctacacagttgctttatttttctccatagcacttatccccgtgtgatataactatatatttacttaattttctttttccccacttctggaatgtaaacttatgaaggtatgtgaacttatgtgggtatgcttgtgtttctttccttactagaatgtagatttatgggggtatgttttatcccttatggtatccccactaccttgagctgtgcttggcacgtaggaagcaatgactggtgagtgaatgaatgaataaataaagccctcctttctctcataatccacagcacttactgtctgttctgtagttttttggtcattaattttgttcagtttagcatcttataatgctttctattattttcttttggttcagtatctaattgtttcattcctataggagattcttctctatgctccttgacggcatgagtgggacaaatgcttcctttgtgtactacctcacagtgcaaggcgaatggatgtaggaacttgttgaattgaacacatgtatttattcataatgacttaagttgccaaattctagtttgcctttaataaaaggcgttttttttttaattggctaaaacagtataattctgtatgaaataggttttttttttaatgtatggatactttttggtgatgttttgttgagctcatagtaaatttcggtaactggaagttggaacttttgtaattataattgtatgagtttctatacgtaatttgagtaaaataatatcacaattttcaatgagataatttcttaccttgaaatttaaatttctaataaaatgtctccttatgctgtagttatattgggagctagtttcaagatgaaatactaattctaagtaagtataactttgtagcctacttatccttttgtatatgcatttgcaaatataaatgtacagatgtttttgtacatactttgttgtatttctcatgctaggatttcatttaacagtttgtataactatttctgtcctgtacctttgcattgccactaggattttttaaaaaagtaattgcagatgctctgtaaatctctctatacatataaattttgtatattgttttgtggagataaattttcaagtatacacttcacattttcaaaagttactgaaataataccatgaatgtttacaagaagaaatttaaaactatgtaaaagttttgttggttcttttctaattcatgtggagaattatttactaatttacttatattttttctgtatttcaggccagtctatccatatggggatggggaagccttggcattgtcctttttctgataacctttggaccctttgtaatattttatttgacattttatatcctctgctttgtgggtgggtaagtatactcaattataattttataattcatgtgtcatatcttgttaaaatggaaacaaatgactgagaaacgggagtatgatttatttgtgaatgccatttttaataaattgcttttactaaagttaaaaaaataaggatacccataaaaataaaaacagtgattgtcattatttgtatcagaaatatgggtagtccttcaataataagatgtccatttccaaaggtatgaactttttttggtgataatgtgtaaagtttaaaaaatttttcaaattccttttggtggtgtttctcctttaaagttgaaattttcttttgcattatgttaataagtaagttaaattgagactgcacatgaagttttacattatagaaattgtgattagacttcaaacaaatgttaattttttcctttaatgaatgttgtcatttcggtctagaaaattcaaatacctgattttgcagttttctcttcatagttatttggtgtacgtttatgttttcccttaagttgataaacctttacaagagaggtttcagtcataatttattgtagctttgtatgcagagcatttggtatcagacacgaattacaaggaaatattagaaaatatatagacaagggatgtttgttagacactgttaccaaaatagcttagttgaaatgagtcttttgttgttaatgtgtttgtatgtatgtttataatatgacgtatttatgtagttagttgtggaatgaacactgatttctttctgaaaaatcttttgagaccccagatatttggaggagttttttgagcctataggtttggaggatttagctgaattgaatagcatatataaacagtagcttgagaaactgtataggacactgaagggttagcttctaaatatatctatcacttttttggggatacagatttgatagtcatgttgtagtctttctatagggagcatatgcttgaacaagtgagaatttctttaattgagcagctatgtcaaggactctccataaaactgtattttatgttagatttagtattttcatatctatggcctagatacgatactgtgtactgaaacatttaaacttatttcagccataagagtctgataatggagttcagaatatctttattgatgataaagatgactgaagatgataaagatgattgaagatactacagatctgcagccaaatgggtttcctaattatacttctcagtcacagttaaggcgacagcatggctgaatagtgacatggttgcacctctccctctcagagtcgaggctgcatttattaattggaagggaaattgtcttgacatttttttttgaaaggtagaaatttcttctaatttcactaattgtattagcccttgtaagattgaaggaaaaggatttcagagtatttcccaatactttgtcaagggaggatattgcagctttataggctaaggtaggagcccttggaaggtgggtaagtgaataattatttctttttttactcaactgctccaaataaatttaggaaaaagagaagagtaatcagtttattaattttttaagtttttaatctttaataaaaccagatcctgcacaaagtttattcatttttaaagtcatgagaaccttcattgttccttttttaaatgttgtagtttatcaaggaataatttcaaaaaatcttttggatgcttacaaagttctgtaaaaatttggagataaggtgggatactagaggataatgggtactaaaaaactctagagaatattaagagtcacatggtagggtctgtggaatcctctcttgtttttctaataaaacttaagtttttaacttgcatagtttattcttgtcaagtgttgataatgtctatattttgcttatagtcaaagttaactccttattttttaatataaagaatgcttttggaaagaaaaacacttggggatttttcgtttttgttgttgtaggatactttcatcttactgcattatggttattttgtggcattctgttgtatttgttgggttatataattaatttatggcacccaactacagtttaaattattacttaaactttacagctgaaactactatttaggttcttttaaaatcagactgctctttatcttgtcttcctatcgttacacacttgtgggcaaaaattaatgtcttatcagtctgtttcttgatgatgtttttaataacacagtgttaatataaacattttattttgtctataaatatgcttaataaccaggtaaaactgaaatagagggccaacttgaatcttaataataatatcagatataacacagatagatgacatttagcagtaattctgagaccagccttttacaaataacaaaaacagaattaatgacttaaactgatttgactttatccatgttctcaacccccaacccctgcttttgtgatacttgtactgaggactagtgagagggcaggtagacacaaaaattggaggactttgagaatcttcctttcagtagttgagactgacaatatttaatgttttactgttcccttcctgtcattacagtctttgaatcattgtaacattactataagatcattattagattaaatgttttttgatggatttccaacactttgctttattggtaaatttaaaatctatgaaatattgataatatttagtcaatacttagagtgaagtagttctaaatcaccatttatcttccttgatcctgtaattatttttcaaaataattaactttttttgggatacatttatattttcttaattccagccttattttaaacaaatcatagattagatttttttttccctaaatagcctttatgtattctgtattcatactggaaagttataataatgtaatacctcacgtgaattggttaacagaactatagaattctgtcatttagctacatatttagattcatttgtctttatccatggttattagctagcctacttgtttaataagggctgatttttcttttctttttttttttgaggcgagtcttactctgtcgctagagtgcagtggcgcgatctcggctcactgcatcctctgcctccccggttcaagcaattttcctacctcagcctcctgagtagctgggattacaggtgcatgtcaccacacccagctaatttttgtgtttttagtagagacggggtttcaccatgttggtcagggtggtctcgatctcctgacctcagatgagccacctgcctcggcctcccaaggtgctgggattacaggtgtgagccactgtgctcagcctgatttttttttaagtttgaaaaatgtcacttaagtttttttttttttttcgagacagtcttgatctgtcacccaggctcaagtgcagtggcgtgatctcagttcactgcaatctctgcctcccaggttccagcgattctcctgcctcagcctcccaagtagctgggactacaggtgcaagccaccaccctggctaatttttgtatttttagtagagacggggtttcaccatgttggtcaagctggtctcgaactcctgaccttgtgatcctcctgtcttggcctcccaaagtgctgggattacaggcatgagccaccacacctggccttgtcacaagattctttaggaaatatattggattaaaactttaaaaagtattattgtataattcacaaaatgttcatagttgttttaaacttcagaacctaatacaatctgtcaatttcttgctttgccaaagtcacaaattgactttttagtaaatgataagccatctgtgaactctggaaaatatacttggtagtagattcattaaattataaggaaattttgtttttatatttgtgattaaatttttctttctaggggtttagtggttactctcctgtttggaaaaacaaactcagagaagtacctagaacagtgtgaacactcatttcttcctccaacatcacctggggttcctaaggtaaatcgtttgagggaatataaaacctcaaagtccagttctttgcaatgataatagagtaatcatctgtatatatagcgtgacaaattttcgtatagtttactaatgctcactgggaatttatgtgagattgtctaattatacttagaaaatatattttaaaaggccatcttaaaaactttcttagtgttagatttaaaaagtgggaatacaaacttgagaaaacgatagaaattggttagtttattttgggtatttttcctgctgtcttatcatagtatttcaaagcatcatgcatatgatttttaacaatgtcaatgagtattctggtttgaatgaaataaattgcagaggaatcagaggaaaaaatggatacttttcattactttgaaaaatacagcttgtaattagattatgcagtatctataattttaataattcaggcctaatttttatcatcttgaatggtgctattattttttcagtatcatactctataaataaaattggaattgtgtaagtttcagattgtagtgccttcaattcttgtgcagttgggttggtttcattttgtatgaagagaggcagatggcctggagttgatgctaataacaactttctttacagttattaatttatctgttacatgctaaggtgcaggagatgtagaagtaaataatgtccaatattattttacattaataaaagaatttcactctattccactgacttttatattgataaacaaattttttaatacttaaacttttttataatctgaaacctttctctcctttaggactcatattaatatgtatttttttttttttacttataagtcttaggaaattaacctttccttttttgaaccatttcttagctatttatagtgtacttcatttgagtggcatatacagagaataggaaatattttaagaattaagatccttaacagtaataaattatattcaagaatggttaagtctttataatccatttttaatagatagtataaaacaatgggttttatttgctatttctaaaatatgatttctaagtatgtcttatgaaaaaatatccgtggtttcatattataactttgaagcatgtatttttaatatagatatctatgtctatatctgtatctatgtttatatatatttatggtttgtttttttaagaatctcccactaccttttccccaattttcaggccactgatctttctgaacacaaaaaagtagagaagtacattttcttaagttgccaaaactatccctacataaaatccgtttaaaaattaattattttgcagctggtatactgttttgggctgggaaaggggaggggcaagagggagagtgtccagtaaagacagtttgactcacatgaaacactaattttatagttgtagagtttcattgaaatatggcagcagcatacctgtacatttgcagttttcccacattctaaataatttttgctgattaaatttttgaggataatcatttttttgggagtgtctaattttgttaacttgagaaatagtgtttggcttatagagtagcacctcaaataaggttatttatttacttgaggataatgaagggatgttacattgagtattcaactggaattaaactggagagattttacatcagaaaactactcagtaagatattttgatttcctttaagtgcttagaagaaatgaaacgggaagccaggactattaagattgatagaagattgacgggtgccaatataattgatgaacctctccagcaagtgagtttcagcgtgtggtatttgaattctatatattgtgttctaggtatatttcttttgaagataccaggaaatactttttgctctttaaataatatcctggaatttcttaatgttatccttgaattttatacttgaagatgcttccttatttattaactcacttctaatgaggtggtttactttatgtaaaagcctttcgattgaatttggatttagaaaaaaagttgttattgacatttgatagtgtttcttaaaattttacagttaaagtgttactctttcgttgatgaacaagcttagtggtgtggtaaatcagactttttttcctacttgttaccttttaaaaaatggaaaagaaatatccgatgcaaaaacattaaaaaattagagataggtaaaaaaactatgccccctgaaatatttttcattgatgtttgattatatgattataaaaatgtgtactttagaattttaacatttattattattactaatatttagtttatctgatttgtaaaaattatacattgagttgtattatgtactatttattgtctgaatactgttggcagtatcaaaggtattagtagaaataagtgaactcctgtatcatttttataattagactgcaatggatctgatgatataatctttaaaaaaactttttttgtggaattatagtctctattattttacatctcattccattaaactgattgatattatttattagattatagcatggaaagtttcttttttttctgcaaaccctgtctttacctggatttatgtgggacttggccatagatagtgttttattttatttttttttttaaatctaggcagtaggtaagttgggataccagaataatttaaaaatgtttgaaatggtttttagtatgttgatgtttttgtaatgagggcaggtatttaccaccataaattaatacgtagagagtaaatataaattggtagatacagcatacttttttagtttaccactgtaactttttaaatcctaaaatgttgtaattttttttccaatatttttgttataggttatccagttttccttgagggattatgtccagtattggtattatacactaagcgatgatgaatcttttcttcttgaaattaggcagactcttcaaaacgcactcattcagtttgctactaggtaaggacacgacattgtatttatgcagaaaaatttagatgtatggtttgtaccagtaaggaaaacaacttttaaggggaggaattgtttattaaaaggtaagtagaacagcagattattactgtgggataactccaagattttacaactagagctcttaaaacctttaaattaccccagattttaggtttttacagaatgttattttgattaagccctgctttctaagtctgtttggtagttttttctttagggtccaaatcaggtgacttttcaaatctgttaccccacttattgctacttcccccctcccccttccctagaccctctgttttatgtgagtgctatgaaaatagattagtttcagtgtaactgctcttctccacatagttttgctgtaacccttctcctaattatgacacatatctattggaagtcctcttggacgagaagggaccaaaggaacataagtcagtggaaaatattcaagtttatatttttcagaaaagaagtatattttggtgagtttgttttaacaaactttttttgtcagatatactaaaattcttactttacaaaccagctatatactgcttcccatatgatgaaagtgttttgacttctattcttgtacttaaactgcttgattttttttgatgggaggctatttcacacctgtttaaattatgtttactttcatttttatttttgaaggctttttttcccctccatccttgatgtctaactttttgaaagccttttaatgggcaacgttatgtgaaagggaatacttgtgttctagaaattatttatttttgaaagaaagattttatgtttggatgagtttgtagattttttttttttattccattaaaatatgttgctaccatcacacgcaaagattgccctgctaggtatttccagccatgctgccctctcaggccctttcctctatctccattgattataaagctttagatttggagttggctagaggaagggcattggatgtgtttcccaacctcattggggagcctggcacaagttttatgatttgaacaataattgttacagagatagatttgtactcctcatccctcgtgattaggagcaagaatttacaaagtagccagccagaattacagatgcagactcactgtggaacacagaacatataattggtataatcaaagaaagtcagaatttgaatttaatctcttttatttcatatgcaccattattgagtgttaggtattctttcagataactcttctaaatattttttattgctttctatagcaacactatcctgatgactttttttttctttgaaagggtgagaataggaagaattcattattcttgtgcctgactattgaaaaatatataaaaatgtgtaacacattttagacctgggaagagatttgaactagtaatctgaaaacttgagtttgcattctagctccacctctagctatgggactgtgagcaagtgtctttaaactctgaaccttggtttttctcatatgtaaaataagtgtaataataactgccctgttctgtgttcctctcaggataattgtcaggatcaaaattcatcttattcaactaatattttgggcatactttgtaccaaccagatgctggggatacagcagtgaataaaacaaagtccctgctcagtggagtgaaatgaaatacctgtgacagtgttttgaaaattgtgaaggaatttagaaatttaagtttttatgccatccaacacccataattttactgatgaggaagctaaggtccagaaaggtaaagtggttagtctaatgttatctagtgagttagaatcaaattgttcttaagtttggtattttttctcctacccaattaaatattttataatctaggttatttatcttagtttcctgctcttctttcctgttattgcaatactttccctgtttttgatcccctagtcacctttcttttcactgtaggtattaagtttttttttcttttgaaaacattcagtgctatcaagcttagtgaaaaagcaaggttttttccatcctacactgatctaaatttatatctttgcttgaccatttaccttaaatttctggaaaattaaaacaatacagataataactactttagaggctgctttgaggctaaaaaatggtatcaaataaagttcttagcgtgcagtaaaactcattaattgttggtttgttccttctctgttaatgactttcctacattccctttttctattactacacaaatatatgacttactagaggctccatgacttccggtgccaatatcaggaagattagtctgtttacaatcattcatatacttcagaaagccttattctgtgctgtctgctgtatactgtgaaacatatgatagcagcaaaaactatcacctctattctttaacttacagtcctttatagggctcttaacaggggcccacaaacctggaaaaaaactgtggtttttttttttttcctatccagtggtttcataggtttgatttctttaaagggtcatgaactcagaaaatgtttagaacccatgatttctagtgtttgtatttattcatcaactttgagaaacaattagagaatgtcactgtaaaatgaagtgcttaattttgaaagatgggaagaaaataatgtatgttttgagtccgaagctgttgatttgagcttagctctattacttcttaagctcttggccttgagtggacaaaacacatacattttttgtctggagatgataacttatatctccttatgaggtggttgttaggattaaatgacatcatgtgtgggagagtgctttgtagtcataacatcttatttagtattagtacttgttattccagtaccagcttggggaaggaaactttcctccagcacccttgagttctccttctctgtggaatttgggtgtggattagacgggagccttagggaatgaatcctggataacccatgtatttttattcaccctctaaataagatattatagtgtgatgcagacagccttggcctgtgtcagaaaatctataattctatctctactgttaagttttagtgtatcgaaaagaaaatttttaatgtctctgtaaaatagtaatagtaattcttgtagcaaacttagagttgtaaggggaaaatgagatgatgtgggtgaaacatttagtaaagtatttgccaaccagtaaatgacatttttagcaaatcacttgactctgtgcctctataagctggcacatagtaagtgttcagtaaagttaacttctctgttattattgttgctattatgttcctaggttgtgtacacagattctttgaccctgtcttagctcttttttttttttttttgtagagcaagggaggtggagagggcaaaattaaggcacatgaaacatagagaaataaaacaatcatttctgtggtattgagagcggtttgtcatgtagcgatagagtgaaccacagtagctgatgaagacctgaacggagttgagaccaaaactggttttcaagaatgggttatttggatagatagagaggaaggacatgttaggaaataagaatagtatgagcaaatttctaaaaaagaagataaggatagtgtagtagaaactataacaagcaaccttgttgttgatcttgaaagtgaagtgtgggtggtaaatccctccatcattgttccccttaacccaagattagcagaaagtacataatatattctttttttttttgagacggagtctcactctgtcacccaggctggagtgcagtggcatgatcggtggagagcagtggcacgatctcggctcactgcaacctctgcatcccaggttcaagcaattcttctgccccagcctccttagtagctgatattataagcgcacgccactacacccgactaatttttgtatttttagtagagacggggtttcaccatgttggtcaggctggcctcgaactcctgaccttgtgatccgcccccctcagcctcccaaagtgctgggattacaggcgtgagtcactgtgccccccagcgaaagtaggtatatgctaatgccactgtgttcctaactgaaggatcttcctgtagagggaggagggatagatacataggtttcaggattcgctggctgtgatactaatgatatagtatcacagggaatgatagggaatgtgttcttgaagttttaccaattttcttactaccttttgccatagaaataatgaaaataaatggtatatccctacacttgttaaaaggcaaacaaaactcaaatagtggacatttgcaacaaagttttatccttttttttgttttaccattttatattctttgctatatgaaatttgggtaaaaactgacattacttggaaagacagttattatatttattacagtacagcaaaaacaattagaaactaatttaaaattagaaattttatctaaatatttaaaagaaggggaaatagttaatgttttttgtttttgttttgaggcagactcttgttctgtcacctaggctggagtgcagtggcacgatctcggctcactgcagtttccgcctcacaggttcaagcgattctcctgtctcagattcctgagtagctgggattacaggtgcacgctgccactcccggctaattttttgtattctagtagagacggggtttcaccacattgcctaggctggtctggagctcctgagctcaggcaatccactggcctcagcctcccaaagtgctgggattacaggtgtgagccaccacacccagcctaacgtttttataatctgtagaatagacctggggtaatagttcattattaactgatacaattcacaaactatacagttcacccacttaaagtcagtagctttagttaagcattgtacagctttcatcacaataaatttaagaacattttaatgacttcacaaagaaaccttatatccattgtcagtcacttctgcgtttccccaagcttctagctctaggtaaccactaatcttttttttttttttttgtctctatggatttgcctattctgagcattttatatgaatgaaataatatatgtggtcttttttcctgtttcttttacttaacattatgttttcaaggttcattcatgttgtggcataaattagtgcttattcttttttattgctgaataatattccgttgaacacataccacatttgtttttcatcagtaaatgggcatttaggttgtttctagtctttgaatcatatgaataatgctactatgagtattcatgtacaagtttttgagggacaaatgtttccatttctcttggatatatacctaggaatataatttctggattgtatgatcagtcttttgaggaactgcaaactttttcatagtggctgtattttgttacgtttccaccagcagtgtatgaaggctcctctttgaccaacacttaagttattattgtctgtctttttgttaccatcttagtgagtgtgaagtagtattacattatcgtttgaatctgcatttccctgatagctagtgatatcgagcatcttttcatgtgcttattggtcatttgtatattttctatagatatgtgatttgttctacagatagatggtttgttttcaatcatacttttttcccagtgtctatgaaaaatgaaatgttcatagacccaatgggagcatattaaaatgtgtggaaaaaacatggaagtcacaagtgggaactctattaacaataatttattgggtatttactgttccatcgtgtacaaaccatggtagtaagaatttgtttccagatagtggctgcctatacaaaattgttatctatagttgaaaaaacaattcttatgttttcgttcataagaacacaaagaatagaaaagaaaaatggcaaataaattaactttttaaaaagtcatcttaggtatctttattactgacaaccaaatgtttctgtttctggctgtaaagtaatatacacctattttgtaaaatgtaattttcttctttagattttctgaattagctattttcagccatagacccacaatccaaagatcactgttaatgttttagtgtatttccttttaatgtcttagctgtgcatacatagtcacaatttttatatagctaaaaatcatacagcatatgctactttgtatagttgtgattctattttctatatatttataattcttcttatatattttaatggctataaaactgtctgttgcaggaatcagcaaacttttttctaaagagccaaacagcaacgattttaggatttgtaggccacatcatttctgtcacagctagtaaattctgccattgtagcacaaaagcagctacggacaaaatgcaaataaatgagcataactgtccaataaaactatatttataaaaacaagcagagtacatgtcctttgcagggacatggatgaagctggaaaccatcattctcagcaaactaacacaagaacagaaaaccaaacaccgtatgttctcacccatgagtggcgtgatgagatgagaacgatgagaacacatggacacagggaggggaacatcacacaccggggcctcttggggggtgaggggcaaggggagggatagcattaggataagtacctaatgtaggtgacaggttgatgggtgcagcaagccaccatggcacgtgtatacctgtgtaacaaacgtgcacattcagcacatgtatcccagaattaaaagtatgtattaaaaaaagcaacagcacactcaataataaaatgacaagtaacctaattaaaaaatggggaaataatttgaatagacatttcactatagaagaaatgtccagatgttctgaaggacttatatcttagttttagtagttttattaatactcctgtttactaaagtagttaacatcatgagtttaattttctatactttaacatacttaagaagatgtgcacttagccccatgttatgttttttcctgtattttatcttaactaaggtgttcacgtcttgttttttgtactcctgaaatgatgactatactttatgtgtgtacttctgtgtaaattttttactattttctgagatctaagtccttcagaacatctggatattggaatctctttgaagcattgaaatataggatataggactgcacttcttaagcagtgttatagctcactaaataccatttcctttaatacagtcatataaaactgcatgcctaagttcgtttccaccaatttgcttattacttctatgaatcaggatgttttgttttcttgttatggtagagtagaaagaacactgaactgaaagttaagaaccctgtttgtttttgtttttgtttttgtttttgagacagagtctcgccctgtcgcccaggctggagtacaatggcgcaatctcggctcactgcaacctccgcttcctggaaccctgttttgtttaacaaaaccttggtctcactgtgtctcctagaatatgtaatttaaattctggctctgaaattacagggaattgtggtagtgatttgagaaccctttcagttctaaaatagtaagattctctggtcaggttgttactaatcttgatttcttttcaatcatgtttcctcccaaaacacacactaacatactccatcacactccacattttgaataccatttggggagttatttttttttaagtatataggattgctaattagagttaatttactttgggattaaagtactcttcatatctattgttttattagtaggggtcttatagtaggataacaaaatttatttaaaccttttaatatatttctaaatgatcagaaagaatgcttgattctaaacataaaatacatttactaatctcttctcgatgattaaaacccttgtatcaatgaaataaaaagtttttgtacaaccagactattgctgttctttatagaatgctgaaaacaataaatctgtagtgttatgagtttgattttttttaagttttctgaagtgtaagttctcccaccacgttcagttttaagctatcagcatgaagtcactgaacatggaaataggaagagatgtacacaattgtttgcctactccagctcacagttggagaggatacagctaagtgaagagggggcagaggcagatttgtaaacctgaagtaatgagttgtatttccttgtgtggttgctaatttagctcctatgaaagaattccccgtatatttttgaggactatggtagggggtactcatacattaactttaagttcaggaatgtttgtgaagaaggtcaaattagtttcattattttaatcaatactgacaactaaatccttaaagtggatgataaaaggagactctggagagatggttatggtaacatgtagtatttatgactgaattgacgtaggggggattgatttagtggattcaaaatgaagcttacaattctgtgcctttacaattttacccaaattcaatttcagcctgagtttttgacaccgttaacaaagtagttcttcaaggactctgaaggatggaaacaagtaaaggattatgtatttagagtgaagagtagtatatcctttctaatagtgaattaagagggggacttagtatctgattcagagactcaggagaaggaatttttttctttcacagataagccactcagttgctttctctcaacaaaaaaaagtctgagtcagttgatcaaaaggccttctaatggagtaaaacttttctcaaaatctactcaaagttacttgtcaaaaatctacccaagaaaactaggaattctattttaatgatttttcaaaaatttctattttttttacatagaagataaagaccttttgttgaagattaatacatattattataattttatgtgattggttattatattgatcttattaacatacctttaaaaaggccaactcttaacgtgcgtgtgtgtgtgtgtgtttgtgtatgtgtatatgtatataccttttcccttgagattcctttcagttctaaaatactaagattctatggacctctgtgtgtgtgtgtgtgtgtgtgtgttgtacatatagtgtctatgtatacctacacattatgcagtatatagtatactctaccattcttactgtttttaaaaaaggtcttcgtagtcatttctctgaaaaactaatgtggcatcaggagcataacatttattataggattgttttctgtggaaaaagcagcttttacttttatcattttgacataaggcaccttttccaggaaaatattctgccatgaatgtgaagatcgcctttactgccaagcgatcaccctctcctctagtcaggcaagtctacaagatgacccttgcatatatatttatcatgctcatccccctcttctgctcattcctgtgtcctttcttctcccatataaatactgctctttcatcaagatttaagtgtagcctctttaatgaagcctctttaaattatgacatattccttaatctatagtctttgtgtgtgtggttctcgtcaacaaaattttaagctgattttgaaatggttcctattctgtgctattgcagtgaaagttctcttaactgatgtttggttagccagtgctctccattccctttgtatgctgtactgactgataaccttagcattaagactaggctctattacatctatccacttctgtttccacccttggagttgtatgcttatcaaaagtcagttgtgtgatacctggaccccacctccagaaaatctgatacaattagtctgtagtgtgacctgaatattggtgatttagaggagacagataatcaaacacgttgaaataaaagttgtatttgtttttgagcctaaatatcccagttacactttttatgataatcaggtcgtttaattaacagtcaacttagattgaagaaatatgaatatgacaaggtagtttctatgaaaaccaagtcacttgctttggaattactcgcagctggttgaagagtgtaattgaattaagtgagcgaaaggcagctatgaaatttgaaagtcttcaaggactctgcatgcagatttgttcacaaatgtctttattgccatgccattttaaagaaactggaaaccataggttttgcagtgtaggaacagttcatagttttttcaagacccaggtcatgttaataccactcagcagagccttaaccaaagaaaaagtcttattcctacacaggaagatttatataattgaacttaaagtgaaatatattcatggctccctcttttgatcgaatgtttaaatttacctactgcccaattaccagttttttatacactccatccctgtgtatgtatatgtgtggttttatgtagctaatataatcatagactcaaagatgtaatgagtgttgttagagaaaacaaactttgggaaatgatgtgacttgctgaatttcatagactggcactgatgcctttgatttgagtaaaagacccatcatttgggggagtcttttgttagaatcaaaggcatctgtgtcagtccagtgcgttttccagaaatacttgattttggtagtgttttgtgctactgatgatgagctgtacactgcttagaatagatggaacaagtgaggcaatttacaatcctaaactcaaccacatatttgggcctttacttgcctttttaagggattggcattaagtagccatgggacaaaaagagcttctcagtacatattctactttaacactttaaggagtaaggaagcaattgttgtttgtgcctcctgttgccattgtccaaacacccattgtaaacagtgctccgaccctgaaaaaggaatcaataaatcaatatgcattgagtgcctctaataatgtttgaatcattacttttccttgggggatacagctatgaataaaacaaacacagttggctgagtgcagtgctatgtgcctgtactcccagctactcagaaggctgaggtaggaggatcacttgagcccagcagtttgaggctgcactgtgaatatgcatgtgaagagtcatggcattccagcctggacaacatagcgagactctattgaaaaagaacaaacaaaatgaacaaacaaaaaaacagacacagtcaatctgtgccttactgagattaatgttctaacagcaaataattcaactgtaggttgtaagagctataaaaagtggaaagtttggtattatcagaatgcataactggagacagggcctagtctgaaggaatagtggagagggtgggggtcagtgaaggttggcatgtggaattgacattttagatgaactttaatgtgtaagtgggaattgtcaagtgaatggggggagagaaggaaaatttatggagagtaggcaatgccaagcaaatttggtagagggaatagtctgtccagaggcactgagagtaaaaggggcatatttgcacttgacaaatggaaagaaagcctgtgaatctgcataacaaagaggaagggagagggtgaaatagatggtgatgaggaaatacacaagggctttccgtatggaagatcttagagaaggtgtttgtgcttagtcctaataataatggggtgttattgcagttttaaagctgtatatatcctattttaaaaatttgactgctttatggaaattggaatgcaagggaaacgagtggatgtgggagacctgtaagtagaatggtggcgagggatacgatggtggcattagagacagagatgaaggcatgcaaaatttatgttcagagagacacactttatagttttgttttgcttttgtgctttcagttaaaatttcattagttgtttgcattcctagttaaccttcttaattttttcttgcaaccattctgtcaagatatataagcttcaggggcctactataaatgttttcaagctagggttaattgtatcactttttttggccatatagggattgtgttcttttatttttaaattcaagaaattacagcttattagtaataataaagctcaagtgtcggtaataagatgcattatgtaatagcccggttgttttactaagaattctatgggggaatattttaagcaaaatgaaaaagagttttgactgttggcataatgtaagaataattgatactaagagctctaatagaaagctatgtagtaaatgcagtagaagtatggctattacataaatgaaatatttcttactcattttcacattgcatttattacatatttatcatgtcatgattttagaaagtacttcactgtcatcaaagtattttccaattttgttaagacaaacattattagaaattgttagtatatatcctaatttataaatgggaagaagtgtgctattgttcttcctaatctagaaagttcttttgagatttatattaagtttgcatgaagtcagtggaaataagtcaagcagaaggaaaataacctcagaaagagataagatatcggtactgtttttcctatttttcctaccctcaacatatttctgtattgaaaatagaaatctgtacatcaaatttaaaataattttgtatgtatttgcattgcttgataattttattcgtttaaaatgtcattacatcctctataatgaatcaagatggatttaaaatgtcttctaaattggtaaaatttattttgtttgaaagtttcagtaaattaaataaacagcattgtagcatgaaacaggacagatgtaacttgaaatattatatattctgctttcttctaaatttgtcaaaatgaaccttttatggattaaatgagctatggcctatactaagtaaattttgtttttataaaattttcagtatggatgattttgaataaatattcatgtaaagatttttgaaagatgcttacacagattgtgatttatttttttaaataagaaaaaagagtttctagagactgctaggtttaagtttttattttaggtttatgttgagactgaatattgttaccaagtttagttatatgcttatatgcatggctcttatattctaaataatgttaattaattcatcctcggattactgagcttagggatccacctttttatgttaatttgttttcgtgttcatatacttacggctttctctttagtttcatgtatacaacaaaccttagtgttaataacttatttttttacttgaaaacagccatttatttttcaacatcatactgactctttaaggctttttttttttttttttttttttcaaaaagtaacagtaattaagtcagcatcttcactagcctttttattgtatgtgtgggtaattaccataatgaattatggcatacttttttggttcctccattgtctagcatcttcatgaatagactcttcgttttctatctacttggtatgttcctgggtgaattaattttagtgcgattttatgaaaaagaacattatattaaaaaatcacccaatccaaggagagatataaattgtttttgagttatctattgtgttttttacctgttacactggtatactgaattaacagtatcttttgaggtctgttgcttttgagatagagtactaggtgacttcttaaaattagtaatcacctttttcatgagtattctaaaggcttttatatgtgtgatattttatatcattctttataccatttccttgtaattagttatttctaatggttaaggcttttttttttttttttgatgagatagctctgttcccaggctcgaatgcagtggtgtggtcacagctcactgcagcgttgacctcctgggctcaggtgatcctcccacttcagcttccctagcagctgggactataggtgcatgccaccatgcctggctaattttttgtaatttttgtagagacagtttcaccatgtcgactaggctggtcttgaacttctggactcaagtgatcctcctgcctcagcctcccaaagtgttgggattataggcgtgagccactgtgcctggccatggccaagtttttaagtgctagtgtattcaaacagaacgttcagaacatgtgttgcatagctaaaaagatgaatgtggagaattcagaaagagttcagaagaaaccaagaaatgtttgaaatgctcttttaaagcaaacaaaactattcagaattccttatgtattcttatgttggggctgagaaattacatgatatactgttgtcagattcacttcaaatttaactggaaaaaattaatttctttttctattttaaacctttagatagtagttttaagctttggcacataaaataattcaagtaatattgttagaagacttagtgaagtagatttgatttactttgaatcttgtgaaacagtactaacaggtaataatgaatgaaaatctcaatttaaatttacagtctcagataatcatgttgtttgtcagtagtcattaaaatgaatttatattttctgataaagcatttatataatccttttatgtaatgtgttttttataaggtcaaaagaaatagactggcaaccttattttactacacgcattgtagatgactttggcacacacttacgagtattcagaaaggctcaacagaaaataacagagaaagatgatcaagtgaaaggtaatatctttattccatttgaaaactaggatttgaaaatctgttttcctttcatcattttatatatcttgaattgtttttctttaggtacagcagaagatcttgtagataccttctttgaagttgaagttgaaatggagaaggaggtttgccgtgatctagtgtgcacttcccccaaagatgaagaaggttttcttttaatttaacttttttgacaatagtagctggctagagtcaagttagcagaaccagtgaaaaaatctaagggtaaaattattcttacttagggcaggtagcatagtaaagatgctattcattttattttattttgtaactcttaaaagtagtttccagattctgttttcttctttaaaggtcatctttaataattaactggtcctggctgggtgcagtggctcatgcctgtaatcccatcattttgggaggccgaagggcctggattgcttgagtccaggagttcaagaccagcctaggcaacatggcgaaaccctgtctctactaaaagtacgaaacatcagctggctgaggtgggagaatcaccggagcctgggaagtcaaggctgcagtgacctgtgatcatgctattgcactccagcctgagtgacgagagtgagaccctgtctaaaaaaaagaaaagaaattatcaatctacttttaaaatatagcaaacgcaaacattttatgactgaatttttttatctgtagtaatttctcttcctcttgaatttattatttttgcttcagaagtatacctgttaccataaaatatttcctaagggaatgatacagtgatttcaaataaaatttatagatttcaacgggcttgtcttttattggtaggagtttacactagacaagttttagctgaggacgttatcttcccagttttgcaagtattaagtctttgttaattggcacagttttaaattaagaggatcacttatgcaattatattcccagaaagtgtcagcataggaacaactatagaaaagcccttctagttgttgaaattgttttcttagattttgaaaatgttttaaatatttttatttatttctttgttcttcctttcttcttttgccttttctttttatgtttattgtataattcaggttttaatggccagtttattagcactgttaagaagtatagttgacacttgaacagtgagagggtttcgggtactgactccctgtgcagacagaattctgtgcataacttttgacccccaaaaacttaaatactaacagcccactgttaaccataacccttatcaataatgtaaacaattgattaacacatagactagtatctgcatatattttatgcattcatggcatacctttttgtgaatttttttgatatttctaggctatgcggttcatctcttgagttttttaaattgtcacaaatctctaaaaaattttccaatatatttactgaaaaaaatccacatataagtggacctgagcagttcagactctttgttcaagggtcaatttatattacagtaacttagaatgtaacacatagatatactgatgtgcaatacttttatgtaagttgagctctcttaaatcagcagaatagaagagcatactctttttttcctttgttatagcctgctgagatgatggaggtgttttcttgaaagaagaattacagctatgtttttatatgtgtgaataacttttaagtatggaaagctaattaacgtgtggtagaattacagagtacctggtccatctaaaactattttgggaaaaaagacttgtaacgaaatttttttatgattcaaaaaactggttaaaacagcaaaattaaaaaaaattaagttgattaatgaatagttactacttggagaataatgaaggaatttttaatgaatactgatgtgtactaattactaaaataagccattgtaaccagggaactggttatttctgcctttttaaatgtatcttatatatcaagaggaagtgtagactttatattttctaatgttatgatagctactttttctacttttaggattcctaagggatttgtgtgaggtcttactatatttattgctacctcctggagatttccagaacaagatcatgcgatactttgtcagggtaagcttaaactcataccatatcatacctgcaaaaaaatgtagagcagtagttttcaaaatttttgtcttaagaccctgttacactcttaaaaattattgaagactccaaagagcttttgtttatgtgagttttctttaaaatatttacacaagtgaagactaagaaatttttaaaacatgaaaatatgcaagcatgtatttcattacctaatagctcgataccatcatagcattatgtaactttgtaaaggtcactgtgtgtacatgaaagaacaagagtgaaaagttaaataatgtcttagcattattatgaaaatggtgttgaaagggtcacctgaaacccaagcttcgggggaacttcaggttcatggaaacctcccactaatcccccagaagtctctggctgatagttaggtgctttggtttttggttatgacaaaagtttgttttaaattttcttataccctagtgttatctaaatcaggttagataaaaataacatttttggacagaaactttaaaaactgtacagttaagattatgttttttagcaattggaaaattaatgtcagatgagaatagtagtcttggacttgttattccctgagtataaaccttcagagtaaagttctgtgtgtaaatttaaaggaataacatttgtctttggctgctggtaatgatttagaaaggctagctacacaagaacatgtcctggttgaatgcgtaacgtgaaaagttttgaattttcctaaaaacaaaagcttatgatctctttagtctgtcctgcaaaatagataacaattcctgagacttgcttttatgcttgcatgttattgtttataagccataccatacaatttcctaacatctacctagcttggggttcagtgtacttctcaggtatgttaatggtacttatgtgaagtaatagaaagtgcttggttttgatgggaggagcctgatacattaactgtatattgttaaggccaattatttgggctggtcattatgacgggtggcaagtacctggatgtctatcactagattcatatctgccacttaaggaagatagtactagtcaggtatagcatttgttcatgcagagtatccatttggcataataatctgtttatatattactccagccagctactgttacgtggaatctcagcattatttcgcatgtcttgccatcttttccttattgaaactctattttctcctttctttcatgtcactggtctcatttttagtcacctttgctttcctttttagtcatgtttatactccttaacttctcttctgcttaaattttgattattcaagatcttaagtcccaagactttttcttgctcatccgttactgtggctttaaacgcctttccaaatgctaatgcgtttgaaatttatagctttatttcagatttaccttctgagctccgggcaactctgagctgccctcttgaaatcaccacttgagtgactcacagctttttaaaactgaaatgtccaaagtggaagtcttattcttacctccatatcctgtgtgccttttagtcttctctccatcctagtaagtggtatgatcatctagtaaatttttcagatctcaagtccttcaagaggcttataggttcgcatgtagtgtggccttatttacctctctagccttcatgccaagcaatgtcaaggaaaaccagaactggacagtaagtgtagtaaaaaacagaccttatccagcaactgttgcagtaggggaaaagtgacctcggtttaggaccgaactcaattctgaataaaaaagaacaagttgggatttatagccaaggagcaggctggggatcagtggatggaaaattactaaaaggaaacatcagatgtagtgggaattctggttaaacagacttaataggattcttgttgaaagcaggatgggatgttcagacacaaagggtggggactgaggaatttaaggtgagggaggtttggctaaacccacttgatagaattcttgctaaaactgcaatgaaaagatgaacagacatggaaactcaaaggttaaggcataaatgggtggaggattcagaggagcctaagtttggtcaaggatggtctttgttagtggtcactatactccagccacactggcattttcccccaaaagtgccattttcctccctgcctctcatgtcctttttttctctgttaagaatgattccttggccaggcgcggtggctcacgcctgtgatcccagcactttgagaggccaaggtgggcggatcacgaggtcaggagatcgagaccatcctggctaacacggtgaaacgccgtctctactaaaaatacaaaaaattagctgggcatggtggcaggcgcctgtcatcccagctactcgggaggctgaggcaggagaatggcatgaacccgggaggcggagcttgcagtgagctgagatcgcgccactgcactccagcctgggcgacagagccagactccctctcaaaaaaaaagaaaaaaaaaaaagaaaacccgattcctcttattctatcagctaaattgtattcattcttcatatctcactacatgtcgcttccttagagatgccctccctgaccacccaatctatatctccctcataattccctgttattatggatagtatccaattgttttccttcatagcatttaccatattttaagatggtaatttggttgttaatttgatacctctttctcccagatgaattgtaactctaatgaggacagagattatatctgtatttatcataaatatatacttagtgcttaacgtgatacttggcacatagcagatgctcagacaatcagttttaatgcaaaaggaaacccatttaccctcttgatggctgtggtgcatgtgctactgcagcttcttgaagattaagttgactcctaagagccatgaatgaaaatctgccttgttacaggaagttatttaaaataagtaggattttaatgagcacatttttttaaaataaatttctcttttaggccggtattttattactttttggttgaatctaattaagtgaggataattgcagaccatgcattcagcaagtcagttttttttcctttagctctttctttgttttcttttgtcagtaattctaaaatttctcacaggatatttttgtttagattaaataacagacgaaagagttttaattttctttgtacggatactttgtatagattgtgtaagtcacagtatttgagataattgctatttaattgcctctactttcttgccgttactatgttttattcctttaaagatatggcttcaatgattttgtatcttttaggccccatgtttgacaaacattgctgtcttctaaaaattggaggtcttaaagtaggaattatgtggaagtgcctacttgcttggaatatttagagctctcactaggaccttgagtcatatgactagcccttgactaaccaaaccctttaatgtgacagattagaagttttctaatacaaatcgactcattgcaccaactaataagaaacacaaaatttaatcaaaaattttccccaggtgtttttttctccttttgaaaagaagcattggaaaaagtgtgtgtgtgtgtgtgtgtgtgtctgtgtgtgtgtgagtaaattttctcctaacaaagtgcattttaaaatttgaacatgtggccagagacataatttgaaggaaggaattacatacgtaaatacaattttgaagaagtaggagactaaaactaaccttgaaagaagcaattttttgtcatttcagactgcaaagtgtctccaaagacatttcaaaaaaattactggtgcctccattagtgctttttggaaatactgattcatcatgggggtaatagttggcagagacttgtacagcttacaaaagagacttgtacagtttactaaaaataaagaccaccttctgtgatcctttacttagaaaaattatacatcctgttaagcttattgttatttaacctcccccaatattcttaagaaattagggttcataaatttatatattactggcactaaagggtaataccaggtgaaatcattgtatttatagaatctactaaattcttagtttctttttttctactcatttatcaaatgcctgccatgtttaaaacaatgaccttgagaagatgggatgaggaaggtaaatatttttgagaataaataattcagtagataagttgaccaattccactcatatggaggtttcctagatagttgcctctattagaaaaatataagacttataattacagagaaaatatcaagtgttaaatgctgtagatacagggcatgagtatttcaagcatatttctgttggaatgatcaagatttatttaatagggtaattgattctgcagtcaattgttctgcataggaacataaacaactgcaaagaatgggaaggtagattttagagaatgttgaatcgattaacatatctattattttaaaaatgtttattaggaaactattcaaacacagagaagcatagagaataatacagtagacatttatgtaccaaccacctagatgtaaccagtgttgataatgtactgtagttgccgtttcctcccttggtagtagttctaaaatcagtttgtatccttcccttttcttttctgtttctatagttttaataaagataaatgaatccataaacactgttagtcttatattttgtctttttaaaattgacatcaatgctaacatactagaggtatcatcttgctttatttcactccacagttgttactgtggagatgtgtccaagttgatacaggtaactgtatctcatttatctaaactgaggcatagtagttcatctttttataagactgtgttgcttatcaagtcctagttacatgtatatcatacttttcttaagtaacagcattgtgttagaatatttacattatgctgttgatttcagaaatagattaaatttgtttttgttatttacttttttttcaggaaatccttgcacgaggaattcttcttccattaataaatcaactcagtgatcctgattatattaatcagtatgtcatatggatggtaggtgccttttaaaattacaactctgttttagaaataatttttgaaatgtaaaaatatagttgggagatagggtgtttaagcagtaatttattaaagaaattaagtaaaaatgtttctgaagtaatctctgtgtttccaatatttttatttgcttatattttgaatgtgttggccaaattctctttaagaattttgttgattatcttccttgcggttatggtgctactactatttctttaaaaaaatagaatattttactacctgtgtctatagatgatgagtatttttaatggctactatttgatttttaaatacaacttgggatttgaactacttgacatgtaactcacattttatactgtataatggggaaaatatggaggacagaatagtagaatgagaaccagaagatctggattctagatgtttctgtaagttgcctagtgtctgtagtagttaactcaatagttttcttctgtcagacatatcaaagacttagttattactaagtccacaagccctatttttttttctttataatgtatccttttccttaataaactcatggtcaaggaagaattgtaaatgggccaccttctgggaatactttgatacctacttctagatctttgatttattttcttaaatctgggatttctactctacatttgtcttcctttaactcagtgtagctttcttaagaaagaattacttgattgttctttgatttcccttaggcattgtcagacttgccattgttttatttttttttttactttatttttatttatttatttttgagatgggatctcactctttcatccaggctagagtgcagtgacaatcttggctcactgcagcctccgcctccttggctcaagtgatcctcccgcttcagcctcccaagtagctgggacacaggcatgcaccaccacatcccgctaattttttgtacttttggtagagacatggttttgctatgtagccctagccagtcatgaactcctgagctcaagcgatctgcctgcctcagcctcccgaagtgctgggattacaggtgtgagccattgtgcctggctgctgttgttttatttttgttgttgcaaaggtttacccttcgaccagattgtagtacctgcagacaaaagttgttattaattgtgtacttctggagcctttcctggagaccatggaacttgattcttcttttcctctgtgaacttttttagactttgcattaggcactataaaagctttgaaaatacacatatctgcacaattaaaactataaaaaagtgagtctcctttggctaggaactcctaagaagttattttaaagtgataatcaaatttgtgacaatctgtatttaaaaattttaacaagtttttaatttttaaaaattatggatatgtaagagttgtacatatttatggagtacatgtgatatttcgatataagcatacaatgtataatgttcaaatcaggataattggggtatccatcagatcagcatttatcacttctttgtgttaggaacattccaattccactcctatggttattttgaaatatacaataaattattgttaactgtagccaccctgttgtgctactgaatggtagatcttactctttctgtctgactgtgttttatacccattagccattccttctttatttcccttctcagcatctggtaaagaaacattatttgacactgtatctccatgagttcagtctttgttttgttttgtttttagttcccacatatttggcctgctgtgcatggttaatttgacttaacataatgtccctcagtcaatatttcattctttttttaatggctgaataatattctattttgtgtatgtaccatgttttctttatccatttctttacatacttgcaagcatttgttattgcctttcttttggttaaaagccattttaactggagtgaaatagtatctcattgtagtttgtatttctatgatgataagtgctgttaagcattttttaataacctgttttccatttatatgttaccttttgagaaatgtctattcagatctttttgcccatttttaatgggattctttttttttttttcctattgagttgtttgagttccttatatattctggttattatttctttgtcacatgagtagcttgcaaatattttctcctattctgtggattgtctcttgcctttgttgatcattccctttgctgtgcagaagccttttagcttgatgtgatctcatttgtacatttttgctttggttccctatgcttttgaggtcttatgtaagaaatctttgcccagaccaatgtcatggattgtttccccactgttttcttctagtagttttatagtttcacatcttagattgaagtctttaatccattttaaattggtttttctatatgctgagagataggggtctagtttcattcctctgcgtatcgatatccagttgtcttggcaccatttattaaagtgactgtttttttccccaatgtgtatttttggcacatttgtaaaaagtgaatttactgtgaatgtgtgggtttatttctgtgttctctattctgttccattggtttatgtgtctgtttttatgccagtaccctgctgttttggttactgtagctctgtagtataatttgaagtcaagtaatgtgatgtcttcagctttgttcttttctgcttaggattgctttggctattctgggtcttttgtggttccatatattaatacattttgggattattttttctatttctgtgaaaaaggttattggtattttgatatgggttgctttgaatttgcagattgctttttgtactatggacattttagcaatattgattcttccaatccatgaacatggagcatcttttcattttttttgtgtcttattcaatttcttttatcagtgttttacagttttccttgtagacatcttttacttccttggttaagtttattcttacgtattttatttgtgattatatgggattacttttcttgttttctttttcaaattgttcacatagaaacactattgatttttgtatgttcgttttgtatcttgaagctttactaaatttgtttatcagttattttttgttgacttgtgttttagtcatctcactaaagatatgagtggattgtacaccacagttgcagtattattctgtagttgtctgtgtacttagtatcaatgagttttatactttcaggtgatttcttattgctcattaacatgcttttctttcagattgaaaaactccctttaggatttctagtaagactcatctggtattgatgaaatcccttagcttttgtttgtctggccaagactttatttctccttcagagttgacagataaatttgcaggatatattttaggttggaagacatttttttttccttcagcactttgaatgtatgaatgatcccgctccctcctggcctgtaaggtttctgctcagatgtgtgctgccagacgtatcagagctcctttgtgttatttgctgctgctgctgctcctcctcctcctcctcttcctcttcctccttccctttcttccctttcccctcccccttctcctccttctccttcttttccttctttatgcagcttttaggactctttatttatccttgaccttggagagtttgatttacatgcctttggtcatcttatttggattgaattttattggtgtttttcgaccttcttgtacctggatattcatgtttttttctgggttttaaaagttctttgttattatttctttgaataaactttttacccagtctctctctttacatcctctttaaggccaataaatcgtagattagcccttatgacactgttttctagatcttgtgggtatgcttcatttgttttcagattctttttttctctatgtgttttcgtatagcctgtcttagctcggttcttccttttgctggaccaattctgctattaagatactctgattaatttttcagtttatcaattgaatttttcagttctagagtttgtttattatttcagcctctgttaaatttctcaatagaattctgaattccttctctttgttatcttgaaattctttgagcttcctcaaaacagctcttttgtatttcatgtctgaaaggtcacatatttccttcacttccagagtggtcattggtgccttatttagtttcttgaggtgatgttttcctggatgttcttggtgcttgtagatgttcattaatgtctggacattgaagagttaattatttattttaatcttctcaatctgggcttatttgtaccatccttgttgagaaggcttttcatgaagtcaaaagggattgaatgttgtaacctaagcctatggtcactatgctatttcagcactagtgggatccctaagcccaggaatactgtgactcttggagactcctaaatacactgccatgatgcacttcagtaagataaaggagaattccctaggttaccagacaaagtctttcatgctcttccctctctttctcttaattacaaagggtctgtttctgtgtaatgctgcctagagttggggaaacagtgacatggacactgtcatggtcaccatggctggcaccgtgcagagttgcacctcaaaccttgcagagcagcacagtactggggcttgcctaacgcctgtggccactgctgcctggctgctgctgctatttattcatggcccaggaccactttagtcagcagattgtgaattctgctagggactgggtctgtcttatcagggcaacagcttcccttctggccaagggtgggtctagaaatgctgtccaggaggaaagatgtatattcttgggtttcagcaatctgcctggtttttggttttactgcggctgagctgttacctaagttttaagacacagccctctgtattcctccctttccttcctctgagtggaaggagtctttgctggagttacactgcctggaagtggtggagggatgacacagacactctgctggccaccatagctggtgttacactgggtcatacccgaagtctactgaccgctgagaagagtgtatgtagcaccagggcttgccctaggactgcagtgcttgtggcctgactgccactcatatttatttagtgccccaggccatgtcagtcagcgcaagtgaagccacctggattcgagttattccccctgagctgagaattctgctctggctcagggctggtctaaatgctccttccctgggtgctagtggaattctgtcctgtgctgtgacagagcagttctcagtttcaaagcagagttctatacttacttcactcttcctcccacaagcccacagattctctttctgtgctgtgctgtccagggttgaggggaggggtggtggaggcaatacgagactgtctttcctacccttttgaatgccactttccttgatattatgctcaaaccgggtactgtgatcactcacctaattttatggttcctatgaaggtgcatggacggttatttaatatggtgttcctgtggggaggatgatcgctggagggctctacttggccaccttgctcggcctcctccaataatgtatatttaagaccgttcatagcagcattggttatagtagcaaaaaatggaaagcaacttaaatgtcccaaataggggattagttaatatataataacacattgatacaattgaatactatgtaaccatttaaagtgatgatagtatatctttatgaacttgaaaaattgttcatatcttttgcatgaaaaagataactaaaattagcatatatgttagataaatatcccattctttagaaaaatatacttattaatgactgtaattctcataggatatacactgaaatgttaatagaaaggtagtaatttttcttttttatgtatttcatttcacttgcaatgagtatggattatgtaataaaatagtatgtttttaagcggtagaaacttacatgcaaaatttataaacatttaagttaaaattcaggcagggtaaataataataaaatttgtttagtagtacagaaaatggatattgtatactaaacttaaataatcaggatataattattaactctggtccaaaaatggaagcaagttgaacagaatgttatggttatctctcactcatgggattgggaattatttttattcccctctgtctctatacagatattttttagtgttcagttttctgtttctgagcatgtattaactgcattaactgtaattacgtatatagtaaaaacattttggagtgggcttagcctatattctaaaaatatttcaaactgttgggggcagcaaatagctgaattactgatggttctgcagaaacctcacttcttgcctcctcaagaaagaatttgactgagagatgtgaggcataaaaagagactgaggtaagtttcagagcaggagtggaagtttgttaaaaagctttatagcaggaaagaaaggaaagtacactggaagagacccaagtgggcacttcggaggtcaagtgccttgtttaaccttgatcctacgattttatgtactggtccacttctggcatcttgcatcccttttctcatgattcttccctttgggtgggctgcccacatgcacggtgccctccttacacttgggaagtgagcacacacagtgtgtttaggaagttgtacacatgtccatctgagactttcttcacttttctgggggcattccaccagaaggtcatactctgtcattttgtctctcaatgcacatcctcgagctcacttgactatttcctgagattttattggaagctagttaccaatttcaagtgtttttatctgtttgggaaattgccactttctggtgcctgtgaccaatgattacgttagtgtgacagctgtggaccatcaggaaattgcctcttcctggtgtgggctgcgaattatttttgcagttatcacactgtgtgtgtgtgtgtgtgtgtgtgtgtgtgtgtgtgtgtgagataactgtatgtgtgataactgtatgtgtgataactgccaaacccatcacctgatggctgcctgacatttctggcaggggcggggtgaaaggggtgctctcctgctgaacaagaatgcagtccctattgtactgtgcaacaaaatatcaggaataaaaatatctgtgcatggtggtgcatacttgtggtcctagctactccagaggctgaagtgggaagatcatgtgagcccaggagatcaaagctgcagtgagctgtgattgtgccattgtactccagcctaggcaacagagcaagaccccatcacaaaaaaaagacacaaataaatggaaacacatactatgttcatgaagtgacctaatattgtaaagacagccatactgcccagagcaatttaccgattcagtgcaattcttaccaaaatcccaatgatatttctttgcacctcacccttcctgatttcaaaacctattacaaagctacagtaattaactgtatggtgctggcataaagatagaaatgtagacttagtggaacagaatagagaactgagaagtaagttctcatgtgcatactcaaatgatctgcatagatttgtatcaaggctacaaaatgggaaagaataatctcttcagcaaatggtattgggaaaacaggatagccacatgcaaaaggatgaagttggacccttaaccttgccctgcatgtaaaaattaactcaaaatggattaaagatctgaaatgacaaaactcctagaagaatatgtaagggaagagcttcttagatttgattatgatttatttgatatgataccaaaaactcagacaaaaataacagcaatagagagtgggagtgtatcagactaaaaaactgcccagcaaaggaacaatcaccagagtgaaaaggtaccctatacaatgggagaaaatatttgcaagccatatatccgattaggaattaacatccatcatatataaagaactcatactactcaacaacaggaaaaagaaaagtatttaaaaatgtgcaaaatagtgtatctccacagaagttatacagatggccaacagtaatatgaaaagatgtgcaacatccctaatcattatggaaatgcaaatcacaaccataatagtaaatgaattatcttacaaccatttggtcactattaaaagaaaaaaaaacaaaatatcaggtattggcgaggatgtggaaaaatttaaactcttgtgcactatcgatggaatgtaaaatggtgcagacactttggaaaacagtttggaggttcttctcaaaattgttaccgtatgatctaacaatcccacgtctaggtctctatccaaaagaattgaaaacaggatcttaaagggaaatttgtgtaatcatgattgcagtattcacagtagccaagaggtggaaataaccttaagtgtctatcaacagatgaatgcataaagagaatgtggtatatacatacagtaaaatattattcagccttaaccaaaaaaaaggaaatcctgtatatcctacaacatgatgaaccttgagaatactgtgttaagtgaaataagcttatcacagaaagacaaatactgcatgatccctctttgagtagtcaaactcttagtaaaatgttggttgctgggatctgggaggagagaaccaacaggatttgttgttcagtggatctagagtttcagttttcaacataaaagatcagagaactctttaaaaacaatgttctaatagtttataccactgttaacttaaattgtttaaggtgataaattttatgttttctgtttttgaccacagtagaaaaaagaatgaaatgaacaaattgtctttcagagttgtattataattttgcctttccagtagcagtattttacagttctggtctttccacattctgattaacatttagcattgtcaatcttaaattttaacttctctagtatgtgtgaattggtattttgttgtagttacttgcagtttctttattactaatgataccgagcgtcttttcctgtgattattggcctgttttgtatcttttttcaagtgctcattttctccccgtttatcttttttaaattgataatgtaagaatgcttcgtatattctacatagaagttctttatcagatatatgtattgcagatattattccctaggttatgacttggtattttttctcgttcagtgatgtcttttgatgacaattttaaagttttgatgaaacgtaatttcccaatttgggttccacagctagtatttttttggtcttctctaggaaatccttgtttgtttgaagattaccaagttatttgcctatgctaagttttataatttttacttttatattttgttctatgatttatctcacatttttatgtgtgtggaatatgacagtttagattgatttttaaaatacagacatctagatattctagcaccatttgttgaaaagactttttcataaaattaatttccttggcaccttactaaaatatcagtttgctctaatatgtttggttctgattctggcctcttcttttctgttgctctctttgtgtacccatatgcaaatatcatactttctgattactttagctttatcgtaatattgaaatgggacagtatgagtctcttacacttgttctttttctctaggattgttttgactatttttcacataaaatttatcaaacgtttagtttttattaaaaacctattagaattttaactgtgattacattgaatctatagatgaatttaggaagaatggatagtttaacattttgtcttcttatctaggaacatggcatctctccatttattgaagcctctgtagtttctctcagcattgttttgtaatttttagtgtttatgtatctttcacatttttaaaataaatttttataaatattttatatttttgatgctgttataaatgtgatttgtttcttgatttatttttcagattgtttactaatgacaaatggaaatgatactcagtattatatgttgattttgtattctgcaacattttttggaatctttaggtttttctaaatggtgttcatgtggtctgcaaacaaggacaaattgactttttcctttccaattaggatactctttatttctctcttgcctaattactctgggtaggacttctagtactaggctgaataaaatttgtaggagtaggcatcctttttctcctggttcttaaaggaaaagcttttagcttttctccactcaatatgatgttaactgtgagtttgtcatatatggtgtttaattgtgttgaggtattttccttctatacctaatattttgagagattttattttgaaggcatgttgaattttattgaatgccttttcaacatctattgaaatgataatgttttttgtgcttcattctgttaacatcatgtattatgcttatcgattttcatatcttgaaccattcttgcatttctgtgatgaatcccacccacttaatcatggtgaataatctttttaatgtgttgttgaattaagtttattagtattttttttttgagatggagtcttgctctgtagttcagtggcgctgtctcagctcactgtaacctccacctcccaggttcaagcaattctccctgcctcagactcccgagtaactgggattacagatgcccgccagcatgccctgctaatttctgtatatttaatagagatgaggtttcaccatgttggccaggctggtcttgaactcctgacctctggtgatccgccacctcggcctcccaaagtgctgggattataggtgtgagccaccgcacctggccagtttactagtattttgttgaggatcttgacatctgtgttcatcagggatgagcttgtagttttctttttttgttgtgtccttgtctggtgttggtgttagagtaatgctgggcttgtagattgagtttcaaagtattccttcctctttaatttttggaaacattgaatagaatcaatattagttcctttaaaaatatttggtagaatttagcagcactgaagccatcaggtcttgggcttttcttggatgggatacttttactactgcctcagtcttattactcgttactggactgttcagattttctatttctttatggtttattgctggtaattttatgtgtgaggaatttattcagttcttctaggttttccagtttgttggagcataattatttataatggtctctgatgattctttatatttcagttgtatcagttgtagtatatccattttcatctctgattgtattttttttggtgcctctttttttcttagtctagcgtaaacatttattgcttttgtttctccctttaaaagatcacttttcaactcaatcttttgtattgttttcttagtctcaatttcatttatttttgttataaatcttaatttggggtttggtttgttattgcttttctagttccttgaggtgaattttctttttctttttctttttcttttctttctttctttcttttttttttttttttttaagagagtctcactctgtcagctaggctggagtgtggtggcatgatcacagctcattgcaacctcaaccaggctcatgtgatcctcccaactcagtttcacatgtagctgggactacagggatatgccaccatacccggctaatttttttattgttttgtagagacagggtcttactatgttgcccagctggtcttaaacttctggctcaagtacccctcccacctcaacctcccaaagtgctgggattacaagtgtgagccatatacctggcctacattcagctgctctatgtcttttaattggagaatttagtccacttacatttagtgttactactaataggtaaggaggtaactattttctagttgttttgtaacttcttggttccttcttactgtcttcttttgtggttaagtgatttttctctggtagtatgttttaatttcttgctttttagtttaactattacaggtttttggattgtcattaccatgaggcttacaaaagataccttaaatttataacaagttattttgaactgatgacaaattaactttgattgcaaagaaagaaacaaagaaaattgtaaagaactttaaactttaatcctcccacattttgacttttattttcagtttacattgttgatattgttcagggtccacttctaattctacttctcttgccatttctaccacatctgtggtgacttccttcactgaagtcttgaaccccttaaagtcatctatgaagattggaatcaactgccaatcttctgtgaatgttgatatttgacctcatcccatgaatcatgaatattcataatggcatctagaataatgagtcatttctagaaggttatcagtttactttgttcagatccatcagaggaatcactatctagagcaaatatccatagccttacaaaaaatgcatttcctaaatagtaagacttgagaggtgaaattactccttgattcttgggctgcacaatggatattgttttagtaggcatgaaaacaacattgatatccttcatcagagctctggggcgaccaggtgtgttgtcagtgagcaataatattttgaaaggaatctctttgtaagtggtacatctcaacagtgtgcttaaaatatttagtaaaccgtgttgtaaacagacatgctattattcaggctttcttgttccatttctggagcacaggtagagtagatttagcataattcctaagggccctagaatttttggaatggtaaatgagcattggcttcaacttagagtcactactagcctctaacaagatactcattctgtcttttgaggctttgtagccagacactggcttttactgtctaattgtgaaagtagtagatggcatcttttctccatataaggctgttttgtctacagtgaaaaatctgtttagtgtagccatcattatcagtgatctagactaaatctggatgacttgccgtatagcttctacatcaggacttgctgcttcaccttgtacttctgtgttatggagacagcttctttcctcaaacctccaatgtctgctagcttcaaactcttcttctgcagtttccttacctctatcagcctttatagaattgaagctagtccgggccttgctctggaataggctttggacaaagggaatgttgtgtctggtgtgattttctgtcctttaccactaatactttctccatatcaccataagtgttcttcacatttatcattcatctgttctggagcagcacttttaatttccctgaagaacctttttttttattttttgcattctcatattggataattgtttagtgcaagagaccaagctttaagtctgtcttggcttttgatacattttcctggctaagcttagtcatttttagcttttgattgaaaatgaaagatatgtggctcttccttttgcttgaacgcttaagagttcattgtagggttactaactgttctaacttcaatgttgttatgtgtgagttaatagagaggccctactagagggagagagacggaggaatggtcagttgtggagctgtcagaatatacaaaacaatttatcaattaattttgtcatcttaaatgaggattgttttgtagtgcaccaaaacaataatatcaaagatcactgatcaccatagtagatatagtaataatgaaaaagtctgaaatattctgaaaattattaaaatgtgactatgcacatgacatgggcacatgttgttggaaaaaatatgctggtaagagtttctggacacagcgttgctagaaaacttcagtttgttaaaaaaaacacagtgtgatgtgtcatagtcaagcacagtggaattgaaacaaggtattcctgtattctgttttattgttttaatgactttctagctattccttgttcctataaccattattattttagtggttgctctaggaattagtgtcctctttaagttgtcatcatatgcctagagggcagtactttatcacctcatatgaaatatgaagaaccttgctgtagcataattttaattagcccccatcctttgttctttttcattatatattttacatctgcatgcataatttactccacagtgctatgcaaattgttgcattaaacaccctttcttaaataaagaacagaaaaaaaatcttttacactcatacatttacttagtgttttcagtacccttcattcttttttgtaggtacaaatttcagttttgttgtcatttttctttattttgaagaactttctttaggattctgtgtattgccaattttcttttcttttttctttttttttctttttttattttttttggagatggattctcgctctgtcgcgcaggctggagtgcagtggcacgattttggctcactgtaacctccgcctcccgggttcaagcaattctctgcctcagcctcccaagtagctgggattacaggtgcccaccagcatgcctggctaatttttgtatttttagtagagacggggtttcaccattttggccaggctggtcctgaactcctgatcttgtgatccacccgcctcagcctcccaaagtgttgggattacaggcgtgagccactgtgcctggcctattgccaattttcttgtgacaaattatctgagctttttattctctgaaaatattttcatttactgccaagtttgaaggatatttcattgatgtagaattgctgtatttttttcttttagtactttaaaaattgttttattttccttttgcctctgttgtttctaattagaagtcaacttccactgtataattgatcccctctatgtaatgcatctttttacatagtcttgtacttttacagtattcagttatttggctttttgtttaaaatagataacatccgaagtctattaccttttcatagcccactcttcctgctttgcttagtttaaattttatttacagtcatagttattaatccctctacaacatcctgtacttctttacctctttaactttatttgcttattgacaccacaacactggttaaatccaacataactgcttctacattcctatttttaagcaggtgaatgtggttgatgaaaaaaaagaaacctacactggtctcattttaaattcatgagcactcatctcatttgtgcccttattcttgccttgcaatcattaaatttttcctgttatgttacctggcccactcttctgaccaactcttttatacttccttcactttcatttaatatattttttcacatcttttctcttagctcatgaccatagttctccactgaaaaattgaggaaattgaaagagatgtttcataatatcctgttaccacgtacattcataacctgtatctatgcatgtatattttatattttcttctgttactgtggatgaaatatccatgtatctagctaaagcaagtcctttatgtgagcattgtaaccaactccttctagacaatttcattttattgctttggcaattttacactttctttctgtaccatcacattttcactctttatatgatcattcttattatcatacacctttgtcattatctctctcatcttaaaaagaagatgaaagaagtcattgatcttacattccattttaggcagtactctttactcctgcttattttttttacagcaaaactttataagagggttgactgttggctgtctacattttctctctgctctttctttcttgaactcctccaataaacttttacaagtcaaagagaataatccccattgttatggtcaattcttagattccttatttttgttttacatctatatgaaatgcttgacacagtttatcctcttttcctctcttctcccctcccctctctttttttcttttcttttctttttgagacggaatctcactctggcgcccaacctggagtacagtggcacgatctcagctcacttcaacctccgcctcctgggctcaagcgattatctcgccttaccttcctagtagctgggattacaggcacctgccaccatgcccagctaatttttctatttttagtagagacggggtttcaccatgttggccaggctggtctcgaactcctgacttcaggtgatccgcccgccttggcctaccaaagtgctgcgattacaagcactgcacctggccgtcattttcttttttaaaacacttctttacttggcttgttagaacaccaaagtttgttgattttttttcctacgtttttggcctttctcagtctttttgctgtgtaagtaaatcttctgagtatctgtccttagatctcttcttttttcactctaccctcattctcttgattattcccatccatgttcatggttttaagtgtcatctccatgtcagtgactttaaaatgcgtatttctgtgtagtcttcctttctgaactcttgtccatcatattcaaaagcatactaatggccatttttatatttaatgggatctcacacttaattttgccaaaaacaccctcataatattttgcctccccgactccccgccccccccgcccggcaaatgctgcatctcttaatttttttctccatcttgtttagtggtaactccactattccagttgtcaggccaacgatgttagtgtagttctatgttctctttatttcacggccatgtctgatttatcagcaaattcttttggcattgtctttacaaaacccgtcttaccagaaaacattctataaaacactttgtaccacaccaccattgtcaccaccctgctccctgactatattatatttcacttgtcttattaactggtccttttttctgattttggctctgcctttattctatttttatacaacaacacagtggttgtgttatattttaggttagagagtgttactcttctgtttaaaccttccaatataacttctgacttgcttcagagtgaaagctaaaacctttgtactataacagaagatttgccctccattgctgctgaccatatcttttgctcagtttgtctttggtttagttccagtcatcatggcttctttgctatcatcaaatactgtgagcatgttcctattcctacagtttcaaacatgctgtataatactttattttatttgcagtctaagatccattggaaaataggtgcccaaatatagaacttttttctttttgttgtaagcactgagtatgtagcaaattgtcctagcacatagtaggcactcaagattcagttttccttttcataagtgagttcctctcccacctgtttttcttaaacttgttttcagatccgtgattctaactgcaactatgaggcctttatgaacattattaaattgagtgacaatattggagagctagaagcagtcagagataaggcagcagaagaattacagtatcttagatctctagatacagctggtgatggtaagtaatgtatttaatttaagatatatttttttgaagtattattttatcttcaaaactttgattaatttacctaaatgtcattttctgatattaatgttttcaccttaattaaatcttccttattaggttaacatgtgcttagttaaagtaaaagcattattttcagaatgtgagaatgtgattattgtaattatccctaaagtggaggtaattggcatggtttacttttaattaaataatttcactgtataatttcagatggtttcttttattgactaaaacagttgctgtattattggttattttgttaaattacagtaagtgcatgtttaaagtatttcataaataacactaccactttctagttcatgatttctttgcttttagatatcaacactatcaaaaatcaaataaatagcttactattcgtaaagaaggtatgtgactcaagaatacagcgattgcagtcaggcaaagtaagtaaagtagttttgaattaacgtttagttataaatactatactatagggattaaaaatgcacagtaaaggacaaaaagcaggacgtttaccagtgcagcactttacaagaggactttaaaaagagttttctcttctacaatgtgatataaatatttgttaaaacatgccaaaaaggttaactaaaatgcttcctgaaaaatgttaaagtaattgaagattttattttattccttgatttatttatacatttacttgtgtatcatttgtttattcaaaacttacatttattcagttttgtgagttgggtactttttagaagagccaagcagacagactcttttcgtggagtttacattttagttgcagagtcaggaaataaaccaataagcaaattgacgcgtaatatcaggtggtgatatctactgcaaaaaacagtaataaagcaaagtagcgtatagagaatgtcttggactggtttagataggttccaagaggttcgatgacacttgatcatagtgagatctaaataacatgaggcagttagtcctgtgatgtatttttgtttgcctttgaagtatctatcttagaggcagtcatgagagcaaatgcaggggcactaaagtaagaatgtccttggtgaattggaggaggttgttgtggttggtatggaatgaatgagctattgtgctaggaatgaagtcatagaagaaccggggggttagatcttatatggtcatatatggtcttagtggccatagtaagaattttattttattctaattatgatgaaaatcaattggagatttgccctgacaagtgacattacctgacttacaagctaaaagttaaaattattatctttactctttgtggagaatagacacaaagtgtgagatgatgggggtaagaatggaaactgagagattatttgcaatactcctgatttaaaactagataagagatgtctatggaggttgtgagaagcgattagagactggatatagtgctaataggattttcttaatggagtgaatatggggtgagaaagaaaaaataactcaaggataatttcagggtattttggtttgagcaactgtataaatagtggtgctgtttactgaattgggtaacactgagagaggaggaagtttagaaaagagaattgagttttgggtattttaatttgagatccctgtttgacattcaagtagacatgccaattggcaatcttgagttctaaggaaaagttagtgatggagatgaattttgtaaatcctcagaattatcagatgtttaatgttgagagcctggatgatgttatctaaaagagtgtgtgtaagtaggaatgcactggtgacttggtcctactacacttcaatgaacagagtttaagacaaagtaaagagtctagccaaagaaacagagtaaatagccagtgagattgcaggaaaacctgagcatgtgatattgaagcagggtacttccctgaccccttcgcaggacttgcaacaggggtgtcttgtttactgctcagcctgctgttctcaactctttgtggtggggagcgcgtgagcaagccagtgggaacttgagtgaaggagtgctggaaccagcctgccacttcggcactggcgggatcaaactccactcactcggacccactgtattccacccctcgcgagagggagcacccaggtgagtgggtggaggaactggccgatgcattagcactggcaagagcaaactctgttcaggccctacagctgtccagtcagaggtgcctgtgactcccaaagccctagaaggtgtgttacagcgctctcttagctctgctgtctgtggatggcttaagggttaacagctcagtggaccatttgcctttttgcatgaggcggctgcccttcatcagtgagggcacagggccagtgtgaaagccttttgtgtgcacactcgtggcttctgagctcttactcggcgtccaggaaaaatgaagtcacatgaatgagttgaaagatggtaaatgctggagactttatggccgatgaaagtggttctcagtgggaaggggagctgaaaaggggaatggggcgggtaggtaatcttcccctgaagtccggctgtctccatttggattctttccgaagttatgccatcaagctgtccctctgaagttgagccgcttctctccaatgtccagccgtagtcccggctaccagctgagtctcggttttttataggcacaggatggggtggtgtgcggccatgggtggtttaggaaaaggcaacattcgagcaggaaaacagggatataaattctcatttaggactgtgggctcaggctttttggcttgagggggtggtgtttcgccagggaccacccttttctgcctagaattttgtgccccctgtccctaataatatctcagaagccaaatgttaaaagtgtttataaaagggaaagaagaggtgtatcaaaggataacgtggagaaagatgaagactgagaattgaccattggacttcctaccttctggattattggtgatctgatgagagcattttttgtggagtagtggagaaaaatcttaattggagtttgtccatgagagaatgggaagaggtaaattagaaacagtaacgatagttgctctttagagaagttttgccctaaaggagagcagagatttggggctttaaagcaggaaaaagcatttcttaaatacccttaggtttttaatgaggtcacatttttgctgtggttttgttttgaaaatttatttgtgagtctctggtcttataattttacagtgtatttaaactccttaaggaatagaagaattatttttaaaaaccgtggtggcatatgcctgtaatccgagctactcgggagactgaggcaggagaatcacttgaacctgggaggcagaggttgcggtgagctgagatggcaccattgcactccagcctgggcaacaagagcgacactccgtctcaaaaaaacaaacaaacaaacaaaaaaacccttaaatttagttttctaggtgaattataacttaagaaacattacttgaggcccatatttgttacgtgtgtgtgtgtgtgtgtgcacctttgttttggttaactttattttaaaactagtttatatactcgtgcaaatgagcgtagaagaaagatacggtttcacttgtgcttttctttaactacttccttatctagatctcagaggtagtgatctttcagcgtcattactcagtgtatttacccaggcactttttgatattgaatccttttaaaatttagatattttgtttgcaagcctgtcaattccattttgaatacaagctttattttttaatgagctcagatcatacagtgttttcctttgtaagtaaactcagaatccccacggatttgcagttatatagccatgttacttatcttgaaatcttagaaacctttatcctcagcgaattttccttccatcctgtatctgtggagccgctgctgggcaggagaaagaggtgatacaatttgaagaagggagacttagtaggaatcatgtgctgcctctagattgctctctaccagacatctaaagtcagttagctgttattattcagtacttacatgaaggaaaatacaaattatagagatggatttgtttttttttttaattctctacattttcctttatttaccacctatgcttaatttagtatctgcctctgaatatggcagcctacttcatttacagtaaacctgcctatctttcttttttaaatagagggttctgaaatatgaatttgggaatatagagaagccagtgaaaataaataattcatggaaacatcatggctcttattggaaagggcagcagcatttgaaaacatgtagtcatacttaccggctttgtgacttaataggcaacctttttcatcttcgttttccttgtctgttaagtagacgtggtgatacatatccaacaggattgctgtgcggattaaatgaagtaatatctgtaatgtaactagcccaaagcctgatacgtagatgctctttaaattttggacgcaatttttccctttttttttttcatatgtaggttgtttccttgctctgtgactttgaaaagtatgtctgaaattcactgtttagagagtctggaaaaaaaacacattttatctaataattagagattttactgagttaggagcaaaattactctttaggcatattttgttttcctagtagtaaatagactttatacatgaaaatgttgagtttttaaaattcttgcgtatattaaccatttccttcacccttttagcctttggaatgttcattttcatttggaatatatagagatagagaataattgaaaatatagtgatttctatttattttatattgaaacagttgaatgctattatttttaatgtgttaatatttttaatttgctaagcaactcttaactaggaatttaaattcacacaatgtatatctattgggaaacaacatgcatgagaagggaaaaacttcatctttactccgttttagcttgatttttttccttatatttatgtacacatctttaacaatgaatgattagataaaatattaacttatattcacttttgcctgtaggaaataaatactgtgaaacttgcagcaaactttgggaaactttgcacagtccccctggacagcattcttgtagacaatgttgcactacaattttttatgggtaggtagatcaattctatttaaatgatacagccattgaatttctttttcgattttttattgtaaaatacacataaaatttagtatctcaactatttttaagtgtatagttcagtgatattaaatgtattcatgatgttgtacagagtctccagaactgtttttatcttccaaaactgaaactctactcattaaacaccaactctctccattcctcacactctcaacccctgcaaccatcattctgctttctgtctctataattttgactactcttaagtacctcacgtaggtggaattgtacagtatttgcctttttgtgactggcttactcacttaacgtggatatgccctcaggttttatccgtgttatagcatatgtgagaatttccttcctttttaatgctgaataatattcgtgtgtgtgtgtgtgtgtgtgtgtacacacacgcacacacttgcttctccccttacctcttctcccctccctccacttttcctaatttctctgcctagtacttccagtactatgttgaaacgaagtggcaaacacaggcatctttgtcttgttcctgatcttaatctttttgttcctgatcttaatctttgtcttgttcctgatcttaaagaaaagtattttgtctttcatcattgagtatattattcactgtgggatttttcagatacagcttttattattttgagatagtagccttctgttcctagtttattgagtgtttttgtcatgaaaatgtgttgaattttgtgatatgctttttgtgcatcaattaagatgtggtgtttatccttcattctgttgtgctgtattagactgatttttttttttttgtatgttcaaccatctttggattccaggaataaatgccaccttagtcatggtgtataatttctttaatatgctgctgaatttgttttgctagtattttatggaggatttttacatctatatttataaggaacattggtctgtagttttcttgtactatctttatctggttctgttttcaggataatgctggcctcatagaatgagttaggaagtgtttcctgtttaattttttggaaaaatttaaaaaggattggtgttacttttctttaaatgtttgatagaattcaccagtaaagctattcaggtccaggtcttttctttattgacgatttttggttactgattcattctccttactacgttatcagtctcctcagattttcaattccttcatgatttagttttggtggattttctgtttctaggaatttttccatttccactaggatatccgatttattggcatacaattgttcatagtacttttagttttgtagagtcattagtaatatccccactttcacttccgattttagtaatttgagtcttttctctttttgtcctcctggataaatgtttgttaattttgtcactcttttcaaagaatcaactattgctttcattgacttttactattgtttttctgttctctcttttgtttatctctgctctaatctttactgtttccttccttctgctagctttgggtttaatttgttctttttctatttctttatgttgtaaagttaaaaagctttacaacataaggaaagatgatttgagattttcctttttgctgtgtcccattagtttggtgtgttatgtttgttttaattaatatttatgtattttctaatttctcttgtgatttcttctttgatccattggttgtgtgagtgtgttttcatgttttcagaggataagtagggtaaataaaaagtgtgttgtttgatttccaaaaatatatgagttttccagttttaattttgttattgttttataattttatcccattgtagttggagaagatactttgcatgatacccatttttaaaaactttatgagactcaatttgtggcccactgtatggtctgttcagaaaatattccatgtgtacctgagaagaagctgtatgctgttgttgggaagtgttctgtatgcttgttaaatctacctggtatattgtgttaagtcctctatttccatacttatcttctgtctgggtctatccgttactgagagtggggcatcgaaatctccaactattattgtggcactgtctctttttcccttcaaatctgtctgtttttgcttcatatattttggtgatctgttaataggtatgtaactgtttataattgttgtattattttgttatgctgaatcttttattaatatataatgaccttatttacatcttaaccatttttgatttaaagtctatttcagctgatactagtgtagcctcccctgctctattttggttactgtttgcatgtgatgtgatttttcattctttcactttcaatttatttatgtctttgtatctaaagtctttgtagacagtatatcattggattgatttttttaatccattctgccagtctctgtcttttgattagaaagtttgatcaatttacatgtaaagtaattatttataaggaaagagttctgtcatcttgttatttgttttctacatgctttatgtcttttttgatagtcttttctacataactgacttcttttgtatttagttgatttttttgtagtgacatgtttaaatttctttctcattcctcttatgtatattatgtagccattttctttgtggttactatggggattacatgtaacatcctaaatttataacactgtaatttgaaattatgccagcttaatttcaaatgtattcaaaactttgctcctttacagctctgtcaccatccctcttttgatgacgtcacaaaactaagtctttacaaattgtgtgttcaaaatatgaactaatagttcttttaaatgagttacttttgtaaattatgtagaaaccaggatgtgcagtaacaaagtacaatatttctggctttcagactgatagttgattttttttaaaatcgtattcgtctttccagtcccatagaaaacaaaaaaatagagttacaaatcattgttaataatactagcttttataattgcccatatttttatttttactgagatatttatttcttcatatgatttcaaagtactaagttactatctagtgtccttttgtttaatttacccttcagcacattttgcaaggcaggtcttatggtaagatgcttcctttgcttttgtttatctgggaatccttacttctctctcattttgaagtatagttttgccagatataggaacttggttgacagtatttttcttttagcactttgaatatcactccatcaccttctagcctccaaagtttcttgaaagaaatctgctgataatcttttggatattttgtatgtgttgtttttctctttctgcttttggatgatttattttttgaaagttgaattataatgtgtctccatgtgggtatctttgaattcatcttagttggagattgttgagctttttgggtgtttatattcgtgcctttcttcaaatttggaaaattttcagtcatttcttcaaatatgatctgcctgtttctctcttctccttatagaactcccatatgtaacttggtccagcaggtcccttaggctctgtttactcttctttgtatttttacattctgtttcttgaatctaaaacttttattaatctatccttacatttgctgattcctctgcctgctcaaatctaccttaaatttcctttagtgcattttttattttggttatatacttttcacctccattttattttggtttcttctaggttttctgtctctattgatctttccattttgttcatagattgttttattgacttttttacatctttctttagtcttttgggcatctttaaggtagttgttttaaagtcttcatctagtagatattccatcaggtcttttttggggacagtttctgttcatgtatgttggctttttttcctctttgaatgggccacacttgccatgtactttgtatgccttggggtgtgtgtgcgtgtgtgtgtgtgtgtgtgtgtgtgtgtgtatgaataactggctgtttgaatctaataatgtagtaactctggaaatcacttccctttccttagggtttgctgttctttattgttgttactgtttttgtttttaatatgtaggctgtttatgctaaggatcagcctgaggtataaacttaaaagtcttctcaagactattctgaacttgtgcttttccctgggcatgcatagtcactttctaattttcccacatatgtggttgcttttgaatgtcctcatttttaatgcatggctcccaaagggagataaaggtaaaactgtaggagtcaagggagaaagggtgccagtcttctaaatctcttgcttgttacttcagcagaaaggaaaggggcttggaccaatcaagagatatgcaacaacaaaggctgcctatttgtctgcacctctttgatcagaagcagcagtgtgctgtcagagcctagatccgaatatttgaaggacaagttgttttttgtccaccctggttcctacttgctgtgtacaagctaattctggagtgcatgcacagctacttgttctagtagtctgagagtggggaatggtagctgcagttgtgctaagagctggaatggactgagattaaccaaagcttacttcccaagccttcccttaaatgttgcaaatcttcattagattccagagttccaaattagttacatcagattctgccattgcacttgttgtggaggtggagagatagaattctggtgcttcacactcccacatcttctttgaaatttttaagaattttaaatattattgaattttaagtagttaatattttgcatgccaaattcagtccagcctttattctctgaaatgtttttctttagaaaccatggaggtagagctttgttttgttttgaaggaaatagttatcataaataatgtgcatttaccaaactgcttttaaaataaattctaggaaattctaatgcaaattaaaattcattgagaaagagtactttattgggaacatacaatgtatataacctgtttgtatcgtttttgttcatgtgtacatgagggattttgtttttataccattttaatatatactttttaatttagatcttattgctattacgttaggattgcttttatctggaggacattttcagcaaacctctatacattttcatttttgtgataaaaatataaatatatggtttgaagagtcatttttaaaaatgtctagaaatattcatattataacaatctttattgagaacaaatgttgaatgttttatgtaacaaatttattcactagagattttattatgaaaagtgggattgaaaaaattctgaaatacacgacttcacttttgtttttaacataactggttttttagcgtaactaatttacaactatattttcacctcagggatttgctaaaacattttcaaaatgtggagttttaaacacttgaaactttaatccttctttacttgtcataaaactacatggaccccaaattgtgtgacactaatatttatgttattatggatttttgattgctagattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggtgaggctgtattttgattactgttttcttctttagcagtattattaataatttttgtaatccattgcttatgccaggctgactacctcgaaaacattgtctcctttaatcgataacaatcttcctgtctgtctgtatcctcgtttaagtgaagattctgatgtttagccagtcaaattatcatggccacagtcatgcaaatactaaatgatagaataagattcaaggtcacacattagattcaccacaggctgaaagtaaaaggatagaaaaagataaaccatgcaaaagtaaacaaaagagagtacgtatatatatttaaaaaacgtatatatgtttaaatgtatgtattaaacatatgtacatttaataacagagccccccaatgaatgaaacaaaaatttgcacaattgaagggtaagagagacaattcaacggttatagttggagacttcaataccccactttcaataattgataaaacaattagatagaaaaacatcaaggatatacaagactttaggaacattataaatcacttaatcctgtagaataatatatatactatactataattctatagaatatatgtaatacactataattctatagaatatatataatctatagcgtctatagaatatattttatgtaatatgattgtatagattattttattatagaatgtatagaatacatatatagaatagaattgctttagaacttatagcatacatgtattctaataatgtaatctaataatattgtaataattctaatctaataacaattctaataatattgtaatatatgcatatattgttatatatataataggtaatgtaatactgtaatacatatatgtatattattctatagactatttcccctaatgaaagcaaaatacacattattttccagaacacatgaaacattctccaagataaatcatttgcaaggccataaaagccgtctccatttaaaagtattggaattgttctttgatcagaatggaatcaaattagacatcaacaaaaggaaatttggggaaactacaaataattgaaaattaaacaacatatttctaaatagcctctgagtcaacaagaaatgacaaggaaactagaaagtatttttaattgagaatgaaaatgcattgtatcaattcatgagatgcagctacttagtgcttagaagaatatttgtagctttaaaaatgtctaggataaaagatctacaatcaacaatctttttttacttaaaaatctagaaatgaaaaataaatccaaggcaaacagaagaaaggaaacaaagattattgtgagaatcagtgaatagaaaacagaaaaaccatagtgaaaatctaaaaccaaaagttggttctctgaaaatatcaacaatattgtcaaacctttagctagactggccatgaaaaaatggaagaagacacagataaccaaattcataaatgaaagaggagacatgaaccctgaccctacagaaattaaaaggagtaagcaaatattatgatcaactttatgacaacaaattaaacaacttaaagtggacaaatttttagacacagattgccacactaactcaagaagaaatagaaaataaaataatttgcttaataaggtctgattcttgctagctatagaaaaaatgctaaaatcttggtctgtggtaaaatcatatttttttaagtataggacaagaaaaatgtttttctctaatttgaaatactttttgaatgaaaatggagaaaaggattacagtaaacagaaatttatatactgtttcgctaaaattggtaggtgatctttgacgaggccaaaagcagcctagaaaagagttgacacactgacctgagttgtttgatgatacatgtaggttgtgataaaaactcatatagtgagcaaaatgactcctatttttaaaataagactacttgaatattaaaaaaaaaaaatgtgtcaccagaaaaggacagccaactttaacaggattttctaaatttctttactaaaagtaatttatttggaattgaacttcagtttgacaagtttatctgtctatttaaaaaccatttttcctcaaaaagggatttaacttatgatgacatcattatgcttcaaagtatttaaaaatgagcattgtaggcctggatagcctatatgatgaatttatagatgaaaaagacctgattgacaaacagttgatctacctaccaaacaagccatatatatggtttttggactttttttggagcaccgaaatcaaatttctacacatttaaaaacctgtttttaataagtaaaatcccaattattacattcccaaattattttgttgaaaggatatttaggctaggtgcagtggctcacacctaaaatcccagtgctttgggagcccaaggtgggaggattccttgaggccaggagtttgagaccagcatggacaacatagcaagatcttgtatctacagaaagaaaaagagaaaagaaaattagctggagttggtggcacaaggctgtattcttagctacttgggtggctgaaccaggtgcttgatcccaggatatcaaggctgcagtgaaccgtgatcatatgattgcgctccagcctgggtaacagagcaatattctgcctcttaaaaaattttttttttaaaaagtttatttaacttgatccttcacattggattgacacaagaaataagtgtgaggtgggcttgaaaagagcagagctaaaaatcaaggtgaatttttatgtttgattatattcagtggtaacactgcataaaagatgtcctaaaggctgcaggcagttcagaaaagtattagagaaggaaacagaaaaagcaaaaatatcctactgcatcatggactcgatagaaaagtcattatttatttttgttaaatatagataatacctgttttgcatgtatattttgcttttatgtacatttgtcttttaaaaagtctttctgtattttaagaatacaaaacaatatagcctataacatttaagtatccaatagagttttaaaaaaagttaaattggtatattagaggacagaaacattgtaaattacatattgttgtatttttctcacacagattatttgccactgttaactagtcccattggtttgtttaaataatcacatttctgtaatagaaaagtaaagaatacacattaagagataattttgggaaaacattcacttttatattttcacattaaagtaataacaaatgtgtacaaatatttcttttttgttgttgttttgttttttgagacggagtctcactctgtcgtaaagtttggagtgcataatctcactgcaccctttgcatcccaggttcaggcaattctcttgactcagactcccgagtaggtgggattgtaggcatgcacccacatccagctaatttttgtatttttttaaagagacagggattttgccatgtgggccaggctgttctcgaacttatgccctcgagtgatccacctgccttagcctcctaaagtgctgggattacaagcatgagctatcatgcctggccatataagtattatttttgtattactttttttggaagaggggatcttgactggttgtgtttcatgttggtacactaaaagtgttggtcatcctataccaaagatgtggcttaatctattctgtatacttgagatatataggaaaaagtaaagtttaaataaacgtaaaatatgatgtttcaaattcaccctttttatttcctagaaagtgagtttagtgagcttagagggcaaatgaaagggcaaaaccaagtaacatcatattcctctctaatgtttgttaaatacttgaagctgtttagttctcccgtttctatttcagggcaactctactaccccccgaaacacaaaacaaataagcatccccctcaaaacaacaaccaccacacaacctacttaggtttactaacaaaagcgtcaaattgacagtggggcattagaagttgtatagcccttttcctacatatttatatcctgatgtttactttttttttctcctttcttgatttatctacctgttctttattttattggataaattagagaagttatgtaaataatgctttttgtttttgttagtttctctaaatgttatctctaggactcatttactctccagacttttcagaactgaaaatgcaaaagttgatgtgctgaagctgttgacatgtctagcttttcagcattttttcttttaataaagtaatttttgaagttgaaatgtcaaattttgtatttccttgtgttatatactttgaaattgaagttcttaaaacaaattaattttaagacttttttttccccatatcacactggaactttgctgcagcattagttataaaaccaaatttaggataacagtaatctctttaaaggacattcaaaaggtttctctagggtcaaataataaatgaaatggcttattcgttcagcagtcatattaatacacatctagtactactgaatactaaacactgactcctaatgacagtgtttcctatgtgccagacactatggtatatatcttatatagatcttttttaatccttacaataatcctaaataaccttatatagtattatctccattttacagatggggtaaatgaagcttactgagagataacttgctaggcaaaagttgagatttaaatccgtgtttgtttgccagcctgctatgaggaagagtacatgaggaagagaagggtttagtcctgtttcatccttcttaaacatcaaggtgtcgtttacaaaccaatgattcttacctgccagttattttcaataatatgattccattattatcatactatcaagtatcatcttgtattaagaaattacagagatcattactattatttttctctgttaggcatctccaagagttactgttgatgactatttagtagcaaaattagcagatactttgaatcatgaagatccaacccctgaaatctttgatgacattcaaagaaaggtattattatgtacagcatttatcattttatcttttttgagaaaaaatacttttatgtaatgtaattagtttttaaaaactttctaaaagtagagtggtattaaaaagataaactatggcaattatacttctcaattccagaaatgtaaaccagtatttttgtttatttcgttaattttctgaggaaaatccttaagttgggttgttttatttgaatttgattgtagggctagatattgtagtctcagaatttgatgaattgatgccatataaataacatgtctttcaaattcattttaacatgagccttgaacctttacatgtacttgtttcttagaaaacaattcctagaatgtgctgtctgtgacttgtgttgcagtaggatttttttcaatataatttagttactggagggatcagaggaaatcattagttgtgaaatagtcttattgctgacagcttgtaactatgatacattatggcaagacctcagtgtgtcttttggtgaaattgtgttttgtaaaaatcaccacacacctgtattaattgttgaatatcttgatttatttcaccaaggtatatgaattgatgctacgagatgaaagattttatccttccttcagacagaatgcactttatgtgcgcatgttagctgagcttgacatgttaaaagatcctagtttcagaggatccgatgatggggatggaggtaaggtggcacccattttacacataatatgcatatatatttatatatattctgcttaccaaaagagcttttgtataagttaaaaatgttgttggagtccaaatataaactgtaatatattaaaaaatctacaaatgaatgacaaagtttagtgactatactaaattaaaatgctgaaaatttaatagtggattagaatgtaactatagaagccttgaattcttaaagaagaagaatgttttcttcaggtgagtcactgaaatatttttatggcagtttcccttttgggagtaagtaacaatattcatgattaacaatagaattattgagaagatttaatatgcaataagtaatgactcagagtatatcataaactataaagcattattaaaaaactacagttttaaatatctttaattgtacacttttccaaattctacacagtgtgagagacttttgagctagaaaaagccgcaagagtcatttatcccaaccttcagttttttccagtgaggataatgagttctatttacatgttatagtgaaaaaaatggtttaagagtcagaatatttcgattttactcccattctatcacttactacctgtgtgaagttgtccaactgcttaaattcttcaagcctcatttttctgagttggtaaatctggaataatatcctcataatatcttacgttagtcattgttagatttaaatggaattatgcatttgaaaatgatttataaagtaaaacacaagtatcaatttttattagtaaatagtgagttatataagaatagtgggagggatagcctttagaacacaagcttccaaattcttaggcccaatgatcattaacttgtgattcaattcagaagtatttattaagctctaattaaatatctagggttggatgatctttctggtatgttctaccaagtgaatgaagtcaataaaaagtaaatgggaaagatttaagtattttaagaaagtgcttcagttatgactgtttacttatgaataggttttatggcaagcacacttgagaatggagataaaatagagctgttaggtagtgagcactgctttaaaaaatacctttattatggaagtctcccagcctcccctctcctccacctcctatccctgtgtctacactagtgagattttgttttttaaataatctaagaaatctagttactgaagtttacatttgaaatttagtaacttttctttgattatttatctgatgccttgggtttttaaattaatactctataagtttacttatgtgtacaattggaataatgtattaactgattttgattgcataattaaggaagattttttaaaaaaacagagttcttctctgagttgaatggtaaaattttatgtacctctagtttgttctatatatctgtacttactctattgaaaaatgttcttttatagagatgctatgaaatttgcaatagcagctctgtcaactaaccatcctaaaatgactattataaaagtttttgttgtttatactaattttatctattttagaaatttcttcgtatttgtgaagtggatttgctaggtgactcagaaagagagaagacaaagtcataaccaaataattgtgtgggcttctaagtaatgtgtaatttaaactggtgatagtagcaatatattctgtggaagtaatttttgatcctgtaacttaagaatgcttccagtcctttaaatggatttctagcttccattcatatctttctagccagtctgtcttcttcagtacagctattggaagcaaactataagcagtctcaaacttcctaaaatcatacactgtacttttttaaaacacgaagtacattaaaaaatttttttttggaactggttttgatctgaagtaaatatgcttctcttatatatcagttattgagtaacccctcacatttgaatcattgattgtagtttgagattatatacttatgtatcttattgtctttctaggacattgctctctaatattttgtttcctaattgatgagttttatactgtgaaattacctatcccttttttgaaaccattcaaaaaaagtatatggagtgatgggtataatatgaaacattactatttaaagtaactgtcagctttgttgtctttgtcagtgtttaggttttaggccactggtttacctttctcaactagtaatgcttctgatatacttctttttatatgattatttaatcaaaaataggcctttccactttttttgttataaattagttttctgacttttaaaattaagctgctgagcactacatgcattttttagatattctgaaattttgaccaccttttagacattctgaaataattatctaacctagggattaatgtacagctgatttttttaaagtagtctacatttgagcctaaaattaaaggaccaagtcatatcatatggtatagtactgtatcctctggtggtttttctttgcttgagtagaaatttcattcctatttaaccaaacttaacagtaggtagagaattagctggttggcttgcttgtgcttactatctctcctctctccttttctcctcatttcttcctttgccctttctctttattcattattactttctttagttatgaaattattttaaaagtagatattttctcctttattaaaacagtctcataggcttttaaaactatatgaattatgctttcctttttaaattttaatctcaacattatttgtctcaccatgttgaacagtgctttcttttgttttctaatatttgtaggtagtcatccaattcttgattaaatgtcgaccaagattgattttatactgtatttctggatcttcttattgttgatcaagaaaataaactatgccctattttgctcccaaattctcctttaacttgacttgtctttggtgggaagatttaagaggtgggcacactacagaagaggtaggaggcatataattgaataaggaggatagataactattttacttattttaagtatcaccaagggataatcctaggtgaaattcccatttttttatgaccagagggctgaagaaccaagaaatgttcttgagcatttagagtaaatttggaaggcaatatcagctgcctccttgtaggaatagtagtgttgcttttttgaagacccatttagagaaccaaattcatatataacctcttaagtgctcgaaaccatatattaaactgtgtatgaatattgctttaccatagatttgtttgtgtgtttaataaaggaacaccttaattggtaacttaattttcttagatttataatagaactctaagggaaaagattgttgtttgacattaatgttaataatccagcattgacttattctctcacattaatttgtcctagttgctttttaatgaaatggaattgcatatgcagttttaactgtctttttgttatatattgatttaaaaatctggacttccagtgttttcaagataatctaccaccaagaataagaggacttaatagacctattaaaaataagtctgtttatccctcacagtacagactgattttatttgtaatctttcttaatccaatgagacagaagttacaaaatagtgctggtgtttcctaatgggcctcattctgcaatgttttcctcatgcttatattgtattaggcaacttacttgataccatgagaataaaaacatttaataattactctcctgaacacgaatgcctttttgatttttggccagctatcaggtacatactatattgtcacttaaatgcctgtcttagaaaaccatgggactttaagggatcaagtttttgggagtatccacaatttttttttttttttttttttttactattatgttatatcttggcttatgtgactttcattcttagtgtttgaaccttagataaagcaaccgttttaaagttttttgctgtatactaagttgaatttcccccctgcagaatcttttaatgggtctcctacaggaagcataaatttggtaagtactattatgggtactttattaaagtgacttgaaaataatgtaaaaggctgagccttaacatatataaataaatgatatataaagaaggccccaaatcatcctttagtattgtaaaaagttattatgcttttaaagaaatgctaagttcacatataaggcatctatgaattagaacttaaaaattatattttatctttattttaaaaattggcttaggttatacctgcataattgcttttctgcattttataaataaattgatttcattattttcaattctaatatttagcatgtttaaattactatgattactaaattgctatgataggcaataagtttgtgacacataaatgtttatattggaatcagtttttttctcctcttgtatttagaaagaaatacaaaactagtggggataaccaaaaccgaatagatatttctttaagtctacactaaaacaaattcaggtcattgtaaacaaaaaatttttttttgtaagtttagacagttttacagcaactacatccttaatgattagaggttagaatggcatgtttttagaatctcaactgtcattggcattttatatattcaaggtacagtgtaaaataatgaaagtttcagttctcttatatatccagccttgccactgaataactcattttctaagatgctgttaggaagaaatattagcgttctatgaaggtttcagtccagtttggctgggttggggaggggaaaaacaggtaaggtgttgtttgttttgtttttcctcctacctgcattactttttcttttagacctttcgtaatagctaaatgttttagaggttagtcgtcttaggtgttagctgtactaccatgtctgcttctaaaataaccttattgagtaaatgttctgttactgtattataacctttagtaaaacactaaagcaaatctgtggtagaattgtcagatactttgtaacttttaaaatatttcctaaatcatttggtgtcattaccatttacttgttatagtccagagctttaaactaaaaggaattgctcctagagcttgaaggaagtgttaaaaataatgttcattatatagaaaagtttccaaatgtgatgaaacccttccttggtttgaaattttttagtattcacatttgtagtacttgtgtaaatgtttaaacactagtaaaaaattttttttctttattccatgtctggaataaatgcttttccaaataagataagtctcttttgtcacatggtaatataaaccagaatagtctctggatcaaaaaacagtcatacttgaagtcagtgacttggagtatttttttattcccataaatctatttaattcatacttctaagtagttggaccatgtagacaaattttagtgaatatctgcattttaaaaatagcttaagattgtaaactagatcacgatagtttattccaatgtactaaacaaaggagatatttaatgtgtttggtattttactcattttgccattggtagcttggtaggtaaattacaagcatttcctttagtgccattttggttgtgtttgatgactatcattataaatttgaattttcagtttttgtcttagtgttaaaaaacactttcttacaaggagtttaagaatcataacttaaagagtactttgcaaattgtgcttatttcaatatagcattaatgtacttgttttgaaatcacaattgtcttttaatatattcctaaatcaaatgtagttttgtaaatattattttaccaattgtaactttatagtccacttgatatttacgtgcactataactgtaactaatgtttttccaaagttttcatcatatgtaatgaaaataatatttactaattgcatattttaagagacaaaaagacatttctccacaaagcctttttaacaacttttggattgcatagtatgagatgctaacatgtttaaagagataagtacatttagcatgttaaatgttaacatacaagggaaggttaccattattaataatgcttttttaaaaaaatagattattttatgttacctgtgctggcttataattagaagaagttatagtagataatatgaatttggtagactgttccatttcctctgagtcttctatctttcacataaaaatattgaagtaaaggttgtgctatttctatcaaaatgatttcttgagcacataaaaataaatgcactcctttttttttccaaagcattttcattcccagtatgtcctgacagagatgtagagcaggtattagccccattttaccattgggaaaactgaaatccgagaaagtagttgatatggttaaagtctcttaaggtattggtagtagagcatggactagatctaatttaatttgatgtctttgccatttgagttgaccagggaagtcttgtggattatctgtatagaattatcacattttgcttctcttaacaatcagtttttagtagatacatttttggccttcttcttagaatgcaattgccttaatttaagtgactttgtgccatatggatggttgcttttaagtcatttagatgacccttttagtaataataatattacattaggactcaaaagctcattcacatcctattatttttaaagtgtgaaatatatctgagttatataatatgaatatgtgaaatgtgtgaatgatataaatacgtgaaacatgtctagattatatatgttcggtgtccccaagaccactcccaggctcagtgatttgctaagaaaactcacagaacataccatagtcttactcatggctggaatttcttatcatgaaaggttataaagcaaaatcagcaagacaacacatgtgaaatgttgccaccaggaaaattcattggagactaaatgtacaggttttttattggaggcagattatatagcacataccaaaattctggactcctagaaggaaagtaggtgttcagcataaacatttcttatacagatagtttaggtatggtaaaccactcttattgattagagaatgctgagaatcttccctaaatttaagttcccatattccatccgagggacaaacttggaagcagtcttttctagacagagcagtttcaggctgccatgttaactctgcagcctgctttaattacatggttatgttcctttttatatatgtgtggatatatgtgtatgtggcaaaaacatttttaaagtttagacccaaaggccgtagttataaaagattcattttgagtcagtcaataggaatttatgtttgtggaattgtttttgaaaactaatcatttaaaatctatcatagtctatggattcacctcatttaataaataatcagaataatagctaacagttgttatattaggcagttttctaaatgtcttacatgtcttatttaatctccacataattctctgacttaggtagtattctcattttatagataaggaatctgaattaaatttaaaaattatttctatattaacaaaagtattaagctaaaaactacagagctggttctagtatatttcaatgtaaatgttaacataatatgtctacttatttttatctagattttcttgccatataaggatcataattgaaaagtagcaagttacagtagatggacaagcaattaagggagaaataatctaatatattaagtttattactaaattttttgttattgtttcttaatctttgctttttttctgttagcctaaatggaaaatattattgtgtatggaggggatggagggtatacaaataatatatagtttacatgcagggaaatgagtaattgtaatgcatatatgatgtagaattctttactcttttttttccctataaaattttaaaaatttgtttcctgatttttttttctcagtctttagatgacctttcaaatgtttcttctgatgactcagtacaacttcatgcctacatttcagacacaggtaagagagtttgaagtataattattgcattaaaactatgtattattatatccctaaataattttccacacttaatttttactaaccatttttttgttctctagtcatagttttgttactttttttctgcagcatgtccttcattaaattctgctatatttatttgcttatgtatttgatctctctaagattgtcactatcaacatttgaaaatgcttatattctaagtgttctactatttctaataaactctaaaaccattcttttcctctttgttcttgggtctagctgatagttgtctgtataattctcgttaaatcttttctggagagatcttagttcaggattagttttcatatatacaaagtcaggctagataactggggtaaatgaagccccaggtataggggtttgcagaacttcaagaagtgcttgaataatgaggtgagaaacctctaaaactttgtgatcattcagcatatgtgaagaattgttagtaaattcggaaaaataaccagttttcatcattgctattgagttattagataacactaatgagtattaaataatgatagttttcttatctgacctcttactgttcttagattgtagaagtgtgtttgtcatattacatactgaagtataaacatactgaggtatataccttaattcagtttcatgcttacattttagacactgaagagattttatagtctagtctagtctagtctagtctagtctagtctagtctagtctagtctagtttaatctagtttagaagacattaacttgtatctttttaaaatagatcttcatttcctttttcttgtcactggaactgaagtctcaatttacatttgttgcctgccagatttctggaagaaaacaagtatttattagcttcttaaaatgtatggaagcactgtgctaggcattgttaagaaattatttcaggctgggcttggtggctcacgcctgtaatcccagaacttttgggaggctgaggcaggcggatcacgaggtcaagatattgagaccatactggccaacatggtgaaaccccatctctactaaaaatacaaaaattagctgggcgtggtggtgcacacctgtagtcccagctactagggaggctgaggcaggagaatcgcttgaacccgggaggtggaggtttcaatgagccgagatcacaccactgcactttagcctggcgacagagcgagactccgtctcaaaaaaaaaaaaaagttatttcttcctgacaaacatatgtaaatactgaagaagcagcatactatagtggttaagagtataacttttttactgaattgcttgggctcaaaccccagctctgccagttaatagttgggtaagccatccaaaattaagatttagttaaaaaaaaaaaatagctgggtgaacctgagtgagttccttaacttccttgtacctcaatttccttacctgtgagatgggctagtaataataataataataatacataactcatagggttgttatggaactaattcattacattggtaattatgcatggtaaacatatttgatttttggttcattaaatacttattttaccaactggacttcagagtctctttgattctagatcttttagcatctttatttcagaaagtaggagcttatagactagtccagtgctactgaaagaatggcccaaggaagcagtacacacacaagaatggtggtctagtatgtgtattgcttccttcattgagaaatcttgctttaaaaagtattggctaaattaaacaatatgattagtaatggagttgatttacattctagtgctattttttttttacataataagaattactagcaaatagtttgcagatcgcctgctatgagtaacattggcctaataaaaacaaacccttctagctaaatcaccatcttcacaaaaccaatatatgtaaccccaatatcttcctttaagtcagattaccttgatgtcttctgcattttttttaaataattacctcattattcttcctattgtgcatccaccctgggtgatcttccaagcctgttggtttttgacaaatcctgattattctttcttatatctcttctccttttttgttccttgctattctccttactgttgttaatttttaattagttatggttagctgcctaattggcctctgctttctattttcctttcccaaacctatcttggacacacctgataaaaccattcccttgttgccatgctaactccattgagaaatggtggttctctaacgtgattaaaacgtgttgtgctgtttaatttgcataagtctctgagagaaagataactggacaaggtgaacagtgaataatagtgctacttacagagcaagatgtccaaagtctatttctagtcatatactttgttaaatcagaaacagtgataatagatggaaagggaatgaaagataattttggaaagaaagtacaaatcttagaaaaaattttaagaaagtttgggaagagcttctgtccaactactcttgccaatatagagtcctaacttttatgttattaatttaccaaaaagctgtagtgaccttcttctgcccagttatatacgaaatagcaaaatgttagccccagaacttgaccacgtttattcacacttatgaataaacgtaatccattattacaagatcagttttagacttctggttagtgtggtagtctgaactgctatgagatatcatgccttccacgcatagaaaggctaaaaacaatattataagtatagctgaaggggaaaatctacagatgccgtagaccatggggaaaaataaattcagagaattgaaggggtgttaaagcaaggggctcatagtagcataaagactggatcttgattttgatagcattttcctgccctcaaatttagaagaggcaggatgggccaaggccatgggatgctggaacaaagtgctttacataaagcctagagtcacaaagggcagctcagtgtcaaagaggaactaggaaaacagcctaccatcagtagaaaaacaagaaatgtcaagatcatgactggaaatggtatctgtcacccacaaaaaattgaaagcccagcttgcatcctatcctgagtatgtctggatttagctgtcctcaagtgattatgtactgcaagatctcaagccagagagttagtattaaaattatttctgaaccactgaaaccagcagttagagtggtgacacttgacactgttcaatgtgaacgcttccctagcccagggcactcagaacacccagggagaaataaaaccagctggaaatgagcttacagaaagcaattaatagcaacagaaagaaatacgaaccacaataagagaaagccaacagaaccagcagataatttgcatcctgtgaacttggagatggcagtcttaatagacttggccgtaagtatgttaaaaatattcctagagagaaatactaagacaagaataaacagtatgaaaaagaaccaaataaaactctagagatcaaaaaaatacagtgattgaaagtaaggtcagagaatggattaagaaatagaccagatacagatgagaagagactcactattaacttttggagacgttaattgtagagtgcagaaagataaagaaatgtaacatcagaaagacaagttagagaaaatgatttaaagtgcatctccttagttaagattagtacaaaataggaacaggctttgattttagagattacctgacttgcttggtatgtggcaaagtaatgcgaaaatgctttgaaaaaaaaaaatccccagaataaaccgcacttgtgaactactgaacgtatcaaagaaaaagaaaattgccagaagataaatgttatcccgtggctgttgctgtttagttgaaaagattttaattgtaatacaactgaagagtgaaggctagtacaaaacatcattttgtttattttttctatattaaatttaagaaattctaattttactctctaaggtaacattagatgtagcaatgtaatgatgtagtgatgtagtaacagaaagctctttggaagagagaattgtaataggtaccgctttgtgattgatagtgtcatactgaacttagtttattttgtaatttagccattatatgtaataccttatggatgtgaatatggaggatgggaatctatcctttgctgacatccttctgtctcagtctgtcatttcagattcttcttcatttcatattatcttttttgttttcttcatcttcctccttttttgtgtctttcgttcctcttcattttgttttaaatgattagtatatgctgactatgacccatatgctgtggcaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacaggtaatgaagttttaaaaacttgtgtactttatgttgtttcttgatttgattttgattataaatctgaggatgcccagatagagtgattaattaaaaaaataaggtaagaatttttggtataatcaccataaatcttagaattaatctgagcatttaaccagtaaatcaaatgttgaacacttcctcagtcctaaccatcatggactagtgacagactatcaagagtataccttggaaaattaaagtgaatacatgtttctgattttaaaatttgcgtgtgtgtattgtgcttttcaaagttttttgggcttagattgaagtaggaatggggattgctgtaggacattttgtgcttttgtttttgaaggcataatttaaacctagaagttattttaaatggcagtttaatccagcagtgtaacagtgaaatgaatccttgatccattactcaaattattttgaatcacaacataaaataaatttaatattaaccaagtaatattttcaattcttattaaatacaaccctcttgttttatagaaataatttaaaagtactcttaaagataacaaatctaaagaaattatttccctgtcctatttttaaattaaatattttctcaacttaaaaaaaagatctttgatgaattggaataaatgatctatgaaatttattttaacttattttaactcttaaaaagtctgactcattcagggattttaggtatacaactggtattaaaccaataatagttaaaagtgacatctgattgggtgagctaaagctttgaaatgacgttgtactactttagaaatcagaaattatctttttcaacttaatatagtggaaaatatatagttggcaccatgataatcttattaaaatatcttgtggatagagtgagataaactattaatagctttaaagtgatgaaaaagaagttaatgttgacttctgaagcctatattaaaaggactattttgtgttatattaataagaaaattaaattaataactttggacatgcgcattcttctggtgtcaaatataacctttcttcatgtttagcttgatttgtttgcagagatgaaataattttctgccccacattgaagaaataattgctttactttttaaaatattacctgtttgatattttaaaagcatatagctcatatatctttttattcccatccttacactttaaccaaacatgataatttaaaaaataatttgagttggtaagagttctatttatttgcaaatgaatttacttgcaaattaatgagagtttagtttaatatgaaattttttattgtgtaaatagttgtaattttctttctagttaagaggaataatcattccctgatttaaatgttctagactagaactgtaggcattattttacatattgacaaatgtaaatgaagaacatacttttgaagaaaactttaagaggacagttcatacagaaatttcccttttcagttcagtgccaaaaattacatgaaattgatacagcacaatttctttttcaaacagctcacgtgagtgaaatggacatgttttgacttggtgtttccttttgtgtgtttgtgtgtgtgtgtgtgtgtgtgtttcttataaagtttataaactttataaaacttataaagttgtgattacctaagtgtttagattgttcacagaacttaagaaattaaaaactccttttaaatgaaaatcaggttttagtaaaatattaagtatctgtaaataagatttagggtctttgccttttagctcagccttatctatattttaaaaactcaaatcccttataaaataatggaagaaaaatgtaatgatttgtaattcagcagttggtcacagtatagcctgttaacatgaataaatggtaactgcatagagctcttaaagtaaaattattttacaacaagtttcatttgtttatataattttgtgatacaacattttttccaatgccaagcgcggtgcctcacgcctgtaattccagcactttgggaggctgaggtgggcagattgcttgaggtcaggagtttgagaccagcctgggcaacatggcgaatcctcatctctacaaaaatacaaaaaattagctgggctgtagtcccagctactcaggaggctgaggtgggaggatcacttgagcctgggaggtggaaattgcagtgagctgagatctcagcactccagcctgggtgacagagtgagaccctgttccataaatgaatggataaatgaatgaatgaaaatccaagctaaatgtatgagctatcatttattttccttaaagattttaataatcttatttgatattttatggagacttataagaaaataattaaaatgttaaatgtcatgattttggaaatggcctgagctgctcattcattgatttaacaaatatttcttaagcttttcctatgtgtctggtacttttcttgatgctagcaacatatgagagaacaagacagactaagtccttgcctctaagagcttgtagtgtaatagctactgtgcatttctgttttatttggtgaaatctgtataggtatagataaactcatgatttaaatgatcatattaagtattcattaaggtaactgagtaaaaatatgcaccatattaaacaaattttgaattattttaatacagaatttcacatctgttctttaaattttccaggagtgtattaggaatctaaacttgtgtttttaatgtagaaaagtaagatctttgattgtagaatgtccatgatttatgtgtagtatttgaattatttttaaacattgaaatcctctgatataatttattttagttcttttttgctgaattttgaatttcttttaaatgcctttaaaaatattttcatgaatttttggcagaggggattatattacttttcagggaatgggcaattgttttgttcgtagtttaaaataatcttttaaatagcaagtttatgatgagttaatatagagtataaattttcacattttctcccttgcttttatagtttgagaaaactgttagtgatttatgtttctgttccagacagacaacttacaaaggagtttattttggtaattcaggctttaagaaaataactgttactgtggtttttatttctttttattagtaaggtttaatattttaaagtttctgaaataaattgttgttttaatggatagtgtcatatttccttggtatattagtttggtagggctgccctaataaaatgccaccaaccgggtggcccaaacaacagaaatgtattttcttacagttccagagactagaaatcaaagatcaaggtattgacaagtttggtttgtcgtgaggcctcgcttcttggcttgtagatggtagggttcttgccatgtccctacatggccatttctctatgtgatgcattcctgttgtctcttagtgggtccaaattttcttttctgataggataccagtcaggttgggttggggcccaccctaaggggctcatttaaacttaataatctctttaggggctttatctctcaattcagtcaccgtctgcggcactgaatgttagggcttcaacatgaatttgaggaaatacagtacaagcacacaagacttggtaataccaggaaaaatatgtgttttctaaaattgagtcagtagtttaatgtggataggtcatattgcaggaaatatctcttaggacaccttgaaaaagtaaatttacttcgaaaattttttttttcacatgtgatgttcagtgaggacccatttctaatacttttgtaaatcaccaaatttgagaatatagctatagttaatgttttctctataaattacctctaccctttattggttttcctcccaatactggagtaaaaaactgcttttacctttcatgtgtaacatataatgaacttgttcacattttagctccaagcagccatcagatttgtccttcttttaatgtatcagaatcttccagtttggggatggaaattatcctaatccttttcatttctcttctctttaatctctgcaccaagaattagttttctttacagagacgttttcaacaaataattgttttaaaaagtttgtttcgctttaggatatgtatcacaagggaaaagtggtaaggctgtttgaatttcagcactaggctgttggtcaggtacagtcactagttaaatgactttgctcttaaactattttagcagctcgtatggttaaaaaaagtgttttagcaaggcattacagattacgatgatggacctttgaaggtgcatccaaatgttaagtccataagtgctagacttatggtatacacatttactttgtgcttgtgattttacaaagataaagtatatgctgactgttcttaattttttttggttagtgtaatctatgagtttatgtttaatgtggttgatggggcaaaggtatcaatatttattataattgtgtatacacggggttatataactactatctgtattttgaaaattgcctttttatttgctagtacttcacaggtcaaaggcttattaaggaaaatattttttaaaaccttttattatgaaatttttgaacaatgtcaatattagggagaatattaaatgaaaccccacatagtcaaaatccatcttcatcatttatgcaaatctgtcattcttgatttaaaatacttttattaataaataatattagaactgtgttttgagtatatttggacaatgttttttattttctgattttcatgtaatatattgcaaaattatctgttgaagatgggtttttgttgttgttgttgttgttgttttttgagacggagttttgctcttgttgcccaggctggagtgcaatggcacactctcggctcatcacaacctctaccttctgggttcaagctattctctcctccctcatcctcccaagtagctgggattacaggcatgtgccaccatgcccagctaattttgtatttttagtagagacagggtctctctatgttggtcaggctgatctcaaactcccgacctcaggtgatccgcctgcctcagcctcccaaagtgctgggattacaggcgtgagccaccgcacctggcctgaagatgtttttaatatgtagagaaataatcacttgggaaaaccttttgtctttataaaaagtgctattgaatgtattttgtcttacagtttgaaagtctctcaagcatattgaaacttcctggaaaaaagacttttaataatatggatagagattttttagaaaagagaaaaaaggatctaaatgcatatttgcaggtaagctcatgtttactataatccacagattttcatttaatatagcacacaggtgtagaatgtttttcatttaatatagcacacagaatgtttttactgtaatcacagggtagcaaccacttttgtgcagcatgtcaaatgtgacgtgcagtctgcttagtaatttgtaaacattatttctgtatgtattgattaacttagaagttttctagacactccatgttagggattttgcttgtttgtgtttagataaatgcacttgcctgtcttctcctggctcaaacatttgaattttttttttaaagtgctaaatgtctgtgtcatgtatttacaagattttgaagaaaaaccaccttttcccaaatcttttatcctaaatgtatcttttagatgtcgatgtattatatacttcttagctaatgaactcagtatgtcaaaacttgttccattgaaggaaccaagctagaatgttgttatattagcagttgtgaaagcagtgttttgtttggggcttccatataacacttgaatgtttttgtttggattattttatgtactttatttcgtaccatttttatttaatgttttgtttgttttgagacaggatcttgttctgtcacccaggctggagtgcagtgatgcaatcatagctcactgtaactttgaactcctgggctcgagggatcatcctgcctcagcctgctgagtagctaggactacaggtgcatgccactgtgcctggctaatgttttaaatttttttgtagagatggggttttgctttgttgcccgggctggtcttgtattcctggctggggcaattttcccgcctcaatctccaaaagtgctggggttacaggcatgagccaccttgcccagcttatttaatgttaaccctagaattgttatgcaaataacgtgacagttttctaacgtggatcttcttagtataagctgtaagatctgaaaataaaatagtaaatatgttcagacaactttcacattagatacacttaaagtcaaaatagctgatataaagaatatatataccaaactgttaatcgtcataaaattattggtgactttatcctaactgtataattgggtttttaaaaatataaatcaatattttttactatacattcttaaaatttatgagctaaaattataaacaatggtaatttctagcattctgtcagtttaagataatctcttcttttttttttttttcttgttagttactgttagctcctgaaatgatgaaggcatcccccgctttagctcactatgtgtatgatttccttgagaacaaagcctacagtaaaggaaaaggggattttgctcgcaaggtaagtaagcagaccactgcactgggtttctttctaggtctgttttcttactttgtttgtaataaaagaaaataaatttagatttgtacgtgtgttttaaaactagaaaattttattaagttctcggcatgtttatcactattggtaggaatatctacatataaactcctgtcttgacatgttgattataattcagcagacgcttgaaaggaagaaataaaaaatttgaaatggtacattaagaaaagtttgcctgagacaagtcacaagcttttcgttatctttagagggaaatgtttcattctgagagaaaatgtcatttacttggaataatgataaaaatattaagcaggatatgttctgaaagtatgccttttgaataaaatcattattatataaaatattttaaataatttaaaatagggtttaagacccatacttggaataaaatcgtaaggtaagacagtaaataagtgcttaaattaggtaggatagcttagtgggtaagaacacaagctttgaaatcaggcagtcttttgtttcagatccctgctctactatttactagctgtgaccttgagcatgttactgaacctttggtacttcagtttactcaagaaatgaagatttaaatttcattagagcattatgtgaatcatgcaatattctgtatattacagtgcctggaaaataataaacctctgaataaatgtttgctcttagtaataatagcaataggagcaggaggagcagtgggggaagctggtattatttataccactctttgtattttatcactttttataagtctgaaattatttcaaaatgaaaatgtaaaaagaacaaggagtttctcactattctttgtccccctaaaaagaccatctttttaaaaagattaaggaattcatacaaaataagtaagaattaacaattataggaagtttgggccaagcacagtggctcatgcctgtaatcccagcgctttgggaagctgaggtgggtggattgcttgggcctaagagttcaagactaaccctggtaacagcgagaccctgtctctacaaaaaataaaaaatactagctgggcatggtggtgcacacctatagtcccagatactcaagaggctgaggtgggaggattgcttgaacctgggaggccaaggcttcagtgaaccatggtcatgccactgcactccagcctgtgtgagagagcaagaccctgtctcaaaaaaaaaaaaaaaaaggagttcatatgattacttcaggatttttgattgtatagtttggtgcaaaagtaattgcagtttttggacatttaaaacaaatggcaaaaaccacaattaccttttcaccaacctaataacatttctaagttagtgttttcttttaataataagttctagggtgtggaccttacaatggaggggaaaaatatatgttgcttttctgcgtatttcatgattgaagtgattgagttaaattccaacttggaacagttttattgtcactagagatgcattttagtgttccatgttttttatgtttatatatcttttctcctttaaagattatatccattttaagataaagtaataaattgatatcagcttttggagataaaagaaatattaaagtacacttttttttaaccaaacaacaatagcacacgtgtatgtcccaacagttatacaacacttttttttcattttttattttttatactttaagtacttggatacatgtgcagaatgtgcaggtttgttacataggtatacatgtgccatggtgctttgctgcacccattaacctgtgatctacattaggtgtttctcctaatgctatccctcccctagccctcaaccccctgacaggcccggtgtatgatgtttccctccctgtgtccatgtgtgagaacgtgtggtgtttggttttctgttcttatgttagtttcctgagaatgatggtttccagctttatccatgtccctgtaaaggacatgaactcatccttttatatggttgcataatatgccatggtgtatatgtgccacatttcctttatccagtctatcatcaatgggcatttgagttggttccaagtctttcctattttgaacagtgctgcaataaacatacgtgtgcatgtgtctttacagtagaatgatttatcatcctttgggtatatacccagtaatgagattactgggtcaaatggtatttctggttctagatccgtgaggaattgccacactgtcttccacagtggttgaagtaatttatactcccaccaacagtgtaaaagcattcctgtatctccacatcctctccagcatctgttgtttcctgactttttaatgattgccattctaactggtgtgagatggtatctccttgtggtttgatatgcatttctctaatgaccagtgatgttgagctttttttcatgtttgttggctgcataaatgtcttcttttgagaagtgtctgttcgtatcgttcgcccactttctgatggggttgttttttttcttgtaagtttgtttcagttctttgtagattctggatatgagccctttgtcagatggatagattgcaaaaattttctcccaatctgtaggttcctacagtttatgctgatggtagtttcttttgctgtacagaagccctttagtttatttagatcccatttgtcaattttggcttttgttgccattgcttttggtgttttagtcatgaagtctttgcccatccctatgtcctggattgtattgcctaggttttcttctagggtttttatgttttttaggtcttatgtttaagtctttaatccatgttgagttaatttttgtataaggtgtaaggaaggggtccagtttcagttttctgcctatggctagccagtttttccaacaccatttattaaatagaaaatcctttccctattgcttgtttttgtcagggttttcaaagatcagatggttgtagatgtatggcgtcatttctgaggcctccgttctgttccattggtctatatatctgttttggtaccagtaccatgctgttttgactactgtagctttgtagtatagtttgaagtcaggtagcatgatgcctccagctttgatctttttgcttaggattctcttgtctatatgggctctttttacttccatatgaaatttaaagtagttttttctaattctgtgaagaaagtcaatggtagcttgatggggatatcgttgaatctgtaaattactttgggcagtatggccattttcacgacattgattcttcctatccatgagcatggaatgtttttccatttatttgtgtcctctcttacttccttgagcagtagtttgtagttctccttaaagatgtccttcgcatcccttgtaagttgtattcctaggtattttattctctttgtagcaattgtgaatgggagttcactcatgatttggctgtttgtctattattggtgtataggaatgcttgtgatttttgcacattgattttgtatcctgggactttgctgaagttgcttatctgcttaaggagattttgggctgagattatgggttttctaaatatacaatcatgtcatctgcaaacagagataatttgactttctctcttcctatttgaatatcttttctttctttctcttgcccgattgtccaggccagacatccttccaatactgtgttgaacaggagtggtgagagagggtatccttgtgccggtttttaaagggaatgcttccagcttttgcccattcagtatgatattggctgtgtttttgtcataaatagctcttattattttgagatacgttccattgatacctagtttattgagagtttttagcatgaaggggtgttgaattttgttgaaggccttttctgcatctattgagataatcatgtggtttttgtcattggttctgtttatgtgatggatgacatttattgatttgtgtatgttgaaccagccttgcatcccagggatgaagccaacttgattgtggtggataggctttttgatgtgctgctggattcagtttcacattattttattgaggattttcacattgatgttcatcaggcgtattggcctgaaattttctctttttttgttgtgtctctgacaggttttggtatcaggttgatgctggcctcataaaatgagttaggaaggactccctctttttctgttgtttggaatagtttcagaaggaacggtaccagctcctctgtccctctggtagaatttgtacctctagtagaattgtacctctggtagaatttggctgtgaagccatctggtcctgggctttttttttctttggtaggctattaattactgcctcaatttcagaacttgttggtctcttcagggattcgacttcttcttggtttagtcttgggagggtggatgtgtctaggaatttttctgtttcttctagatttcctagtttatttgtgtagagttgtttatagtgttctctgatggtagtttgtatttctgtgggatcagtggtgatatcccctttatcattttttattgtgtctatttgattcttctcttttcttctttattagtctggctagtcctgtatctatcttgttgatcttttcaaaaaaaccagctcctggactcactgattttttgaagcgtttttcgtgtctctatctccttcagttctgctctgatcttagttatttcttgtcttctgctagcttttgaatttgtttgctcttgcttctctagtttttttaattgcgatgttagggtgtcgattttagatctttcctgctttctcatgggggcatttactgctataaattttcctctaaacgctgtttagctgtgtcccagagattctggtatgttgcatctttgttctcattagtttcaaggaacgtatttatttctacctttatttcgttatttacccagtggtcattccagagcaggttgttcagtttccatgtagttgtgctgttttgagtgagtttcttaatcctgagttctaatttgattgcactgtggtctgagagactgtttgttatgatttccattcttttgcatttgctgaggagtgttttacttccaattatgtggtcaattttagaataagtgcgatgtggtgctgagaagaatgtatgttctgttgacttggggtggagagttctgtagatatctgttaggtccgcttggtccacagctgagttcaagtcctgaatatccttgttaattttctgtctcattgatctgtctaatattgacagtagggtgttaaagtcttccactattattgtgtgggactctaagtctctttgtaggtctcttgctgtatgaaactgggtgctcctgtattgggtgcatatatttaggatagttagctcttgttgcattgatccctttaccattatgtaatgcccttctttttccctttgttggtttaaagtctttgttggtttaaagtctgttttatcagagactaagattgcaatacctgctttttttttttttttttttttttttgctttccatctacttggtaaatattcctccatccctttattttgagcctatgtgtgtctttgcatgtgagatgggtctcctgaatacagcactccggtgggtcttgacaatttatctgaatgccagtctgtctcttttcatggcggcatttagcccatttacatttaaggttaatattgttatgtgtgaatttgatcctgtcattatgatgttagctggttattttgctcgttagttaatgcagtttcttcctagcatcgatggtctttacaatttggcatgtttttgcagtggctgatactggttgttcctttccatgtttagtgcttccttcaggagctcttgtaaggcaggcctggtggtgacaaaatctctctgcatttgcttgtctgtaaaggattttatttctccttcacttatgaagcttagttgggctggatatgaaattctgggttgagaattctttttttttaagaatgttgaatattggccctcactctcttctggcttgtagggattctgccaagagatctgctgttagtctgacgggcttccctttgtgggtaacctgacctttctctctggctgcccttaacattttttccttcatttcaaccttggtgaatctgacaattatgtatcttggagttgctctccttgaggagtatctttgtggtgttctctgtatttcctgaatttgaatgttggcctgccttgctaggttggggaagttctcctggataatatcctgaagagtgttttccaacttggttccattctccccgtcactttcaggtacagcaatcaaacttaggtttggtcttttctcatagtctcatatttcttggaggctttgttcgtttcttttcattcttttttctctaatcttgtcttcacactttatttcattaagttgatcttcaatctctgatatcctttcttccacttaattgattcagctattgagagttgtgtatgcttcacaaagttctcatgctgtgtttttcagctccatcaggtcatttatgatcttctctacattggttattgtagttagcaattcagctgtttttcaaggttcttagtttcctcgcattgggttagaacatgctcctttaggtcagaggagtttgttattacccaccttctgaagcttacttctgtcagtttgtcaatctcattctccatccagttttgttcctttgctagcaaggagttgtgatcctttggaggagaagatgcgttctggtttttggaattttcagcctttttgcactggtttttcctcttcttcgtgaatttatctacctttggtctttgatgttgctgaccttcagatgggtttctgtgtggatgtcctttttgttgatgttgatgctgttcctttctgtttgttagttttccttctaacaatcaggcccctctgtggcaggtttgctggaggcccactccagaccctgtttgcccgagtatcaccagcagaggctgcagagcagccaagattgctgcctgttccttcctctggatgcttcatcccagaggggcactctccagatgccagctggagctctcctgtatgaggtgtctgtcgacccctgatgggaggtgtctcccagtcaggaggcatggggctcagggacccacatgaggaggcagtctgtcctttagcagagctcgatcgctgtgctgggagatctgcctctctcttcagagccagcaggcaggaacgtttaagcatgctgcaactgcgcccacaaccgcacctttcaccaggtgctctgtcccagggagattggagttttatctataagcccctgtctggggttgctgcctttctttcctgcccagaggaggaatctagtgaggcagtgtggctacagtggctttgctgagttgtggtgggctccgcccagttcgaccttccttgaggctttgtttacactataaggagaaaaccacctcctcaagccttagtgggggcccctccccccacctagctgggcgcccctccccccaccaagctcgagtgtcccaggtggacttcatactgctgtgctggcagcaagaatttcaagctagtggatcttatagcttgctgggctccgtgggggtgggatctgctgagctagaccacttggcttcctggcttcagccctctttccaggggagtgaacggttctgtgtcggtggcattccaggcacctctggggtatgaaaaaaactcctgcagctagcttggtgtctgtccaaacggccgcccagttttgtgcttgaaacccaggcccgtggtggcggaggcaccggaggaaatctgctggtctgtgggttgcaaagactgtgggaaaagcgtagtatctggaccaaaaatcaccattcctcaaggcacagtccttcatggcttcccttggctagggaaggagttccctgaccccttccacttcccgcgtgacgcgacgccccaccctgcttcagctcgccctctgtggactgcacccactttctaactagtcccagtgagatgagctgggtacctcagttggaaatggaaaaatcacccaccttctgcgttgatctcgctgggagctgcagaccggaactgttcctatttggctgtcttgccagccactcactttttttttttaattaataatggcgtctacctatctttctgattcatttctggcaatccacaataacacacatttttcataaaccatattggtgataaccaaggtcatgttgacctctttagaatgtcagaataatttttatgcatattaagaatttggggtttccaactttatttcctttttggctaaatgatagtttaatatttttttccttaattatatttcactggaaattaaatagctattaaagtagatcatctgcaaacattttatcaatggctattcagaacttgagaaataatactttataacacattaatttggtcacacaatgtatcctagctttggaaaatctgtgaaacaatttttagaaaaagtaacagacaggtagcctttctcctttgtacacagtatctttctatccagttttgttatcatggtgaaggcattttaagctataattagagatctaaatttaagttaaaataccattgtgtatgttgttaacaatacaaataactcagctggggtggtaattgaatgaatatacagcatctgtgtaaggacagctaagtgtacacttagctggcaatccgtaatctcctgtgcatgatcatctgaaagtttttctttttttctaaaaatctactttaaaacaaatcttgtttttggaaatgttttcatacaatgatggactttgcttttatgcttatgaaattctgcctctttcatggttaaccaacagtcacctttagaggtttttcattcttcttaccccacttccctcctaatacaaatgcttgggctttaccttttggtggggaaaacaaacaaaaaaaaggcttcagtacttctgggatgctacacagacaactatttttaattaggaaattcattatatagatttactttctcttagagtatcaatggtagtatagcctcatgcctagataagcatgtgagatagtattcatttaaccagttcataataggtaaactcaagtttctgctgtgaagtgtaagatgtataaatttctaaaatatttttgaggatatcacactatttaaactcaggttggagattaaattgaaattcatgccttttatgcttctgaaatgctatttcttctgtgaacattttagcttattagcaaggtggcaattttttcccaagctgcacattttaaatgttgcattgtcatgcttaatgcttatttctctttagaattctacgctatattctcatgacttagcttatttatatgttattaccatttaaaagaaaggccacagtgttgcaaataatgtcccgattgatttgaacatactattctggttgaccaaaaactacagtatatagaattagaattacacatgtgcatgcatgcgcgcgcgcgcacgcacacacacacacacacacacacacacacacacacacacaaagaatcattagccaaacgtgagacttaacttcatctttttatctttatgtttctctccaccagtggtcatgtttttcaaatccttattcaagccagtttctgttctttggttttattctgggttgtactgtgacagtctcttctagggttggatgttccgtcaagcatatctatggtactattggctgagcttaagccagggagtaaccaaccaaaactctcagcccttgtacagttatcttgaaattcactttttattaatatgcattttacctcttctagtttttcttgatggaagctatgaaaataaaattagagtgaaggagttttgtcttcttaccatctattaacgttgctatgattcctaagcagtgagattcagttttgttactgttattcatttttttgtttttgcatgaaacataatttgttttcactggtagcttttatgatacttaacaattttttttttttggaaaacatttctgtagttttgtatgactttggttttgtgtcttttctttgatttctttatttctgttaaagaatcgctcagtctcatctgcatctctagtttggtttctttagatgtctctttctttattaatgtaaattattttaattttataccatttttgctttctgtcactctgaagatttttaattcctttttatatctctggtcatatttccttttacagtcttcgtattccaccttgctaagataagatttacatgtctgatttgcaacgtctcttttccttctttgtaatgaacttcaaatttcttctgtagattttaattgcacatataatgtattctaaaattattttaaaaaataaatcaaatacttattagttatttcagttttctgtttattttacctgttttctgttcagtatctactcaaaatacctaactgttgccttgaactgtgccagaagtatatagtggctaattctagttgcatcaatttctgttttggaaaacatttttttttgttttacaattttgaatggaaaactttttttattcaaaatttctttaataagaaggcagccaaagcttatattgattttctaagaataacctcatctggcagattttcaaatcatatatatgtatgtgaaaatacttttgttttttgtgacaagggtctcacttttgcccaggctggaatgtatggagtgcagtgacatgatcacggctcactgcagccttgaactcctgagatcaaatcatcctcttgcctcaccttccccagtagctaggaccacaggtgtgtaccaacattaccaatatacctggctttttttttttttttttttttagagatggggtctcactgtgttgcccaggctggtctcaaactcctggattcaagtgatcctcctgctacagcctgccgaagtgctgcaattataggcatgagctactgtgcccagctgaaaatacgtttttaagacacactgaagacaacatttctgtacttttaaaatgtaacgacataatatagaccagaaaattactgcatctttccagtgttgcactctatattttccaaggcttgtcatttggataacaactctggtacaataaagtcatggtataatatcttttttccctttagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtaagaagacattttcagtaatgtctaaagcaaactatttttaagtcaataagatgtattgaattctggttggatttaccttagtcccttaaccttatttcttttccaaacattgctagacacatagtctcataaagaataaagaactaaagagaaaaattcttaccagaaatgagtatagtaaaatccacttgcttgttagtctctgctgtggtagggttttaaaattcatttaaaacaaaaactgaaaattagtaaagttaacattctttatcttgttttatttcattatgccatttttatcatgaagtactattaaatttagtagcaaacaaattctgtcgtgcagatgagttatactagtattcactcaggaagcataaagtcttatttctcctgatttacatgatagaatgattaccagatcaaagagaagaaaagttcatcattaccatcaatctctgggctcatacgttactgggtatagacctctgcgtgtcatagaagaatttcacagggagattttttttttaattacattaacacataaaggtactagactgtgtagtttgttgaattcctaattaacattttaaaaatcattttgacgtagttatttgaagttgtaatcaaggctataaaacatataggtattagaattttgtacttgatagattatgcttgaatgtaggggaaatgtatataaacaggttttctttaatgtaagggccactcctaaaattgtgtaaatcatacttttctgttaattctcatactttctctgatgcctcatttttatttctatttgtgaggaagtatactaacactgaaatcagtattgttcagtcgcacttctgctgttcattactcatatgaatttgtacaaaagtcactgaagttttctaggcctctttgtcatcaccaataacttgagatggtcttgacaatccttgtgctgacaaatgattttcagctaatactgatctttctgtccttctttccatctaacattttgttaatttcttaaacatattaacatactatatcaaaagctctttatggtaaaaagaaagaagattggaactctgttccctggcagtactactaactacagatgtgcatcacttaacaacagggatatgttctgagaaatgtgtcaccgggcgatttcatcatctgggagcatcatagagtgaacttacacaaacctagatggtatgtgtaagttccacaaacctacttctcacctaggctatatagtattgcctattgctcctaggctactaacctttacagtatgctactgtactgaatactgtaggcattttaacacaatggtacacaaatgtgtatctaaatatatcgacacagaaaaaatgcagtaaaaatgtagtattacaatcttatgggaccactgtggtattgttgaacaaaacgtcattatgcgatgcatgactttttggctttcaagtcatttgacctttcttagctttgaattcttctaaaaaatatgggagtttgactgactaatttttatttctaactcaaaagtcatttattttgtaaaggagaaaacccttttagtaatgaaataattaccctttatatttggttccaaattttagattgttaaatttggcttatatattgtaccaaaagtcagatcaaatgctgatactcatttaggtttatgattgtgttgtgttctttcactgtctgctttagtgtgtttactttgtggatttggttttatttttaggtgcctcctttaattcctaagactgattcagaccctgaacatcgccgagtttcggctcaacttgacgataatgtgagttaattttattcttggtagtatttagtttaagtcatacttggcatatctttttaactttttaatgaagtgttctatgtatcattaatgtgcacatattataagtgttaagcttgatgaattcttacaaactgaacatgcccatgtaattaacactctaatcaaaaaataagattatcactactccagaaaagcccttcatcctctgttcctgttaggaccttcgcctccaccaaggaccatcactatcctaacttctactctgcttttatactttgtatatatgaaactgtaaggtacgtattccatgaagtctgacttttttttgctcaacattgtgatgttcttccatgtggttttgtatgattttagttccttcattcttgtggctttatagtattccattttgtaaatatagtacaatctatttgttatatcatgaataatacttctatgaacattcgtacatgtctgtacatgtttctattggatctatacttaggaatgaaattgctgtatcaggatatatatatatatatatatatatatatatatatatatatatatatatatatgttcagttttagtagatactgccaagtactttttcaaattatttgtaccacttacattgccatcaacagtacatgagagttccagtgttctacatcctgccagtactcagtattttgtttttttaattttagccattctggttgttatatttcatgcgaatttgcgtttctgtgataactgttgaaatgttacacacctttttatatgtttattggccatttgaatgttctgtcttatgcgtctgtcaagaccttttgtcatttttctgttggcttagctgtcttagttcttagctatcttagttcttttgattagtaggagtgctttatgtaatctgaatgtgagttgtttgtcagatatatgtaatacattgtcttctctctaggtttctttcttgtgctatatatgttatctgtgcctattgcagggtcacagagatgtcctataattttctttaaaaacattttttgttttactgtaacaacatttaagtttgcagttcatctgggattgatttttgtatatggattgaagtatgggtccagttgatccaagcaccatttactgaaaaggccatcttttccccactgtactgtttctcccttatcacaaatcaggttaccatatatgtttggatctgttttattctgttctattaggcagatttattttaagttgtaattatctcctttctgtttctaatcgaatttgtttataatcaactgtcttaatcaaaaataatattttcatttggtttttcaagattattttaggatgtttattatgtttattgatggtataatatccataacattgtacctttggtatgtggtttttacagtttagctatttattagattttcatatggcaccaaactcgtaggaatatacttgatcagagaatacagaagtttttattctgtctcagtaatgaaatgggtctccctctccctactggttttgattaagctgtatgatttcagtttttgaaatggaaggtgcactaaggaaatgtttgtaacgtgacagtgaaaaatgtataactcatgctttcttgccagtatttaaattacagtgttgatgaggaaataattggaaacagtttctcagtgatgaaaaaattataaaattactaacaattatatgtggtactaaatctgtacctgctttttattttatacgtatttttttgcatcaaagcattccgatcgtcttcctttttaccttagtggttgtatacttagtggttgtatactcccataatactgacttttatttgctaaaagctaaaagaaaattctagtaatttagtaaactatgccttttgtaatgtgaatttagttgtgtgatggattgaacttcagcatctttttcctgaaagtacataaatacatacaatttactaactaagcaaaatacattattctgtatcattcatgttttgttctattaaatatatggagatgttgagaatatcttattcttgtgaaaaagatgcatcagaaaatagacaaagggtctagcatttgccttatcaaactcatacagtctcttccaatagtaagaaccaaatcatcttttcctaggaccatcatgaatctactttgccttgaaaatgttaaactatagccttaaaatttattcattattgtggggctatgaagttctgtattctgtcagaatgactactagaaatattttttctacattagaatttaatgtcaagttacaaaggctaaaatgtaacttgttctctgacttgtgaaatatcaatcatttcgtaaaagcaacaaaagtaacaattcatagtagatagctaactcaaacttattcttatttcttatattttgtcaggtggatgacaatattccacttagggtaatgctgcttctcatggatgaagtattcgacttaaaagaaagaaatcagtggttgcgaaggaatatcaaaaacctacttcaacagcttattagagctacatatggcgatactattaataggtagcactctttcctcctcgcttttaatctgatcttacttagctattaaactcttacttctggaagtagattgctcaacctttgtaggagaatttttttctctgggccttttaaggacatcattaaagcagtctgttgctctcagggataatttacatccagattaagttgcttgctctatgaaagtcacgtttatttttttcaccttctaaaattttaaccttcctcatttacattaatttactttcagaaaaatagttgaccatgttgactggatgacttcacctgaacaagtagccgactcagtgaaacgtttcaggtatatcttaagacacagtcacttctttcaggtagtacagagtttagcattgttatcactaattaactttcattgcttttgtttccttcctggacataaagttggtttagttatcattgatgagcaaaaagacttctaagaattatactaaacatttgtcttatgaacctattgatctttgtttctttaaaaccagaataggaaaagtaagaagaaagatctttcaaatgataggctacattttatcacagtaccatggctgtaagataattgaaatattcacctaaaaatgatatggttgtatcatcaaatatctagttttggggattagtttttctcagttgtattttctaaccttcattttaaatgaaattgttttaagtaagtctctctggctatgttgtaattttttattaaatattggaacctctacaaggaacaaaaattaagtaggtaccctacttcatatttctttctacaaaaaatactgagcgcctcctctgtgcctagcactcagcccattgctgagataagatgcagtcccttgaggaaagtacagatagtagagaaataaacctcttttctgaaagtgaagataagcaatgcgtaaaaattcatggcatcatgtattttgaagggaaggaaaggaagcaagaagggaactatcagtattgaacactaagttcttggcactgtgcacagtactttatgtatgctttctgattttatgccatttttcgaggtaggtatttttgtctctattttgttataaggaaattgaggattagagaagttgaataggctctcaggctacaaagtggggaatctggtttctctaatctgaagctaagtttcttcccactgtaccatactgtttccaaaacttggactagctgccctggcatgttcattttatttcagggtaggtaaatgatgttcctctggagtggtgattatcagctttggctgttcattggaatcacctctagagctttaaaaattactaatgcctagatcccatgtccagggagtctgacttaattaatccaatgaaaggcctgaacatgaagagcctgtaaagctctcaggtgcttctaatgtgtaaagttaagaacagctgctctggggagtcttgcccttacaccaaattcccagatgaaagcttagtttttgtgctcagtccctgccttcagaccaagaattagggaacaggagtaaagcacactgaaagttaagaagaatgggttgttttacttgtgaaaggaccattatagtcaatccatctgtaagttgtgggcttagaatttagtattatgtaggcttaattataagaggagtgggatggcataactgaaggagatagctattaaactctaaggcattgagattcaagatattgtagggttgcatttggatgagatgttcaatcagcagatgcccactttgagtttaaatggctgtgatatagtcatgtacatattccattttgctgtcttcattagtgtttatgaactgcattggtgcagactttatctggtatttttcttgtgttcgttttttttgaacccctaaaattgaaccctacacttagttgatctttcttgaatatcattatagctatatgttattattcagaaacttttctttctgttcacatttgtattttctgtagaaatttgaaataattttatcaacttgtatcattagaaaatgaaaatgtttacaaaatgtatttaatcttctcaaatagagatgcattttggccaaatggcattttagcagaggctgttccatgcagagataaaagtattcgaatgagaacaagagtagcaggaaaaacgaaattacttgcaattatgccaggtgagtgagcatgtatagttaaaaatctttataatttgtcattcttctgagtttttagcattcatcatgccagtgtaactgccttttgattataacaactaccttttgatggcttaatacatatcaggcactgtactaggcatttctcatatgttcttaatcagtcctcatgacagtactgtaaagctaaggactgttaacatcaccgctttatatgtgaggaaacggaagctcagagaggttaaataacctatccaaggtttatagctactaagcaacagttggtattctgacttggctttaagtgatgtgaaagcttatgcttttagccacttcgctctgctgccttgaaacatattgggagttaagttaaataaataaaatacatgacaggtgaaagggctaataaaatataaagtatgaatttttcaggaagaatatttgttgtacttaggaaaacaagttatttcaaaaactccatttacatagaaagaactgattggctgattattaatctttattacttaaaatacaatcccaaacaaagtatacttagtagcattttgttggtctgattttggttgcttcattagggtatagctatctcactaccttagatttactttttctcgtttttcttctttcaatcagagaagttatataatgtaaaaagcaatttaatgcggctgggaggtggtgatggttgttttgccccttgttaatgagtatctttgaaaatgcctgcatgtcttttctctgtattttaattctggatgtagagaatgaacagacatatttgtacattctttaatatcacacaataccaatttttttctctaattttgttttcttacctgtattttctctataaattttaatgaccagccttctcttctgtcaattaaattaaaaatttgccacaattttaattcttacctatataccgtttcatttgctgataaaaaagcaaattatagaaatgacattttagaaaaataagaaacaattgcttaggatattatttaatatactattatagtaaacctgattgtgctatatggactgactcagttatctagctggaagaaatctttattcactaaatatttattgaaagttattatgtgccaggtgctgttctttgcacttatgtttgccttcttggagcttactttccagtagaaatagagagactcaaaaacacacagaacaaataaatggaacgtagtttgttagataagtggtaagtactaaagagaaagatactgcaggaaaatggaatagatagtgtcagatgagttgcagttttagatggggtggccaggcaggcctcactgagatgatgatggtggtgtgaagatctgaaggaagtgagggtaaatatgaaagcatataaatttatatatacataatccttgcctattttttagtaaattctcaaaatttttgctttaaattatatcttacccctagttagataaagactttttggaaattgcatgtttctttccaaagcagcaaaataatatctatattatcagtattatgaataattatttgtaattatgaataagaatatgaataattaataatcatacatgttggtctcataacttggtgttatttatgattaaacaccaaatttgctcactcttagtcacagcaccatcggttttctattttctttgctttcttcactttgaatttaaataaaattcaacccaacttgtactatccctatttcttgagcatgctttgttattctagttactgcttatttgctcattcatgttcttttcaccaaggctaatccttcatctcattgcacctatcaaaatcctgcccaagtagaaagtctcctttacctgccacttccttaaagggaacttttctttgttatcgcatctgaaagtctccccactaccaatattcttatacttttagcatttttatggtatagttactatgccaggggtttttgtagatcagggattaatttttttttttcctgtgttccaatgaaactttattcaccatcatggattagtttgtttccttacagcatttgtcactattcattaggcctactaagaatatttgtataatattacaaagtttacagatcactttttacattatttcattaaagacttataaatccttataaggatgttattataaatcctccttttcagatgagaaaagagagtcagggtggtgggtaagtatcacatgggtattaagggacatgtttgtaatcatagtttgggatctttgagactgttttttattttttatctcttacacctgtgctatattgtctcccagtagcttttgcattaagtgcgtaaatagatgcatgcatgcaaagatgcatattaagtttcagctatagtacatagctgaaatgcattaactggttacctactgttcatcagttactctgctgtgtaccttaatttaagaacatttaagagtttaggccttgtgtttcctttgaataattatgtgtgttttcctccacttcatttagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttgg

SEQ ID NO: 37882 - DNA, 21083 bp, Homo sapiens
ggggaaactcatttgtggagaccagccctctggcttggtgagtgaatctggtttacaccggctcctgccctgccttcactcttctcccctgattcaagactcctctgctttggactgaaggtgagtggagcaatctgtgggagcatagaatgggaggctttgagaagaatagattgattgtgtctgggtgagtttaatttgtagttctgaagctgctctgcataaacaaaaagaggcagcttgtgaactgtctgctgagatggcagaggaagaaagcactgagtctgggagaggggtaacctttaaagaagagaggtttgcaaaagcaaaaagccttgcttgtttcctagagggaccattcatttcttcaatctaggtacctccatcaccttccttgttggaaataaagctcagaatcttaagggagacgagcactcaaacaaaggatttctcagcaaagcaattttatttctgtgcagaggggtgcttcttctttgccagtcgccatgagagcacactagaacaaaggaggaagaaagtttttattcctgacgcaaatcctacccctttgccctttccccattggctggagtcggccacacaatctaaactagactcagttggctaaacattttaactttctttagataaggtgggcacgtgagggagagaggggagatggggaaggggtgtgtgtgatgagctagataactaatcttcttccaaaataaggaaaggaatgtgagttggtactgataacgcctggtactgtgacatgtctaggcatgtagcaaaagcagaaaggaaagagaagagaagaaaagtgaagtggggaggggcactgtgaattaaagaataaaggattgatcaggctatttgaagagaaaccttatcataccccacattcctattctgtcattttgatttttccattttgccaacgtggatcagaattttcttttattcagaggcagcaaattccttcctcctttctcccgaagaagcctgtgcaatgaagctttgttttcacttttcataaagcaacctcatgatgaggttcagcagggatgagagcccttatctggatctgggtatgaggcgaaggagtcttaggtactcagtcttcagaagtaaggcccttttgaaggttatccttttacttgccttctggtaactttttggatgctgtccatagctttcctgataaattagcagccctctggttagtccgaggagagaggccgcaggacgggcagactgctgctcatctctgcagctccactttggtctcttgtctctgaaggtccagtcacagggaacttgttcttctgagtacccacagcttactcttcctttgtagcaggaccagccacagaaaaaactcctcagacaccgaggtaaagaaggaaggggtttattcggccaggggcataggcaagactcctgtctcaagagccgagctcctcgagtgagcaattcctgtcccttttaagggctcacaactctaagggggtccgcgtgagagggtcgtgatcgattgagcaagcagggggtacgtgactgggggctgcatacaccggtaattagatcggaacaaaacagagtagggattttcacagtgcttttctatacaatgtctggaatctatagataacaaaccaattaggtcaggggtccatctttaactaccaggtccagggtgtggccccgggctgtctgcttgtggatttcatttctgccttttagtttttactttttctttctttggaggcagaaattgggcataagacaatatgagaggtggtctcctccctcaacttctgtagcacccaatgaacctctggtatccactcctgttttagaagttgctattattctaggtacaccttttcatcatgagttacctcaactccctactcaattttcccttgcacagagctaaggcaaggagttggtaatttctcctgagtcttatctcgatcttatcgctgagcattttgtaccttgatgcctatgtcacccatattctgatgtgtccttttctttgtttcacttttcagaggtccaggtaactgtctccttatgtgtctgtaccgcacatcttgtcaaggtccatatctagtatttattcattgtcaagtctagtacaggacccaataaataaaactgtacttttaatttttgaaaaatatttttgactaaattcacaaaacaaaagcatacaggtatagtaaaaaaacaaaaacaaaaacaaaaaaactatctattcgatatataatcaacattaaataccggtaagagattatgctctggactagggaaaaggaagtaaacacgcagtcaaaaaaaggaagtaaaccagcagttttaatgtagcaaaaaggtagcagttactagaggataaatgtaaaaccaataaaacaaaagcaacaaactaaaagggctgcaataggatgtggtatctgtagtgctcttgtcaagggctttgcaactttaaatagatttcacattaggtctcactgtgagacaatgattttgagcagtcttcaataaaatgatggatttaagaactgatgaactaactgtgagagaaagagatgacactggggtagctttatgaaatctgtcctctgttacaaaatgacttatctgaaacatattgaccagagagttagaactcttggaaaaagggtcattacttggggaaaactaaaccctggacattttagtgggtcattgaaaaaggaactctgagtttagacaaataagaagtggtaacggtgtttctgagttctccaggtttctgcatgccaagaacaggacctattttctccattggtagttcctgacccaaggaacaggggaaatttaaaagatgttggctaggccaggcacctggtggcttgtgccaaagcctagccaaaaatcccagcactttgggaagccaagactggaggactgcttgagttgaggagtttgagaccagcctgggcaacgcagtgagaccttgtctcaaaaaaaaaaaaaaaagatattgatggctaaaccccttataatttttctccttattgtgtagccacactaatttaatttaatctttttttttttttttcttttgacggagtcttgctctgttgccaggctggagtgcagtggtgtgatctcagctcactgcaacctccgcctcctgggttcaagtgattctcctgcctcagcctccagagtagcggggactacaagcaactgctgtcacacctggctaatgtttgtatatatatatattttttagtagatacggggtctcaccatagtggccaggctggcctcaaactcctgacctcaggtaatctgcccgcctcggccccccaaactgctgggattacaggcttgagccacagcgcctggccatcttttttttttttttttttttgatttaaattgcacagataaagaaagcttctgtgcaggtaatcagagtattctgaaacaaggaagctacggacctagttagccttcaccgtgtcatagaaacttctacattcgcaccaccttcaaaggggagcatgcattttgtttatgtgtctgtctgtctacctgtcttaggtcggaagggtttcaatggggctacatttcttcaatgttagaataaagaatgaataggccgggcgcggtggctcacgccagtaatcccagcactttgggaggccgaggcgggcagatcatgaggtccggagatcgagaccatcctggctaacacagtgaaaccccgtctctactaaaaagacaccaaaaaatcacccgggtgtggtggcgggcgcctgtagtcccagctacttggaggctgaggcaggagaatggcgtgaacccgagaggcggagctggcaaggagccgagatcgcaccactgcactccagcctgggtgacagagtgagactccgtctcaaaaaaaaaaaaaaaaaaaaaagaatgaataaatcaagaaaaataagcacttgtattagttttctagagctgtcatagaaaaagtaccaaaagtggttggcttaaatagcagaaatatattgccttacaattctggaggctagttatccaagataaaatgtgttgacagggctggttccttctgaaggctatgaaggaggcctctggtccatgcctctcttctagcttctaatagtttcctggaaacctttagcattccttggcttataggtgcatcaccctgatctctgctttcttcttcaccctggcatattccttgtgtataaatgtccctttttgataaggacacagtcatgttggataagggtctaccctaatgagcacatggtaactaaatagtatttaaatatactagtttcaaataagagcacattcacacattaggatttcaacatcatttggggagaaacaggacagactttatctctctgctacatattctcaatgtacttggcctcctttatggattgagacttttctcccatgaccaacagatgtttctttgaaatgtatattgagtctatatcatgtgtgtgatcctataactattttagcctcttttcctcttcccaaaatatatacatctttaggttcctatcaccatccttgccatatgtccaggccaaggtgaaatttcaacatttaaaaccacagcatgccccagaactacatagctggtctggatctctccatttctatacccccaatagcactgggtatcagtatagctcttgtagcctttacctttgttgtctgtataaatctgtgctgcagtggagagaactctgaaggaggaccttggggacaatacattcactcttactctacctattagattagaatgagtgatctttgtaagtcacttgattctattgacacacctgaagaaagggagtattcttatttctcaagggttttgtatgaagaataaagaagtcaaaatgatttctaaattgtaactgcttataaaattgttcatgataaaattattttcctattatggtgttggtggtggtggtgtgtgggtgtgtgtgtatgtctttggggatggagtgtgaggtcatgggaggacttgctatgggtagatgtgttaggatgtaaacacttcttcactggaaaccataattgtggtcccaaaggtcagctattgggaaactgctaattgatggaaagaaaagatgaaaatctgattaaaaggtctaatcatctatggagggataaggaagttgtggctttatatattcgttaaatgttttattcctgtatgtgattcacttttctaggtatagaggacatatcagtgaacaaaaaaagtcccaggtctatgaatggattacttttcaggaggaagaagtagacatttaaagaacaatcttatatattacatagtaaaaataagaagctaaatgtgcagtgagtgacagtactggtggttttgctataagtaaattatagtatgtccttctaagaagaggacttctaagaggagactgaattaaatgtaagagtgagtcttgctaacatcagggggaggatcattttatgcagagagaggagcaagtgcaaaagccttgaggagccatagatttgatagtttaattgaggaggtattttttacatggggaaaaaagtcagaggagataaaccttaacagtataagtaaaataattcagacaccaaagacatatattatgattctatttttatcaactgattaaaaacccaaaggatattagtagtggttgcctggagcttgggatcagaataggagtgatggcattagggtttttttttttcaggtgataaaaataattttaaattgggttacagtaatagttatatagttccacagatttactagaaattattgcatgatacacttaaaaatgatgtttgatgcagtgtttgatgctatgtaaatacaattcaatagcttaaaaatatgcaaatattcatgaatcatgcaaatattggggatacaatcatgccattcagagagaaaagcctgtgtgcaagcccaggggcaggggtgtgtttagtgcatttaacatggaaaatgtgttttgggttggggaacaaaaggcaggacaaatgatgggttacacgaagctcttggtagaagagcctcagtttgtcctctccagtagaagagaaaataacaataattgccttgatggggtgaaatttgtcctgagacaaaaattaagaataaagtgtttgaaattactacaaagtccattttattctgtcattggtttattcttcatgcctttcttttctcctttctctgttaaatattaatgttttgtcctgttctaaatctctgtaaaagcagtattctttctattccttcttttcttaccctgtccccttcaacattctcagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggtaggctccaagatagaggaagagagagcagagagcagaagatggtacctaatgtgaaatctccactttttttgtcctgctttattccccttgtcaccatagaacggagagccctgtgatctctttccatactctttgcttagtttctgatgcctgaaggacactgctgcacattgttttatttaaaaaagagtacaaatttttagcaaggaaaagttgaatgaatggagaattgctttgtaagataagctttcattgcccctccaagaagaacagtatttttgggaacacgtctggttagatgtgggaagagtggcaatgaaaggacgtctttccttactgcagggtctgctttttctctaggaaaagaatcaggctactcttgataagaggatggtgacttccatcatccaggaataaagaatacattcatctcctcagattttcccccatgccataggttctaatcaccagcctcactgtttctgtaaactagtttcttctgagagccatccaatttcttccttgctgtcctctattcaggtgctgagaaagctcataactttactctggtataatttatttcttacaggaaaagctgcaggtagccctgcagaggctgataaaggaggatcaagaggctgagaagctggaagatgacatcagacaagagagaaccgcctggaaggcaggaggagacacctcctaagggataattagacaggaatctgggcaggaccctgggctctatcacaaggagaccccttcctctttgctgtgctagaattaacaagcatagaagtcatttgattaggtctcaatttaactccttccctgttggagtttaggggctggagagtagacatatcataaatcaacactatatttggaagtgaaggcatggagggaaatatctgtgaaaacgcttcctgtgaatcctgtgttccatttgtgtcatcaggtttgaggctccaatccttccagtaaacaccctggagaaagacccaggattccctgtttagggggtttcagtagggggatttttttgtttgtttgtttgttttttgagacagagtctctctctgtcatacaggctggagtgtagtggcgcgatcttggctcactgcaacctctgcctccctggttcaaacgattctcctgcctcagcctcccgagtagctgggactacaggcatgtgccaccatgcccagctaattttttgtatttttagtagagatggggtttcatcatgttagccaggatggtctcaatctcctgaccttgtgatccacccatctcagcctcccaaagtgctgggattacaggcatgagccactgtgccaggccaggtagagggatttaagatacagaaaggcaaagttgttcaggacaggtgtctacaatccaagcctcacccaggcatcacattttgtctcagattaggcctcaataaaactgacttgagtgtattgctttgggaggagctcaggttaaaaagtagaaaaacatggcttcaccagaaattgtgtattggcttttgcctcctattccttttgagaactccctgaggaaaactgttcttatcctgtctcccaggctcatacaaagcaggccttcaaccagccagactgactgcctctttctcttttcattcccaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggtaagacttgggatggagcacctacgtaagagattaggggaaaaacacagaggccgattttccttcccttcccagtctctaggctttcttctgtgtggtgacatgaaatggttcctttggcccggcatgccccttttatgcccatcatttcaggggtcacagagatcattaagtgtatgaatgggaagggaaattcccattattattcacttatgagagcagtgtaaaaatttgagcttggagaggattctttgtaccatgagcatatcagttttagaactttcccatcacatcaaaaacatttctcatgcctgtttgcagtcaatatctgtttctacctccacctcctggcagcctatctgttttctgtctgtatagaattggcttctctggacctttcaatatgaattgaattataaaacatgtagtcttttgcatctggcatctttaacttagcataatattttgaggtttatttatattgcagtatgtatcagcattttgctcttattgctaatactattccattatctgaatatatcatattatgtttatgtattcaccagttggtggctatatgaatattttccagttagggactattatgaataatgctacagtaaacattcacttacatgtcctcatacaaacatgttttcatttatcttgagtagattttaagagtgttgtatgttgtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcaatgaaccgagattgcgccactgcagtccgcagtccggcctgggcgacagagcgagactccgtctcaaaaaaaaaaaaaaaaaaaaaaaaaaaaaaaaaaaaaaagagtgttgtatgttgtttatgtataagttttaagttgtcgtactattttccaaagttgttactcactttatatgagtaacaatacaaaagcttataaaaagcaatataaaaagtttctaggttcttcacatccttgttaatacttgattatttcctttttttttttttttttagttacagcctttctagtgggaacataatggtatctcaatgcagttttgatttgctttttcctaataactaacactgctgaaaagcttattatttccacatgtagattctgtacctttttaaagagttttttctgttttacttttggtgctattgtaattttttttttatttcaaatttcaattcttcattgctggcacatagaaaggaaactgactttagtattttaatcttgtatattgcaaccttgctataattacttattagtcatagaagagttttttttttaatgtcaattctttggcattttctacatggagaatcatgtcatctgagaataaagttaattgtttcatactctgcagtttgtatggttttttttttttggtgtatttttttggagacggagtctcttactgttacccaggctagaatgtggtggcacaatctcacctcactgcaaccttcacctctcaggttcaaataattctcctgcctcagcctcccaggactagcgcacaccgccacacctggctacattttttttgtattttagtaaagacagggattcactgtgttgcccaggctggtctcgaactcttgagctcaggcaatctgcccgccttggcctcccaaagtgctaggattaaaggcgtgagccaccgcgcctggccagcagtttgtatagtttttatttgtctttgcttgttttattacactagctaggacttctagtacaatgttcaacagggatggtgagaggggatatcctttccttttttctgaccttagggggaaagtactcagtctctcacttataagtatgatgttagctataggagtctttttttttttttttttttttcagatttgtaatgaagttgagaaacttcctctttttttcttttttttgagacgcagtctcgttctgtcacccagactggagtgcagtggcacgatttcggctcactgcaaactctgcctcccgggttcaagcgattctcctgcctcagctgggactgcaggccgcccaccaccacatccagctaatttttgtatttttaatagagacagggttttgccatgttgggcaggctggttttgaactcctgacctcagatgcacccggccgagaaacttcctctttattcctagtttgctgagactttttatcatgaatggtgtgaattttgtcgaatagcttttctgcctcagttgatataatcatatgatttttcttctttattgatatgggagattacattaataattttcaaagattgaaccagcttgcataccttgaataaatcccacttacttgtggtgcacaatttttatatatattttgttggatttgttttactaacgtactgttgagaatttttgcatctgtgttcatgagagatactggtttctggttttcctttctcataatgtctttacttggctctggattagggtaatgctgacctcatagaatgtgttacaaaatagtccatctcctttcattttctgaaacaaatttggggagaattttaataatttccttctccaacttttggtagaattcatcagtttaccaataaaacccactaagcctatttttaaagtgttgcttaatattttggagtattacagctgtctgttactgattactagttaaattctattgttgcgtaagaaaacattttgtatgagttcaattgtttacatttgttaacgtgtattttgtggtatagaatgtgttatagcttggttaattttcaatgtgagcttgagaagaatagatatttgcctttagatggaatattctatgaatgccatttaaatcagttgctatatagtgtgctgttcaggtacaactgtagcggtaatcatttcctgtggctgctgtaagaaattgtcacaaactttataacttaaaacctcatacaaaaaaattgtctcatagttctgaaagctcagagcccaaaatcaatgtaccagcaaccaccagaagctaatagggaagcgtggaacagattacagcagggaccaacattaccaatatcctgattttgaacctagcctcaagaactgtgagagactaaatctcggttgtttaaaaaccatacagtttgtgctgctacgttgttagagcaaccccagaaaattaaaacgcctaccatttttcactgttttctattgaccgtacttgctctttgcttttttttcccttcctctctttttctgccctcttttaactattttgtattattcaattgattattttatattattcaattttctttcctctcttagcttattagttatatattactaatatacatcacaaatatagctatattagttatatataatatacataactaatatatattagttatatattacatatacataacgaatatatattagttatatattacatatacataactaatatatattagttatatattatatatacataactagtatacataactaatatatattatattatatatagttatatataatatataactaatatgcctaaaggtatatatataaatataactaatatgcctaataatataactaatataactaataataatataactaatatgcctaaaggtatatatataaatataaaacaaacatacaaatatatttgaaatataaaaatattttaaaaatataaactttttataaatatataaaaatatattttaaaaatataaataacactatacatatatatataaaggcttagtggtttccctggagtttgcaatatgcatttacaactaatctaagtctaattacaaataacactataccccttcacatgtagtgcaggtaccttagagcagagtatcctcaatcttgagtaacgttgctgtcattcatttcacttatccataagctgtaatcgcccactacattgttgatattattactttaagccattatcttatatattagttgagaatcagaaaaacaaaatattttatttacctttacttctttttcagtgctctttctctctttgtgaagatctgaatttcagacatatactcttcttccccctgaataatgtcttttaacgtttatggcaaagtatttccttcattattgcgggacaaaatttctgaatataaaattcttgagtcatgggtgttattctttcaaaactttaatatttattccacatgctgaacttttactagttttagtagttgtgtgtttgtgtgtgtatattctttgagatcatttacatactgaatcatgctgtctgtaaataaatatagttaattttaaaactgcaacttttattttagatacagggagtatatgtgcaggtttgttacatgggaatattgggtgatgctgaggtttgggatacagatcccatcacccaggtaatgagcatattacccaatcagtagtttttcaactcacacaccctcctccctcccctagtgtagtctgtagtgtctattatttccatatttatgtccacgtatgctcaatagttagcttccacttataagtgagaacatgcagtgcttgattttcagttcccgtgttaatttgcttaggattatggcctccagctgcatccatgttgttgcaaaggacataattttattctttttttttctttttttttttgagatggagtcttgctctgtcacccaggctggagagcagtggcgcaatcttggctcactgcaagctctgcttcccgggttcaggccattctcctgctgcatcctcccgagtagctgggactacaggcgcctgcaaccacgcccggctaattttttgtatttttagtagagacggggtttcaccttgttagccaggacagtctcgatctcctgacctcgtgatccgcccacctcagcctcccaaagtgctgggactacaggcatgagccaccgcgcccggaaattttattttttttatgactatgtagtattccatggtgtatatgtaccacattttgtttatccagtctactattgatggatacctgggttgattccatgtctttgctacaagcaagaaaacaaagaaccccattaaaaatgggcaaaagtcatgaacagacatttatccaaagaagacatacaggtggccaacaaacatatgaaaaaatgctcatcattgctaataacctgagaaatgcaaatcaaaaccacaacgagataccatctcacaacagtcagaatggctattattataaagtcaaaaattaacagatgctagtgaggctacagagtaatgggaacatgtactctgttggtagaaatgtaaattatttcagccattgtagaaagcagtctggaggtttctaaaagaacttaaaacagagctactgttagacccagcaatccccctgctgggtatatacccaaaggaaaataaatcattctaccaaaccaaatatagttttacttctctttcatgctagatgtcttatttctttttatttttactcttttcttctttatctttctttttttttctttattgcacttgataaaacttccaatacaatgttgaccttagtggtgaaaccacacacgctagtctttttcttgattttaggaggaagtaattcagactttcactattaattatgttattagttgtatactacttatacatgtttcttatcagtttttaggatgttctcttttattatcagtttgttgagaggttttatctgaatggatgttgattttcttgttgaattttaggagtcatttatagattctggatattaataccttatcagacatataatttgtaaatatgctttcccattctgtagattgccttttcgctctcttcatagtgttcttcataacttaaaagtgatttttttaaagtttcattttggtaaagatctgtttatttatttttttctcacattgcctttactttttgtatcatagccaacaaatcactaccaaatccaatgtcatgcaattttccccttttcttctaggagttttatatctttaggtctttgatttatttttagttatagtggttatatggtataagttatctatttttaatgttattgtagccattgtattatattgtgccctgtttcacaaacagtttggtaataagggtgaagaggtggcagagagctgaggaatgtgccattttttgcaaacagtttggtaataaggctgaagacgtggcagacagctgaggaatggaccatagaggacaatatttgtttgtctgtctaacctctattccttttgattgtttctttataataacttttgaggaaccatccctaccctgcctcattccctgcagttggttaaagtagacaaaattagtagcattaggcatgtatatgttactcagttctggcaaatcattatatccaactcttatatttttaccaactttacagtaattattttaagatatatacttgactcaattggagtcgatggtttgcatgccttagaattttactgtcatgagtaaaaagagccgttgtcttttctgatgggtatcatatcagggataataatttaaaccaggagagtcaagctgatgccataattaatctgaaaataagtcaatataataggtatgaaatataatttttagaagaaaaaccagattctgatggcaagattttagtttaaagatgtagctatgagtaaaattatacttgaccccttgaatttgttttttaaaaatttaaaccagttttagttggttttgtcagatattacaacaacaaaaaagctaatacaggcagtgaaactatttctgagggtgtgaagtcaactggaggtcaagtctttgttggtataaagggggtcagatcagacagcgggagatcaaatatattggtacatacttgttcaaaaaaataaaggaaataatggttatggtgagaaagaaaagatagctaaaaacagttaaaaatgtaaactagtctaggttaataaaatgttggaatccaggataaaattttatagtttcaaagatgatgactaagtggatattgacactattcgggacagtggggtgtaaatagttgggaaatagtaagttacatttaagacctactcagttacttggtcctgtggcttgtttcatactgaaaaatgtatgagatcacctacagtggagtttagtcagcatacacagtgagtacatggaggccagacaaacttttagttgaaatgcttgcttgcttttgctcacggcaacagtacacttcttaaggacttttattattaattttcatcattagatccctaaagcctgaaaaaatatagggcaaacgtatttcgctgttttgtgtctgttgatgtataaaataaaaacacaatgaattaatgaggttttctcattaaaaatgtataaaaatattagagctcctccctctttttaaaatatattccttcttgagatacttgaagcatcttcctaacaccctcatcttagtcctctgcagtggtcagtctgaatcttatctccacactttgtccccagtctgtgaccatctatttattcccaccatatccagggatagtaagagtgtggggaggaaggtggataaaactttgtaagataggagggcctattacttttttgagcattgctagacaaaatacaggatgctcagttaaagtttaatttcagataaaagaaatgtaatatttttagtataagaatatcttaaatattataagggtcatatatataacaaaaaatatattgtttatcccaaattctaattgaactagccacttttatgttctaaatctggcaaccctatcttgactcatgttttctatcttttccccaggatgtgattgacgtcatgaaaaggtatatgtggaagagagatgtggtcttatttgtctgaaaagagaattatagtcctgagagatatcttccttcaatcagaacaacttaaaaaatcaaaaggctgggaaatttgtgtattaaattgtcccaaattgctagtcacagattaaagttttcaattgtaagaaattttggtgttgggagatcacagagttagggtcgacggaggccttaggaataagagtttgcaatatcagaaccccatgacttcactcactttattcaaacctctgtctctgttgtttccatattgcatagatgcctgtcttattgcagtgaggctctgccctttttatatgccagactccaaatttttcagagacagcgcctttatgtttgttttcctccctgagaataaaataaacaataactttctaggtggtgctttttagatttctagaaaaatagattcaagtcttgaggaatagtggctttggtcctggtgctagcataaccttttcttgctcacatactttaccgtcttgtaggaaaaaataatattcttgtgtctaaagttgcccacctacttggcaacatcaaagtttttttaaacacatgaaaatcagaccactattaattaatttagtcatcgtaatttgtctttccccaaataacttgaaacctcagacattattctctaggtctcatattgggataacagattttggaaaccctttagctcttcaatataggatcctactttgatatctctcaacaactcaggagacagattctatggcctccttaatgaccacctgtctaggaacccacatctctggcctcttcctggtggacccactgagatggcaatgacttttctaaatattaaataagttttttagaggcactgaatatcttttaaaagcattattggctgggtgcagtgggtcacgcctacaatgctagcactttgggaagccgaggcaggcggatcacttgaggtcagaagttcaaaaccagcctggccaacatggtgaaaccctgtctctactaaaagtacaaaaaaattagctggatgtggtagcaggcacctgtaatcccagctacttgggaggctgaggcaggagaatggcttgaacctgggaggcagaggttgcagtgagccgaggtcgcgccactacactccagcctggataacagagtgagaccccatctcaaaacaaacaaacaaacaaacaaacaaaagcattattattttatctaattttatattcatttttaagaggtagaaagcatggggttaattattgcattttaaaagtaagaaagcgaacatcgttgaagtgaagaccttcccaagattacacagaggggaagaccttcccaagattacacacagacaggtagacatgagcacatttctctggactccagtgtcaggcatctcccctctactgtcctcagggaagagggtccaagtgcgtcagcaagtatggtgaaaggtgaaagagacagtgatcttggatggagagaaatagggcaaaggtgtaaaggttatcaatttttgttatcactaggagtgaaagctggacattgaagaagccaaaatctgtttccaagaaactaaagagtgtattccgagtaccagatctgagtgggatgctgcaagttcttaaaggtaaggggattcaggggaaggctgtgaatgtggatttcttagtatcagggctcaatagggaagcgggaggtttttttaggttaggatataggagaggaggtgggccagagaaggaggaaaatcctgtgctgtagatgtggtcctgtcttagggggaatgaccaggtgtctgattcatcctctcattcaccagtgcaaagaatcccagtattccccctttcctttccctactctggagaagagacaggtgtcagtacttacttatttgcttctaacaacatcactgaaacttttgtcgtttcagagctgacagatgtccagtactactggggtaagatgatatggggttttcaaatcacttcctttcagaattgtggttactattagatctcataatctgagtctcatgtgttcctccccaaacatgcttaaaccatgtagttctttttttttttttttttaagatagatttttgctattgttgcccaggctggagtgcaatggcgcggtctcggctcactgcaacctctgcctcctgggttcaagcgattctgctgcctcagcctcccaagtagctgggattacaggcgtgtgccaccacgcttggctaatttttatagtcttacaccctgtatttcttaagggtcctactaacctctgactatcaacacaagttccgtttgatatcgacacaagtttcattttcaatatgtctcttctcaatgctgtaagacacacctatcccatatccttcacttgacttggtaattttttctacagtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctct

SEQ ID NO: 37883 - DNA, 143861 bp, Homo sapiens
tgctgttaatcatttcagagaagaacactgaactttgaaaaaaatgttggaagccattggtaagacttattcttttctgcctacttttataagaattgtaactcctcccattgggatttttgacatatgttgtgtttaacatagcaggattctgtctatggtatctagatttaaaaagtttttacctactagcattgtattaaggtaatatgtttctgtatttggacaatttcatctaaagtgttgtaaaaatacgttacttataagcaaaaattaaaaacatatgagatattcttccaattatgggttttaataaagcttaatgtaagcccaattctgatttatgagcctaattctggttaatatctatttctggaaagcatctggaagtttagcagtatttttaatactgaaagaagatattacttttacttctggcaggtgaagttctactgagctcttgctattaattgataaagagaaaaatgttgcttagtcttatgctttaaggcagtttaatttctacattagataatttaggttgaaatatctagatttcccagactcatgtgttaataaactgtttttcccactgctctttagttttaaagaaactagtttgtagaaccattttacaggtagatatatcaggtatggtacaatacatgcaattatctgacattctagttccttaccctattccaggtaactctttgggtatgactaaatggaaagtgtttggatttcactctggcaccttaatcattatggcagataccttgatgtcggtgggttttgagggatagagtgacagtcagtgacagtaacgggagaaggacttgtttttgtggtcgtgggatcactatgatgacttttgttcctggtactgtgctggtaatgaaaatgtacgtatgtacatttccttcacttcccattttatactaaacccacatgctgtaaagactactagtccacataggaaagttcttaataggaaagtggaaaggaaagggcaaatatagaattatttaaactgttgttttctagtctttattctgttttgtgctgagttgcacactttctaaaaattgatgtggaaattaatattagatttgtatcctgtgataacatgggacatataacagaataagatgctcatgtgtatctttatcatttatttttaaaattctgcatatgagtaaatattgtttgtttaagtttgtgtgtgtgtgtgtgtgtgtgtgtgtgtgtgtgaacccatgatcaacatcagttcatattttaattaccctctttctgtgcaatttcagatttggtgctatagaaagtatctctggtgatgattccaatttttttttttttttttttttttttttttttttgagatggagtctcactcactctgtcgcccaggctggagtgtagtggtatgatctcggctcactgcaacttccacctcttgagttcaagggattttcttgcctcagcctcctgagtagctgagattacaggcatatgccactacacccatctgattttttttatttttttttagtagagatgaggttttaccatgttggccaggctggtctcaaactcctgagctcaagtaatccacccgcctcagcctcccaaactgcggggattacagacatgagccaccgcgccccactgattcccactttttaacattactgggatatggcaaatacgtttaaatagatatacttgttaccatcatgaatctaagtaatacatctgaacagtcttcattaaaaaaaaattttggcttcacatataagagtgtgtaagtgtatatgtttgtgtttcagggaaaggtttttaactattatttgtggtggaaactgtctggcgtaagtatgcttgtaagacactaggactagtaggacatagttactcaatatatttacttttagcaactttgtgtctgatttgtacagtgttcaataattatttgaattgatttggtttgaagcagatgtaaatatgctattttgtttgctatttaattttggagaaagatttaaaatattaaaaagtattcagttttgtatttttgtactccattaaaaaatgtgtactttctctacaggtttttttttttttttttgagatggagtctcactctgtcacccaggctggagtgcagtggcccaatctcggctcactgcaacctctgcctcctggattcaagtgattctcctgcctcagcctcctgagtagctggggttacaggagcgcaccaccatgcccggctaattttttgtatttttagtagaaacggggtttcatcattttggccaggctggtctcgaactcctgagctcaagtgatcagcccgcctcagtctcccaaagtgctgggattacaggcatgagccactgggtccggcctactgtttttttattcaatttaaaagagacaattttatgcactcaatagaaatagttttagaatttctacaagatggagtcctcttaggctggacatgtgtcctttgaatcctgttattgacaaatgctgctctttggtatagacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaggacatcattcacccaagcaggcattcacgacatggcatagatcttgtgaaaggcttgtgtttttctgaaaggctgatttttctatgtgttaatgaatagttaatgaagtcatttaaacctccaaatgagacattcagattcactgtggcttttttcctcctagttatttttgtaatggttgttgctgtatattgtagatgatatgacattgtgttgaaagctgtgtggatgctgaagaatgagtttctacaggaaaaacggatgataaaaatatgtttaggatggttggctgtagacttagtttccatcatcactgaggctcattgttcatgtgatcttgctcattcagattcggacattcagtatacttacaagatttcagataagcgtggatttgcatgtgtaatcatgtgtatgaggaagggaaatcacctctattttgacagtaaaaggaataattacattgtcatcagttagaggaattgcaattctcacttctttaaagagtgtaagtagcaattgcttccatgacagctcagatggtgataaacattagaacttctaaatgtaacacagtgcttttttgttctgtaaaaattatgagcattaaaaagtcctagcatttatattaaaattgaaacatttcacaatgacagaatgaaaactgaagtcagatgttctttgaacttacttaatttaatcaccatttctatgctttaaaaatatttaaaaaatgttatcttcaaggtttgaagtcaatctcattatgccttcaatccaagttagttttcattctaatgtctttagcattaatttaatggttatagatgacttgctagcaaatattctgccttataaggttaaaaatgaaacttgaagattagtttcataattgagtgaaagaacagctccagttaaaaaaaacccaaagtgtggctaatgcaaaagaacaaatagtaataagagagaatgaatttgtttaatgtcatataacttcttaatctaaatattttgtagcaaaaaaagttaagtcaagaagaatcttcacaaatacctttctatagtaaatgtctatttaatggttttaaaagtcgtgatcatgaatttaaggtgttgttgttatatgtagttgtgtttgtctcctttacaagttattgaaaagattgattttatttatttttatttttttgagacagagtctcattctgccactcaggttgcagtgcagtggcaccatctctgctcactgcagcctctatctcctgggttcaagagattctcctgcctcagcctcctgactagctgggattataggtgcctgccaccacgcccagctaatttttgtatttttagtagagatggggtttcaccatgttggccaggctggtctcctgacctcaaatgatctatccgccttggcctcccgaagtgctgggattacaggagtgagccatcgcgcctggcaagattgattttcagtactggttttcagaatggattggtaagcttttggagaaaccagtatcccaaataaaagcataattatgttgtggaaattatctgctttttcagagtgtaaagaagttgaacagatatcttctattcttaatatgttatgtgaaaacatgattagaatgagaagaaaagttgaaacaaaaagagtgctagcaagtctgttgggatataccactggcccagtgagataacttgaaatttccgttgtagacagtcttaatgtaaaaggaatagttatttgtgcatacagtgtctcatgaaaggaggggacaaataggccggcctattaagcttgttttaccatttccatatggaagtagaatatgggctctgagactatttgggtcccacgtgattcagatgaaacctacttggaaatttgttgagaccgagaccaactacagcattatcttattattttgttgatagacaactgatatattttaagactacataaattgtgaggtctgtgaattctatgagacatgtcttacatgtttttggactttgggctccttgatcacatgttcatatacaggggaaaactaatactgaaagggaccaaggaaaacacctagtttataccctgtagattacagtggcttagagaggttaagtgacttgattataagagtagagtagaactagaactcagttttctttggagcctgtctcacatcttcttcttctttttttttttttttcaaaggtagaaagttgaaccctagatgccaagaattttcttttgtttaaaatcattaataactttttacagtgtctgtgattcgttttttaaatctccattctttactaattcaattccatttgtttaccagattctttcttacatgactagagtaaaaatttaaaaacttatattagtttctattctaaaatttaaatataagtactctagagttttgtcatgtcagatttaaattttctatgtagtttaccaactgctgatttattaataattataatttaataattaatgaattcaggaattaaatttattcttttaaaccagtggctacacaaatctgaccaatggctagcttatatttattacctcataccttacctgttttcaaatgtataattttatatgcatgacagctgcaatttactatctccatcttttttactattattagaaaatacgaccctctgattctccctctccatcagtctcctgttttttttagaagtaaagggactgaataattgaaaagcttgaggtatatgcagcatattggagaacatgatcatattgttgtattaatgacagatgctgacataccatgttgaattaagcctacaattttttcccctcagatccttctcattacttctattcaataatgtttaattttttcaatttgcttcttcagtattaagactgcccttagaaatcaaactgtttccctttggcaaattaaacacttgacaggtgtgtaactgagagggcaaaaaagccatgccctgaagggatgtgctatttaaatattgtcaaaaatattagcaggtctgagaatataattgatgtctctgtttaactctgccacattgtgtattgttctaacgccagctaaaaggatgcatgctattaaacctgaataatctctaatagctctggttcatttcctattgcatgattcctgtttaagtgaagagaaaaaaaaagaactgtgactgtgtgtcaatgatctgtcaaatgcaaattctcaagtagtgtcctcactgtcacctagtcatcactgctaatcactacagggcttaatgcgtattcatgacaaaaatccagctattgtgggggaaataaacacgttagcagtttaataatagaaacttgtcagccttgaggatattggatttgcatatttattctatgaagtttctccagtccagtataggtggatgctactctcttgattaattaattgcgttgccttaagaattgaccagtggcactaaattaatctttttaccctgaattatctgtaggaaaactgagaattaaaatgattaatttcaatagaaatttaggaccaatacttaaaaatcgacattgctaagattatttttaaagctatggcaacagagaccaattccaagattggagaaataatgtagatgactcaggctgcaaaagctgcttagatggcaaataaacctcagcacagaatattcaggaggtctctcctcgtcagtgaccttcagactttttggagtgtggcattctattgttttgttgttggtgtttctttaatatttccaggtttttagttcatttactttcctcccaaaaagtgtaggcttacacatatatcatctagatgcgtaatgtgtatgcacacaaaattaaggcagacttttctttggaaattttatgacaactcttgaaataactgtagagatgctgtgttaacatgggatcagggttgaaaattactcttaaatgttgattagagtaattagatctttttttgaaattttttcgtgaaatgagatcttcatgatgtaaaattttggttttatatttctatgtaagtttttgttaattacatttcaaaaagaatttgaagcaacttctaatggcaagacttgttaaataatgaatgattcaaatgtaaacctaaacaaagaccaaaaaaaaagtcacataactagatataccaaggaccttgggttactaaaattgagtatgtcatttaatttgtttcctagaagcaaagcaaaaaaaaaaaaagagatagaactgaaggactatgtattgttcaatgtgggattcagtgaaccagttttcccttggcaatgggtgggttatctcatggaggctcatattcttatattcatttaataatcaagctttgttgaacatctaaaattaataaaaatacaaagaataataagatggaggttctcactatctagaggggaaaatagaacagaaagaaaacaaagaaggtgaatagtaaagaaggaatgagtaacttttactagaagaaaacctcacagtggaggcaacagcatggaaaatgggtcttgaaaaatgagttctgcagaggtgggggaaatgatttcaggtagagagagcaatgtttacagggatacagagcagttcacaacaggattattttatgctctccattcccgagggaaacttggcaatgtctggagttagttcttactgtcgtgactggaagatacgggagctgctactgacaggtaatgggtagagttcagtgatgctgttaaacatccttcaatgtacagcacagcctcctacagcaaaaaatgactgggcttataatgtctgcattgctgaggttgagaaaccctggtatggagccccatgcagacctatattatcagagcagtagattatatgaggggtattggcaggagaggaaactatggagccagactgtgaagaacctttttaagtaagatgttttatttgttggttggttaatcacctttgttcttttgcatttttttttttggatattgtattaactttgtcttctaattgttctagtatgtacattattttagcaatcattttgttttttatttcttcacattttttaacatgataaaatcatcctaacaggctggatgcagtggccaaggcaggcggatcacttgaggccaggaggtcgagaccagcatggtcaacgtggtgaaaccccatcatctctactaaaaatacaaaaattagccgagcgtgttcatgcatgcctgtaatcccagctactggggaggctgaggcacgagaattgcttgagcccaggaagtggaggttgtggtgagcccagattgcgccactgcactccagcctgggcaacagagccaggctctgtctcaaaaaaaaaaaaaaaaaaaaaaaaaaaagcatcctaacataaaattaaggtagtggttttaatgacattttgataagtaagatcttcagttataattgtgaaatatagtaattgttctttaaaataatgctgctttcatcttactaattctaagaatacagcatcacatcctaatttactaatggtttttctgcccaaggccacacaagtaatatacactctgtgtgaatttttttttctgatgctcaaaacaggagcaaattctagaaaacctagaaatgtaggtagtcaggtagtcaatgtgtacttcagaggttcagcttcaaatatctgaggtaagcagagtttgttaggtggaacacacactataccaggacatgtctgaggagtctttattctgtagatacagatttgtacgactgcgaagagttcatggccaaagtgttgaggtatgttgcttttaagtagcaacagcagcagctcaaataatttcttacatttatcattttagagtgatgggaaaatgagaaactttgtgaactgagcattttcttgctctattttaactttgacaatcagaaagatactgttttgtttgattcatatcttaaagagcagaagtgcctgtgtttccctctcttcttatataaataacaaactaaaaatgaccctttccctatagtttctaatttgagaccgaaaggaggatgattcacctatatgcttgctatcagtaaaggggagatgactactgtctttccaagaatgtctaggttaagttatgacttggtgttggtaggggaaggaggacagaacgaaagaaatatgctttgatttcattaacaagaattatttaaaaatggagtggaactcttcccagctgttgttacttgtgaaaatgaaaatgatctttcttacacctgaaatagttttacttttatgatagagctttgtagccacctgacagcaaagtatctatttctcgagactctagtgtgcattatctaggagaagttaaaagagaatgagtggttcttatgtttttacatttaccgtaaagtttatttactgtaggaatttcaaatactttatttttggtacaataacagcttttaaatgtttgttcctttagctaaaagtttgtaaatatagagccattgaagggactaaaatttttgttttaccgtgggcaagaaggcactgttcaagctttttatacagtgctggattaaaatgcaacaccatcttgctattggctatgcatgtgtgtctaaaacagcaaatggtgataattgtatggtatttttgtgacaatgttaaatggtctttggaggagaaggaaaaaaatgtgaaatttactggttataacctaaatgagttttttttaacctccaaatttaagactaataggccttatttttcacttgaagctacaacaattacctttcaagaagcccttatgtgctatagactttgcctcatttaactagtccatcagttccaggaggtaggttttgtcctcattttatccagtgaggaaattgggggttagcttgtataacataatctgacccacacaattattcattgatagacttaagagaatttgaggtctgtctaaccctgaagccagtcttttttttttttttttttttttttttttacttttattatgttacactgtttctgaatccttagttctctgtgttaatgaacaaataagatggaaaaactgttaatagcatccctgaagagaaatgcacttcagctaaacatcatctaaactcaaattcattaacttaaaatatgccatgtcctataaattcttctcccagattttaatcatagattctttttaacgtaaaccagtacttcattctggttatattaacaattttgctagattttaaagttaaagtgaatgatctggttaaagataatagtggaatggagagagaatgtggcaaaatattatcagtcttcatgtgtccattcctatataattatacttctctgtaaggctttattttatttttattttcctctaagcagattgtgaacagtgagtcagtttgtctcctagaaatgtgggactgataggaaaaacactgcaaaaattctaacatgttgtttgtttaaattttcagtttctaaattacttatttgccttccattttcaaatagattaatttacttaattttgataccttccccactatgatgtagaaaatttcagcataccttgataagaatataatttttgctcaagctacactttttaaatttttttctcttggaaatttagctaagaaaacacagaattgttgagatttaaataaagaaaagacattctgtaaatatgcataaacacacatgcctagactgtggtatatgctacattccacttgccatttgttcttaacaagcataaaaaggagccttagaattaattgtatttcaggtttgcttgacatccatttaccacttttggcataaagtccatgccatattcatctttaaatactttgtaccttatatgatacttaagctctaaaactgattgcttaataaatgaatgcatgagtattcttaaatattcaaaactgtcattcattatttatctttccttgccagacaactagtttttaacttaagtaaattaaccaaataactgaagttattttggagaccctactttttctcttagcaatgacattgaaaaggtacatcatttatcatatcatagcaattatcatagcataaagtcttactgtgtgcccagaactgttctagttctattatagttaatggtttcatcattacaacaatactataaagtcggtaatatgattttcctcattttatagatagggaaatggggttatagagaggttaagtggtagagccaggcaggctggactccagagcctagatcttaatcatagaactccatattttttgttttattttcttcttacacagcatagtgaatatagtttaaggatttctgggtgatttgagggcttcttatgattatctgatctcagattgtggcagcgtggtctaatagtagttggagacaaacctgatccagatttgtattctggtaatgatatttattagtaggtgatattaagtaagaatttattctcaagacatatatcctgtgaaacattttggtttcctgatcagtttgtagtcataaattattattaaggtctgcaaaaatcttttgttcatatggttttatctatcaatatatgccatgttagaaatcaaaattcagaagtgttttaaatatttatttatttaaaaatcacagtagtaaacccattacatgtttaaaaattgaggagagtggcactattttatatttttgcacatatatttaatgtgcagcttaatagcagaatactagattttcatcggcttctgcattcaatgtttggatttgctgttttagttgatgtttttgaagaaaatcttgcctcacacagatatgtaagctgggaaagggagggttacagcttttcagataattgtggtatccttctttgatagtgcatcaaaatttgtggagttttcttaaagtttagttgcactgttgaagtagcattgttgtctggggtaaatacacaaggttcgtcatcttgcaccaagaaaattaaggacacggacacatgtgggtgggttgaggaatgaaaagtttaataggcagaagaaaggagagaggagaacagctccttgccagagagaggcatccgaaagaaggggcaaggcagccgactgcagcatattttataggcgggcttgagaagggggtgtctgatttacgtagggctctccggttggtttgaccaggtgtgatgttgtttacacggttcgaggggaaggctggtcaccccactgtaatcttattatgtaagtggactttccacttggctcttgccatcttgtctgctccttactgtacacatggctggcaaaaagagaagatgtagccaccattttgaacatgcctagtcccaggtagtatagtccagtgggcacaactgctggcattcacctgtgcaagcttacagcttggttgtttatgtctgcagctcagtttcacaggctgctctttgttagagaagaaaatgattttggggctgcttttctggaaaaccttaccaaggactataccctcgctatctgcctaagtaatttcttcttaactcctatatcactgtgaaatctgaaaccaaatcaataagtatttcactctctactacaggaaaatctatttgtctatcttgctctttgaattttttttaactaaagcttaatttatatttcattggtcatttggaaaatttgaaaaatggaaaaatcacatttctcatttcattatataatatacaaaagttatacttgctgatatcagttgcagtcttatcaacaaattcaagttatggaaaggtgtcaagctcaaggtggcagatacagatgttctaaaattctaattttcacttgaaagctcaaattttattatgggcggcaaatactgtctgttgtcttccttgaagtgacaggcttactttgtttatttttgagaaaatgtcttttctatactcaagtctatataatcatagtttgattttcagtaatttttttttttcaaatacgatacaaaaaaagtagctaggctagttcagcttgcaactcaaattagtgttttctgtgagacaatcattgaatttattatgcagcataaacactttgtacttaccattttaccttttttttttttttttttttttgagacagtgtcttgctctgtcacgtagactgggctggagtgcagtggcatgctcatggctcactgcagcctcgacctcttgggctcccgtgaccctccaacctcagcctctgagtagctgggaccacaggtgtgtgccactagccaggcaatttttttttttgtagagacgggcttttgccatgctgctcaggcgggtctcgaactcctggactcaagcaatctgcccacctcagcctcccaaagtgctgggattacaggcgtgaaccaccgctcctggcctgcttaccattttgaagcatggaatatgaaaaacacatgttcttgagggtcaagatttaataaaattaacaagttttactgtatcaagaatttgtaatttaaaggatggagaaatagaatattgctctttatgataggcgctgaaagcaatttgtagtctttttttcagcgtatcttggacaattctatccacccagtaacaataataagaaataaagatactattaaaaaagatcaaacgtatttgaaaaaataacccattatttttgaaattaggatctcggtggaaactcaggggagaggtaaaacatcctggtacgttctacttcattgtaggagcgaagtttttaaaaaagaaggtaaacaattttttgataacaataatgaaaagactttaaaacaaaactatgttttaacttcaagttattttccaatctttattcgagtgttcataaatattttatgaaatttggggaagtgggagttttaatttttttacctaagtatattcccaaaggttttagtgtcatttaggccttcttaaagaagaagaaaacgagtttataaaatacacatggagggctgggcacagtggctcacgcctgtaatcccagcactttgggaggctgaggtgggcgggtcacctgaggtcgggagttcgagaccagcctgaccaacatggagaaacccagtctctactaaaaatacaaaattagccaggtgggtggtacatgcctgtaatcccagctcagctacttggtaggctgaggcaggagaaccgtttgaacctgggaggcagaggttgcggtgagctgagattgtgccatcgcactccagcctgggcaacaagagtgaaactctgtctcaaaaaaaaaaaaaaaaaaaaaaaaaaatatatatatatatatatacacacacacacacatatacatatacacacacacacacacacacacacacacatatatacagaaacacacacacacaaaacccagcatttagtgcagtatgccttgtggattgattttaataaaaatctcttattacgtagttttaagaatgaataagatctttgcaggtttgaataaaaactaaaatattaaaataatctgttaactcctcattcatccacttaagtcgacagcattgtataaaagctaaagtctatagctttgtatttgattttgtcatttaacaggttataacaatcagtgttacactgggtaggttattgatcatccaggtacaccttcccaaatataaaaagggaaaagtcagagtcttacatactctttatttccttgtttagtttttaagtgttctttgctttctgtctttaattttatagttcacagtttaacttttttagcacaagggaattttaagacaaatatgctttgtacctatataggggcaggtgcagaaaatttacattttgattacttaaaatgactccatcagcattcttgggttaaggacttattttctaaattgaatacccttatcttttaaatttatcagcaaatgatagtcaaaggctacttaaaaatatctgcaaagtataatgtgtgttctcaatcactatgttttggtatttgagaattcatggctgtgaacagaaaggtatcttatctcagtatctgagtgaactaagcctagtagaataattttataggatatttaacacattagtgattatggaaagcattttgtcactttaattactatccctatcacctagtgatgtttaagacattttagatgctcaataaatacttgaatgaatgaaaggaaggtctcatagaaaatgtaaaattgtgcttgttctatttgaaaatattgttttcccttcttataacttattgctccattttgtgtctcatttagttcaggagctaggagctaccttatgtccaaaatagtttcgtcacattaagctaattccctttgaacatgcagttcaatttctttaattagctttaaaaataagggtcattaaatcagagtgccaccatcaattactgtgcaagggtttgcctgttcaataatgcatcagagctgtgctttaatcagtatttcactgaaagatttatgaaaaaggaggcctctctaggttccaaacttgcaatggagtcctatcatgtataaaaaatttttcttgtgattgctatcatgtttggtgctgtatttcattgaatgctctcagcatcctatctttgcatttcatagttgggatcatttccagagagtgttttacagcatttttggtaaattcacaagaaaaaaagcacatgtttttgtcctgcaagaagaaaatacaaggtgcatgattaaaaaaaaaaattctgcatttctaagaggtgcgtctgttacagcaaattccctgaagaatggcttatttcttgtttctcattacaataaggtgtagcaaataaacaaaaaatatgggaaactgaactagcaatgtatgtcagtttaaacagtttaccaaaactagggttgcaaaagcagtagtcattttttcttactaacctaatttaagataacatatattttagcttttaaatgatataatatccatcaaacataagtattttggtcattttattcttactgctatactgtgtattgagaataagtcaaaataacagaatcataaaacagattttgataatctaccaaaaaatgctttatgaaataaagtttgatcctaagcagtcatttttgtaggtaattacagaaatacttatgcaaaaattgatggtaaccactaaaacaaagctattaatattaactttcttttcacttaacaactcagaaggaatagatgaaatataagaagtgatattttaatgctttatagcacatttagttaaatgaatatatgtatttgaaaatattctattgggttaaaattgagtgcattatcatattgttatatggtcaaaatattataaatgttattattgaaaagaagtataagtaatttataatcttgaaatctcataattacattagccttgtaccagcatatatcaaaatagtgtgaaagtatggcataattattatttccaaaaaagaatttggtatgcaataaaatgattaaaagttttaaaaatttataatatttgggaagacaaatctaaatgtattacagagattaaaatatgtttgttgaggattcatctttacctgagcacttgttaaaggactccttctgggaatgggaattagccagttgaatccacatcaaccctgtggagggccacacatcacagtggtagaccaactttgtcttcagttatttagttcctgtgctctgcattcattttaaggtgaatgtctggtgaatgaactttaaattcatagttgcggatagacaaggtgtagctttatgtatacaggctgtcgctactacttgccttctttaagaggcgtgtttttacatcattcactggaatgccccagagtttttgctttgattatatgtcttattttgcaaactttgaaaacttgagaaataacatacattaaagggaaaaagtgtgcccaaggatttttttaacaaattaaatatacatgtaaccctcaccgaaatcaagatatggaaaatgatcagcactcataatttgtttcacctttcagtcagtcctaatcctcccctttaggaatcactattttgactttatctcggagataagtattactatttgaattttatgtaaatacagtctgagcatatatgctttgtgcctgacttctttgtcttgtctttgtgtctgtgagattcatttgtattgtatgtgtagtagtagttctttttcattttctgtttgaatattctagaatatacttgtccactcttctgttgattgcagcttttggctgttataaataaatctgctgtaaacttcctactacctatgttttaatattcataagtgtgtatttctcttggatgttcacttaagagtgatatttctgggtcctaaggtatatattcagctttcgtggattctgccaaactgttttccaaagcgattataagtccaactctctcacgatatttagtgtatgaaagttcttgtggctccacatcaatgctcacacttagtactacccactttaaatttattttctccaattttaatgactctgggggatatgttatagtatcattttattgttttaatttgcattttcctgatgagtaatgatgctgagcacctttccatatgggattggtcatttggatatcttcttttgggaagttcctggtttttttttttttttttccacccatttttctattgatttttcagtctttttcttactgatttacaagagttctttatatttcctgaatacaacttctttgctggatatttgtattgtaaccattttctcctttgtgttttgcattttcactcctttaattgtatcttttaatgaccagaagttgtttttattttaaaaacaaattttaaattttaaaaataaatttttttctttgtgggtattgctttttttttcttttttgccctatataagaaacctgtggctacttctaaaatacagagattttctctcagaagctttattaaagttttaccttttaaattttgaatgtggtgtgaggtagaaataaagtatttatgtgcatgtgtatgtttataaataattttccatttgaatatccatttgacccagaaccatttattgaagagatcatcctttctcccttgcattgtcactattgttgtaaatcacggggtcatatatgtgtgggtctgtttctaaaccctatgttgtgttccaattaaacaaatttaatcatatcttgaacagatttttagaaaacattttagtttctaattgttttgctgggaaatacagtttattttttggtattgattttacatccaccaacttactaagttcacttattacagctaatggtttatttgtggattcatttggatattcagtacacacaattatgtggtctgcaaataattacagtttttgtttcttcaattctagtctttatacttttaatttattttccttgccttattgtattacctaaaaccttgggtctaatattgaatagaagtggtaatagcatggattttatccattattttttttctcccatcttttgaactgatcctgtttttctcctgtattctgttcattttgtgaattagactaaacgattttcaagtgttaattcaaccttacatttctggaatgcccaacttggtcataatcattttcctctttaagtatctttgaattgagttgttaacattctcatttagtatttttctatttatgtttatgatctatagcttttctgtctagtataatccttgttagagttggcaattgaggttatgttggcctcaaacaaaaagtagagaacaattcagcctttttttgtcacaaaaaattgatgttaattcagaaaaaaaaaatgggaagaatttaccagtgaaactctctaaacctgttcttgttttatttttgcggggaggggggatttttaatagtgcatgcaatttcattgatagatataaaattactattattattatttttttaaatagagttgctctttgtcacccaggctggagtacagtggctcactgcaacctccacctcccaggttcaagtgattctcgtgcttcaacctcccaagtagctgagattatgggtgcgtacaaccatgctcagctaattttttgtatttttattagagatgggtttttgccatgttggccaggctggtctcgaactcctggcctcaagtagtccacccacctcggcctcccaaagtgctgggattacaggtgtgagccactgcacctggccaaactattgatattttgataaatgtgttaccaaggaatttgttcatttcatgtatttttttccccatttttttgcatatggttattgcatgcctgtagagtctaattatgttccttttttttattcccaatgctggaaatttatgtttgctatattaatcagtattgttagaggtttatcagttttattactctcatctttgtctcaaagatcaactttttgacttttttgaatttctttattgtatcattttcctgttttgttgatttttgctgcaatatatgttattttcttccttttctgatttggttttctgttttattttagctttttgattcggatgcttagctcattgacattttgtctttcctttttttccctcttacatctaagtctaagtttctaagcatttatttagctgcatatccaacatttctggatgtagtttgcagtatatgcagtatgtcgtatcttcattatcattcagttaaaaatttgttttaaattcctccctcccgtttccctcctctccctctgttttgtttgtttgtttttacttatatagattaacctagctatccccacaatcaagatcagatctattttatcaccacaaatatctcccttattctattcttttatagtcatatttaaccactttcttacatttgtaacccctggcaacctttaattcattttccatctctataattttgtcgtttcaagaatgttataaaaataaaatcataatgtatgtgacctttagaaattggcttgtcttcatgcagcataatgcccttgatatcttgaagttgcatatattaatatttttcttcttttatttttcagtagtatttcttattggatttacctactgaggggtattttgtttccaatttttcactattatatataagctgctgtgagcgattgtgtatggattttgtgtggacctaggtttttatttctgtacaataaatatccaggagtgcaattgctagattgtatggtaaatgcatatctagttgtttttagaaactgcgaaactatttttcagtggggtgtaccattttacatttccaccagcaatgtctgagcaatccagcttctctacatcctcaccattctgataggtacgcagtgatatttctttttgattttagtttgcatttctttaatggctaatgatgctaaatttcttttatgtacttatttgccagccatatatcctctttcatgaaatgtctgtctgtttttttctgcccattttctagttggattttttttactattgaattttgagttttctttatatattctagatatgagtcatatgtcagatatatgtatccttgacttatttgattctactttaattagtacttttaccactttccaaaaaatgcaaggaacttaaaacacttcaactttatttaccctactcctaccttttgtgcaactgtatgtactttaattacatatatatttaaagctctacaaatttaaattatttactggtttaaggaattcctactgatttacatttttaaactcctttttgtactataatactttctgcatagggatcttctgagatttaattttttttctgcccaagattttactctggtatttcttttatacaaatctaaggtaattgtgtgtggggtggatgggggtgtgtgtgtgtgtgtgtgtgtgtgtgtaagtgtggtgtgtggcatgaaaaatctaggttgtcaggtatttttatctttttttttttttaaatcatcttgttaacatctgacctttattgtttttcttgagaagtcagctgttggtcttattgtgctttgaagattagatacctttttgctctagtggtttttaagattttctttctgtcttggcttttagctgttttgctatgatatgccattctagtcagcctctaagatggccagtatttcttgccttctgatattcatgcttctgtatattcccctgtttaatgtgggctggatactgccttctttgcatcaacagagtatggcagaagagttggtttctttttgatacctttaaagtggtttatttatttgtttttaacagcttttatacacatttttaattgttctcagtggaaaggttactctgatacagttattcacacagagtgaccttcattgtatatagaactaaagataaattatgttttcttggatgctactctagaaacagctctcctagcacacctgcaaatgaggaacttcctaagaagatactgtccatttcttctggaaggcatattgaatgatacccagggcactaaacagttgtctattcagagatgctctagtttgtgtccttcgctagcttgtaccagctaaatgtgcatttctcaaaaagtcatttttaaagctatttgtaccagttgtatttattttataattgcacaactttattatataatatacaaatttatgacaagtttttctatgaaaatattttgataaactatataggtgaattgataaaacaattattggtgaaattgttagttatgttaggtcaaactgtaaaatatatttatgataaaagatgtttatgattatgaaatttgttacaggctgaggatcccgcacaccaatggctaatggctatggtatgttggcatagtaaaaagtatttgggcttatgctatggtaagcaagattgaacaaattgcatgtatgaagaaatcctatatacaaatgaatatacatgtgttttaagttaaaataaggtacatattttttctttgttattttttctgctttacttgaccttttgtagtatgtgaatcaatactggttctgactgcatcttataagaggacttttcctgtacttttaaatacttagaaggtgttttagtttgccctttcacatagaatttgcaaacttttaaattgaataagttgtataatatttaggttatgttttaggtaatagcactaattaaaatccataaattaatatatgtttatttgctaaatacataaaagccccctttagactgaaatgttcagccagaacttaaacagaaaacagataattatttggtgactcttgctcatttactaacaacttccataaattatacagaatgtttatctgtatataaaaattgccagatatttatgttttcttttgtttattttatattctataaaccaaggatgagaatcaagatcttttcattaaacatttgtggcatgactgctatgaacagacctatcaaggcaaataagatacactcgtattcctcaaagagattatagttcagaaagccattttaataaacaattacagcataatcaaaggtgcctttctgctttttcttatgagtataaatttgccaatttataaataagacttttgtatggtggtataattaaataatagtttttaaatatgtgatctctataacctctgcttttacatttatgtagacctcaaggtcagggatgaagcaggaggagtcattgaccttcctcaaacctttaacaaattaggaaatgacaattgatattaaatacttttatacagttctcattttgtaatattttacttgttctgctctcactcactttactcttagaatgcctgtatacctactctttcataatatcagagcttctcttttaccatgaatctcttacagacagactctctattctcgggatgcgatttgttcattctggcttaccatagcataagtccaaatattttttcctatgcaaacataccatagccattaggtcttggtgtgtgggatcctcaggctgtcacaaatttcattatgccatctgcttcaacctgagctgcgtgtcttctgctggcaaactttattgaagttgccatggctcaggataaaaaaaaaatcaatcttggcataagaagcttacttttgaaaaaataataattgatcatgcctgctatagattttaaaataaacatttaaaaggattcccaaaagtctcttctcaacacattgatctctttttcatctgtgattgtagaaagctaatataatggttaagttattggtaactttggtaacttaatgagttttctgttttatttttaaggataggtaacaaactcttatgtatagattttggtgacatattgtgaaatattttgatagcttctgtcagtggatgttctttacctaatgttttattttaaatgatatctcaaatgttttgtggataatacaaggactgtatgttttctgtataatacaaggatgataggaacaccgtgatgaaaaaaaatctaggtcacaaacaacttagctgtgtgactttacgtaatttcatcatccttagcattgagatgatacttgaaaggttgttcaggagattggatcagagttagatccttaaaaaatagataaacattttttttctgccaatgtatgttgaacaactctgtataaggcattcttctagagaacgagggcatagtaaaaataaaatagtcaaaaatttccactggagagtttttgcattctagtcggtctccactgactgggatgaaagcttcatgacagcagggtgtggatcaggtggtaatgagtgccatgaattaaaacagggcacagtaagttcgtggagtataatggtgctgtcttagataggaatgcgaaggaggacttttctgtggtgagattaggcacacctgaatgaaataaggaagcatgtggatatttggggaagaatatacctgtttggtagagtgaacagcttggcactttgaggcacagtgaggaggggagcacagctagggctaagtgggtgagggacagactgctaggagatgaggtcagagagtgactcaaaaacatcaatgaagtaagctttctgataagtagttacagataaaaagtcacaatccaggcacccaacataaatatgaaattaggattgactgcattgctttattattatttagatttaacttcaaactcttttaaaaggcacacacaaataattatagaatcatttcccaaagtgggatgatcttttccgttgttgttacgtgtgtcattgtacttggagttagccagacagcacgatttgagggcacagtcctccagactgccagtgctgccccacacttctgataccaactgtggcgagttagggtccagctacaaagttaaaggtataaggatacacaaaaccaccctcacttatgatgtcagctgcaaatttgcgaggttcccctagccaccttgaggtttcataattcactagaaggtcttagagagtctctgaaatctgttaaactcatggttatgatctatggtagggaaaggatgcagtcaagagtcagccaaaggaagagatgcgtagtgcagattatgggaggattccaaactggaagcttccattttgctgggaaagtataactctcccagaatcgatgtgtgacaatatgtatagagtacagccatgtgtcattaggtgatttcatccttgtgcaaacatcgtagggtatacttacccaaaccttggtgatatagcctaccacacagctaggctatttggtattgctcctagtctaccaacctgtacagcatgttactatatggagtactgtatgcagttgtagcacaatggtaattgtctgtgtttctaaatatagaaaaggtacagtaaaaatgtggttaaaaggtaaaaaatggtacacctgtataggagacacgtaccatgaatggagcctgcaggactggaagttactataggtgaatcagtgagtgagtggtgagtgcatgtgaaggcctacgacattactgtacactactagatagtcaatatactgtatgctactagatagccaatataatggttgagttattggtaactttggtaacaatgagttttctgttttatttttaaggacaggtaaaaaactcttatgcatagagtttatacataagttataaatactgtacacctaggctatagtaaatttacaaaaacttccttcaataataaattaaccttagcttactgtaacttttttttcctttataaagtcttaatttttttttaaacttttgactctcataatagcacttagcttaaagcacaaacacatgtatagctgtgtttgactgtgttgcaaacccaggaagattacctgatcttggtgttcagcattttttattggcgtgttatttcataggtgtgattgattgccctgcctatatgattaaaattcagctccgagtttgggcttatatcatgtggccttggggcccaccatgaagaagaaagatacctcatcactcaggaaattctgagaggggaaattctgagagtttagaggttacttcataggatctggggacagaaaaatatatgtgtggatgtatatatttatgggtgtgttttaatgagtaccctgaagttgaaccctggcggtagtttttgaattttcccatctaataaatggtgctgcattgaacatttagtgatgcacacacatctttgtgtattatcctaatgttcatccttgaaataaatttcccaaaatagaattgctggattaaaggatttggacattttgaaatttcatttgtatgtccttgtacccttgggatattttctatgaaatagtttatggaatgtcaaaattcttaataatccctgcattactcttaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccaggtaagaacatttctttctgttagttattgtaatacctgtagtaatttaagaatgtgatcaagttatggataatttgaagaatatagtgacatttataacatctgaaaacattggaacaaaaagtcagttttgtgggagtttagatggttcagacgttttctattacagttttatcatcatttaaatttgagtattatatgttgtattatagaaatattcttcaggataaagtgctaacaattaccttggaaaaatgttattcaatttcttttttttttaacaaagaaatgattctgataagatgactgttactgcagtaattggcttttaagtttttttttgagacatgccttgctctgtcacccacactggagtgcagtgttgtgatcatagctcactacagtcccaaattcctgggctcaagggattctcctgcctcagtctcctgagtatctgggactatagatgtgtgccaccacacttactaagttttattttattttttatagagatggggtcacattatgtagcccagtctggtccctaactcctggcttcaagtgatcctcccaccttggcctcccaaagtgctgggattacaggcgtgaaccaccatgcatggcctggcttttagttttatttcttgctttgtttcctaaacagggtcgccatgtagaagtttttgagctcctcaaacctccatctggaggccttgggtttagtgttgtgggactaagaagtgaaaacagaggagagctgggaatatttgttcaagagatacaagagggcagtgtggcccataggtgagatggtcgcggcgtcttctttgtttttgatcccacattctgaaggttttggttactatgcaggaatttagaaaaataataatgaatggcaacaaaaaattgaacataatctgttattaaccagtttttagaagtcattaacattgttgtgataaaatagcaggttctttgaaatgagagtagcttttagatatagtcataacttaagttttggtaaggaaagaaaaatttgaggataacattattttcattgttaattaaatgggctctttttgattagatttttaaaattaccatgctagaaatgacccataataattcgagctgcattttttttatgtacccagagcaataatttaatatagttgcccctcagtatccatggggaattggttccaggactcctgcaggtactaaaatctgcaggtgctcaagtcccttatataaagtggtatagtatttgtatatagcctgtgcacattctcccatatattttaaatcatctttaacttataatgcctaacacagtgcaaatcctatgtaaacattagtagtcatattgtatttttaaaatttgtgtgatttttttattgttgtggcattattttttttgagtatatttgatccccagttggggatctaatctatggatgtgatccccagttggggatctaatctatggatgtgatccccagttggggatctaatctatggatgtgatccccagttggggatctaatctatggatgtgatccccagttggggatctaatctatggatgtggaacccatggatacacaaggccaactgtatagatatatccactttcatttttagaagatgagaatatccaagatgtaatgtaggctgagtaggtagctgaaataaagagtacttttatatgggaggggttcagtaggagtagcagtgaaataaccttacgagagttgatgacctgcagccaaggcgtgtattttttttaaagtagaactgcaggaaaaagcttagagtgtgggaattaaaaataggattaaaaatgacttgaacatacatgccaaagaagctgtcatttccttgagaactctcagattgtcttttatccccttttgcatccttgatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggtgagtacctaaaattttcaaaaggaacagaacgtatttttcaagttgtttttggttatctccaagtttctaatttgtgtagggtctttgcacttcttgagtttttgtctgactattcttttatttttccccagcctggaatatttgttctttaagcatgataaagcttctaagttctaaaacaacaattacttttctttgtgtagttttgtcctttgacagcattccttaaaaatgaaaaatgtagtcctttaacaaaattgactttatctgtagacagatacaagcttgattttgctttaaaaattatacaattatattgttagagttagctgtcagtaacttttaagaagtcatctaatttggaatcctgcctcaaggcaggattatgcagaagacattcttaacatgtgacctttttttttctttgaactttttctttttttttaaagaagttctacaaaagatcttgcaaatcaatgcctgtctttaactgttgaagtgaaatcattatgatgatatattgataatttcaagaatgattctgtcaatggcacttacattctgttgaaagggaagtataccaaatgaaagggacattgttaggactcattattatgtctgaatttaattatttaatattaacaaaataatcgcaaaaatttctactgtaatgtaaaatggtagtgctttgtaaatttctacaaattcatatatgagctttgtttgtaggttcactggcaacacatggaaacgattgaattggtgaatgatggatctggtttgggatttggcatcataggaggaaaagcaactggtgtgatagtaaaaaccattctgcctggaggagtagctgatcaggtaggctacatcaatagatcttttatgctattttatcaaataatatgggtacatcttttacatttttttgttggaaagaagaaactttggccttaaatgatgccaaagaaattgagttagaatctttcgttttattgagtgtccctaaaatgttgtcttagacctaggggaggaatacctttgaaaagggacagtaatcttaagttatagttttagacaatgagtttaacacttttgaacctcagactaaagccaaggttatggatttgataattgtggaggtagctactatttgttttatagtcataattcgtatttatatacctagtcagctgttttatagtcacagggtattgtgggaaaatatacttttgtattcaggcagaaaaacaacattcaccttgttcctttagtgatgggtcattggtatcatctttgtgtatgaaacacagcctgttttttatcacttgagtagtttattgaggcattaccatttatgatatgtgacattgttgcaatatatgtgagaaaagatttaacacatttgttatgatttatatcttaatttgataaggcttactggtttaagtaagttttgccttgattataactttttaaaaaataaagtggttgtttatacatgtgtgtttgaacttaaagtaggaagtccagctcatcaaatattccctgtattcataaatgaaattcctgtttaatggcaaccttgtcagtaggggtgttaacggtaatataatagtatgcaaatttttcttccttttaaacattagttagcatctagcagcatcaaatgaaatgtctctcgttgactagcatgtgatatttacatgctttatcttcaatgtggagctgcactcttcaatattgtagctgtctgcatatcacctttaaaattaaaatttaagttaattaaaattaaatgaaattacaagttcagcttctcagttggactagccacatttcaagatctccgtagctattgtattgagtagtgcagaagagttccatcattgcagaaagttaatggactgcatgtgtatggaggctcataagactgcttttcactcctcacatctttctgaattttcacttcacaagtatttcacctgcacatgagttcttttgggacatttataatagaaatagccaggcagaaagttgtgatattaatataatgctttcttgtggtttataccacattttaggtaatatatatttgcatggtgatttatatacaactttgcttaagggcattttcttctttccctccaaaaaattcacaaaaaggcatttaggtagaaatcaaagtgaaaagttcatatgaactcttggtaggtagaatcaaaatgaaaagttcatatggactattgatttaaagactatatgtgaatttcatttattgcatcacactgaatgatgttaggatgtttcaaaagacagttaatattatacccatgtgttttattttatgtcctgattggtaactcatattattgcttttctaaaattaatcccttctcatttaggatttatctgttgcagttaaaataataatagtctaattattcaatattgttttactcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggtaagtagttaagagtagttaatgtgaaagtcagagaaataacacttagatgacgacagtgatgtttacttagaaactagacttactaatgttcctatattagtgctaaagaatggaatgaaattcaaatgtagggatgctttagcactaatgatattttattaatcaggaataatgtgtaaaacaaatgaaaaataggttgcttaaacatgctagattattttacatttttatttaagcagcatatttatgaggataatgttttaaagtatgggtaaaagtttaaaaattatttggtactgatacctaaaatgtttaattctgtctttttctcagttagaagactctctgtaaggtgggtcatagttctaatcattctctttcatcaactttcccattagtatttttgtttttgttttgaatgtgtggaggttgaggagtgggggcaggcttggtgagtatgaataaggcttactaaaaccttttagtgttattgttttaaagtatgtcttagaactgttatcagatttgtaataagtagtcattattctgacccagttatataattttttaaacaaaagttattcttttggtgttataacaaaaactttattcatatgcatagcattccatccttgtcaacttgatatgaaaaaagctagagaatttcaaaattattggaaagtagtgggtatctcagcagatttacaggtcgcaagactacagaggataaatatcaacaaaataatttatccagaagtctcttaaatatttaagaattacacccagtttctagataagccttatagtaaatacacgtcctatattcttttcccatagatgtaaaaaatctatgttttgttctattaaagttttttctaagcagttgctacaaattcttttttaatatcctaacctcctccacaagccctttaaaactttattagaacacttgtaatttccatgattctgttgtttttaggattgaatttggttgctattttttgcaaagagaaagaagtaaagaatgcttgtttatgaaagtgtttaaatggcattcttttatggtaaacaaaacattttattcagcgatatataaatgaatgcaataccgaaaaccacttgatgtaattgaaagcttagaaaaatatctgttctgtgcatatcatcatttctgaagcttgtgccccttttaaaaccattcgatagtcaaattgccactctctaaaatagcactcgcataagtcttattaaaaatagaaaacacatttgtttcaattgaagcagatttcatcctgtcattttcttgtaattatctaaactttaaacttttgctaagtttgcacagataattatgtgcaatgaaaaaaataaatcaaactttactgtaaaattatatctcatttaagtggactgtcagagtttgtttaaagaaattagaaaacatcagctagccccaacctgactgtccattagaatctatagctttgatttctttgtgctcttcttaaggttctctgtaggatctgctgacaccatgctaatacatagtaccaatagcttattgatgatatattgtaccaatcaactaatgcttaattttagggagacttgctcttcagtccaacatagaatttgtaacaactctacacattagagaaggtggcatctgagaaacccactttcagttatcattcaggatgctgaattatgaggaattatgaggaataatgaattaagacatgtagagtcttaatcctgagttacacacaaactgctcaataaatggtagctggtctagttgttgttattcttttcctgatagttgaccaaagtgatattttctttctagatgaagtggcaaagctagatttaacttgttgatctgaattcataacattagttctttcagatgtactgcatcctgacttctccagaaattaagatgagccatctctgaaaatagaatttgctaaaaaaaacctgtttgatttaaaatttattgtacgcaaacaataatgtattctctgataagggaaggttcaaccttattcctgcctgatatccctttctgagcaaaaatatgatgatgcctatccctgttttcaggattaaaggaatcgtctctgctataattctttgctagagaattaaagtaggcctgtggctttattttatcatggtttttttgtttgtttgtttgttttttgttttttgttttttttacgtattatttcactgtatatttattgattttattttaggttgatgcttctactcagaaaggtgaagaaagtgagacatttgatgtagaactcactaaaaatgtccaaggattaggaattaccattgctggctacattggagataaaaaattgggtaattttaaacattaagtattcttttaaacttgacaattacctctgatatctatctcttataaaatattgagttgatattacatgtttcaggttgttggataaactggttgaaaacttccttaggaataatttagtgtaggtgactcttatattgtatttaagacagacaaaacaattatcttattctttagcctgtgtttctactagatgatacgtatttattctgaattagagctttatagttggagaatcgaagatggatattctttgaatgtgctttgaaaattgtgaaaaataaactatttctaatcttagaaccttcaggaatctttgtaaagagcattacaaaaagcagtgccgttgagcatgatggaagaatccaaattggagaccaaattatagcagtaagttacacatttaacaatagctttgttaattttcatggttgagaattgtattctcctagtttacttagttttgagagctagagttaactctgtactaatttaagcttttttggtgacttgaggctattattacaattaccctttctattattttgtggaagtaaaataagggtattggatataagctttactcatctcagttccaaacgggagacttccttcttgaataattcctgatatatctaatttctggttgtaatgaatttattacattaatattacacttatacgttccttgcagatactccagaggtagagaccagatgtccagtacctttagggtattggaatatgaattagggatgcctgcattgtttttttttttttaatcagcagaatgatactgttattgttggctttatggccgcggctgctttcagccctgaggatatataagaatgaaaaaaaaaaaacctagcttcttgtaattagttcaagctatcattgttatcgttgtaacatcaatgtgttttaaacatggctattcaaggcactgtacagaagagcccaactttaatttcagtgttcagttgataccggactccccagactgcagcctgaaacagaaattcaagagaccctgcaacaaaacttccttatcaaataagtttaagggaaaactgcctacaatatagtcttgtatgaattcacagtgcacatagaaaaattgaagacagctgggtgtcttcactgagctggtggctcatgcctgtaatcccaacacaggcagatcctatctctaaaaaaaaaaaaaaaaaaaaaaaacaaattgctgaattgctgggcatgatgttgtctgcctgtagtcctagctacttgggaggccaaggtgggaggattccttgagtctgggagttcaaggctatagtgagctatgattgcaccactgcactccagcctgggcagcagaatgagatcttgcctctaaaaaaagacaaaaaaaaaaaaaaaaaaaaacctgcaatagagaaacctgtttatctgttttaccttagtgtttactaaacttttgtaattgtgaggtctttatttttccaaacatatattcatattctttgaaagacatcttgagggaatgctgatttatcttattaggtatttgtttatgcttaagtttctgttgttcccttagaatcttaataatagtgagaaagtaggatattaaggtagaggagtccttattcatagcaatattattcacactcgccacgacatggaagcaacccaaatatctatgaatggataaacaaaatgtgatatatatatatatatcatatatacacacatattgatatatatgttgacatatatagatatatagacacatattgctatatatacacacatattgatatatatatatcaaaatgtgatatatatatatccaatagaatgttattcagtctttaaagagaaggaaatcttatcacatgcttcagcactgaaaaaccttgaggacattatgctaagtgaaataagtcacaaaaagacaaatactgtacgatttcactgatatgaagtatctaaaatagacttatagaaacacaaagtagattagtggctcccagggactggggagaggggaaatgaggagttgttcaatgggtatatttctgcagttctgcaagatgaaaaaattccggagacctgttgcacaatgatgtgaatatacttagcactattgaattgtactattcaaaatgggtaagatggtaaatattgtgtttttctaccacgattttaaaaaatggaggagtcctttatctctccctttaagtccacattataactccgtgagtcttcttgggttttgttctgtgaaactcctacctacacctgttcacctcttcagatctacactaaagatcaagttgtgcttgccacctcatctggctatatgcccgaagtgagctttctctgtgtatctccattttaccatacaatgtaaatgaattactgtacatgtttttgttttgagggaaagtgaaagacagaaggaatacatacggagtctaaatccatatctgatgctgaattacaaattgaaagcatagctaatttacttttttctcctaagtaatctatattaatcaattagaaaacttttaaaaaaataagcttgattgaaatgtaattcacataccatacaattcacccatttaaaatgtacagtacagtagcttttagtgtattcacagagttgtgcgttcactaccatggtgaattctagaacatttttcagaaccctaaaaacattttcagtaccccttagcagtcaccttctcccccattctcccagtcctgggcaaccaccaatctactttctgtctctatggatttgcctgttctggatatttcctgtaaatggaatcatacaagatgtggttctttgtgactgactcctttcacttagcataatgctttcaagtttcatctgtattgtagtatgtttcagtcttcatttccctttattgctgaataatattcctttatatggatataccatattttatttacccattcatcaattgatggacattcgggttgtttctactttttagctgttatgaataatgctgctgtgaacattcacgtacaagcttttatgtacatatatgttttcatttttcttgggtgtatacttaggagtggaattgctgaatcttatgataattctgtgttttaccagttaccaaatgccctgattcagtttcttcacttacaaagttgggataaggaaacttctcttgtgtgatattcaggaaaatcaaatgagtattttattgacaatatctgatagcagatatctgatagcagtttaataattaagcagatattatttattgagggctatcattgaaagagtctcatgataacttccccctaaatttgtcattatcttcattcttatataagtggaatctcaaatataattcctcttaggcaaggtcagtgatgaaggaaattgttgatgcaaaggtggaagaatcttttctctgaattgttttcttgctttcaataaaatcacttgacttcactcatcaatattctgatttttaatttttagcaaacattcttttactacaaagatataagcattttaaattcctggagaacatcatgcaatgcttttgaacatgtattaattttttactaaatatcaccatcttgtggacttttgagatatttgcagtaatgttcttcacatccagttgcattttcacaactgcagtctttgtctgttatttgttcgatttttgttttgacagcagctattaggagtataatctatttttattttgtagttgttgaagtgatgagattaagaaattatttcttactattttgaagagttattttgtaacttaaaaatattttgttataaggttcttgttttacacattgtgttctgtggacccctgggtcaacagggtttcactgtaggcattacagtgacaaggaatagactgaatgtctccatttttcccatttcatatgttggtattctttaaataatttgactatttgacaaaaggagtctgttgttttttcaaaaagttgaacaaacttgtcattagataaaaacactcattctttttagtttgatattcaatatgctaaaagcagtaggaaattatgattgataaaaattattaaataagcatataaataaggaaaagtgtcaaacgttgcctttggttttctgtgactgtgttcatagattgaagttctctctttatacgtataggatatgttggaggaggccctggcaacctaggttgagtatgctcaggggccagattttgtaagttgttccaactagtatttctcccctgtaattgttcctgttaattgcagtgtctgcagtgcacactacgaggatgttggctctcttctttttttttttttttttttttttaaaccttgaccaggtggtcttgaactcctgggcttgacagatcctctcgcctctgcctaccaaagtgctgtgattacaggtattagccaccgcacctggcctggatctcttcttttcatgagatagcacataggcaatttgctgccattatactacctagttctactgcactcttctctgtggtaccatgggttctgaactgacttcttgactctcttgtgataaaggggaaccagagctaaccaggaccccttaggcttcgtgactttggctcatatgtagcatgggtgtgattatattgaacaaaaacctctcccagaaaagccttggagatttttatgtttattactcacttctttactcttttaataaccagcttctgagtatcttcccagtacaaagtgccatgtggtataattcttggaaaatagatcttatttccataatacagatgaaggtaactaagacatttgaacagaagtctaggtttaaaagttcatgactgttccattatagcagtttcttctgtgctagtattattctctgtcatttgagtaaggaatacattttaaaatccaagtcatcaagttcagaagataaaggaaaaaaacacagtttttaaacatattttaagttgttattaaataaacaaaatcatacacattagatttttctaaataaaacttcacttttagatagaattgaacaataagaatgttttgcagataaaaaacagcctaaagttctatgcattttatgaattttcatggagccccaacatggagatttttgccatttttttcctttattactgtgagagtaaataacatgttcatttattttacattaatttttgtctttaaggtttaaagaatataaaatttgaacatggttaaaaagccttctcatagaaaccactcataatagccactaataatagtttatggtttaaaatttagaaaaattctatgtatttatacttaaatagcatcatattatatttgcctatacctttttattttacttaaaaacttacctgggaaaggtagttatgtaagcacatgtaggtctgttgtgatatattgaagcaggcttaatcatggatcgttatgttgtttacagtttgttgttacagacagattattacatactaccttatatttcttttaaggacatgaaacatttaaattctattttgttgctgtaatactattatttagatttgaattttacttattttgttgctcagcactgtatcttgtatactacagatttcttagtttgaattttaaatccaattaaactcatttggctggagtgttttgagtaaactttacagaaagagaatgttttagcggactttctaaactttttgtctctgagaacctcttgtgttgacttcttatattttgactatttagttggtgataacaaatatgttggacaaagaggatttattaggtataatcttaacttaaaaaattttgtcatcaactgccccttttaatttttaatggggaaggttcttccctttcccctagaagaactcttaggcaagtcttcatgtcttggggtattcttgtagagtaagttatcctgtggccaatcaaaataatcagacacagttgcaaattagtaataaaatttttcccatactaaataatagtctaatttcaaatgaaccccctggcatattagaagcccgctatgaactgatggcttacctagagatagagggtatatcactcagtctgtctctccccacctaatttttcttttctgcccacaccttattttggcttttatggtgtaaaagttgagagaagagaaggaagaaggaaggggcattttgtctgactgctgaaagatggctttgtgctaagtgagcctggcagatgttcagaactgactatctctgagggtttcttcttgggctcttggaagattccagtggaggtatatttggcttaattttccatgaataacagatgatggatttttaacgtagctgactcttcttcccactggcccctgatttctcagcagtctgtttcatagattgtctcttttgagtcccatcattcccttggagtcctgtagtaggtttcaaaatgacttgagcctggctcactcctgtgtggtctatgcccagacaaagtcagggaggtgagcagctcccaacataacagaagtttcctctggctccactgtcaaagcagctaaacaacctcttccttatcctcctgatggcattagacacaatctgctgcattgcctcttctgcaggtgactttggacttgaagtcaagggggaaatacctgggtgggtagggtatatagcattctttcctcttaaaaaaaaaaaaaaacttcctcttaagtttttcttaacatttaacaacacttagttcttttatgccctgaatgtgtgtgaattgtagttctttaccacctagtttaaatttccgcttggtggccctttttacaacttgctttgatataggatattaataatcatagcatctcaagcacaatttctgttttctcatacatcacactaagtataagattcttggtttgtaatttcttttccacaattgtacagataacctagtctctctctttgctgcctagaggctggtagatcttttttctttttatctttgaaatataagaattttaccaggatacattcaggtgtgaggtttttttttttttgtaatttctcatcattttctgttttttcatgtgcctttttgatttgtagagttgggtaagtttcccttctccctaatcctttctttgatttttttccccctcatttatcatcttctccttataatttcttttattagtgtgttggatttcctagctcagcctatgagtctccagccttgtttctgatcattttttatcggtttattcttttcctctgagctatgggaaaattgcatgcatgacctggactttgtttttgcagtacttaaaatcttgttgactgccttcattgtaagttttctttttcttttttttggggggtagatacttgtttcttctttgtaattcctgcttccataaatacaaggaaatgtgaactattttgatagtaagtttcaggaaatatcttttttcctgttcactgcaataacaacttcataggaagatacatgcaccgatcttcagtgtgcaacctgcttttggaccgtgatatttcacattccatgacccttggtcattctcaaaaataactgggcttatacagatagaagttgagatgggttctgctgcagattgtatggtttttttccagatgttttaagaattgacaaagtgacagggaaggggaaagtttaaatttactgtagcttcacttgattcatttgtagattaacaaaatgaagaggaaaccagtggtagaggatcacactgggggattttgcctgtttttgttttctgtgtttgctctgatagccaggagttatttggagttgtgtgtgtgcttgtatgcacacatgtgtggttaaggtaatttttattacaaataaagtaattctgtgctattacatgcaacccagcttagtatggcctttagtacttggtgtgtttcttggagttactggttaggatccacatataccatctgattgcctcacttaatgagagggtgttttttgttttttgctgaagtttcttcttacagaccagacaggctattcccacacatacagagattcagttggcctgcctttgatctggccatgcgcagaccatttctagtagaaattcctccaagttgctggtctaaggaccttggtgcttctttggtttccagttttgttgcagtgttttctctgttctattttgttagtttttctaacagggaatcagcagggtggagatagggagaaagaacagagccagatacttatgttcaagtcaccatccagctcagaagtatcatagaaggtttaaggaactgacagagtatgagattttcatctagatcagaggtttctggatttttgattgaatattccctctagtaaaaataactactcattttccctctttcttcctcactatatattcatatatattgttgttatatatattatatatatatatcctatataaacttagacattatatgctgtttacatatgtgtacatatacataattacatatatacacacctacatatacacatatttacaaagcaaatgagtttttaaaatgtttatttagaggttttattatattctttcagaaacctttgcagtaagggtactccatcttggagacaactgatctaggtctttttttttttttaatatttatttatgtaagacagggtctcactctgatgcccaggctggaatgcactggcatgatcatggctcactgcagccttttgaaccttctgggcttaagtgatcctctcaactcagcctcctgagtagatgggattacaatcatgtgccaatacgcctgggtaatttttctgttttttatagagacagggtttcagcatgttgcccaggctggcctcaaactgttgggctcaagcagtccttctgcctcagcctcccaaagtgctgggattactaggcattagccactgcgcccagccttgatctagatcttataattttcgcatatttactaagttagtaaacatctgaattacaagatttagattataaaatccagatcttttctaacttagtaaacatttgagtgcctaatatggccccactatgcttggaaaagcattacacgtacagtcattttatagtcattttgcaattctaaggaatattaatgactttgaatttcagcattaaatttattgctctgctttttcaaattgtttttactgtgattttatgaattaaacaacatgttgttaaaatttatatttatctacctcagaatataatttgctttacaaataagtttttgacctatgagccaatggctctgtattttaatatctatagtatggacagcaccatgttttgatgacactactataaggaaaaatgatacagagcctgtccttggagtatatagtcataaactgcataatagcagaaaatgtaaaattaaaattctgaaaaatgctatgaggaagaatgggtaaaagggggctttgacggcagtcaaagacatcaaggtagtttattatgaaaacaactattgaactgaaatataaagcaattatatgtattttctaagtaagctattgagaaagagcatggtctagagtgggctatccagagagtccaggctgaggtaacaggacttgcggagactccatggctgaagagagaactgcaagtcagaggaatggaagtgagccctctgtggctgaggggcagagagtaatggacagcatcatgagagatgaggttggggctggtgggaggtgggagcagttggcacaggccattctaagccacgttgagaatttggagcattgtcctaaggagttttctgtagaagagagggttggggagatatgatcatatctatattttggaaagatcaccgggacatttttgaatgttttgtcatttgtgaaaaggggaaaatcaaatgtatttttctgaaaagacaaatagacaggacactttttttctttcttttttgaaaggccatataaatatgaccttgtgatacatcagtgcactcagtgagcacatttatcactgtcttctataccttttaatcctgcatagttctggttccaaacttaactgtgcattgagatcacctgaggaatataaaagcatatttagaaaggagtagaagtagggcacagtggcctgtatctgtaaactcaccattttggaaggctgaggtgggaggatcccttgagccctggagttcaagactagccttagcaacatagggagaccccatctctacaaatttttttaaaaagtaggccgggtgcagtggctcacgcctgtaatctcagcactttgggaggccgaggcgggcagatcacgaggtcaagagatcgagaccatcctggccaacatggtcaaaccccgtctttactaaaaatacaaaaattagctgggcatggtggcacgcacctgtagtcccagctattcgggaggctgaggcagaagaatcacttgcacctgggaggtggaggttgcaatgagccgagatcgcaccactgcattccagcctggtgacagagtgagaaagaaaaaaaaaaaaaatagccacgtgtggtggtgtgtgcatgtggtcccagctacttgggaagatacgatgagaggatcgcttgagcctaggaggttaagattgaaggaagccatgattgcaccactgcactccaggctgggcaatagagtgagaccctgtctcaacaaaaagggaaaaaaaaggcatagaagcctgtgtcctaccctagaactagtgactcattttctggatatggtaccccagaatctatattaaaataaacagaagcctctcaaatgattctagtgcatccctgttaatactggtttccaaagagatattagggtcttactgtcaattccctgataaggtgaatacttattctccattcttttcacactaacaactatacatacacattttgtgaattggtaatacaaatatccatttatttaacatgtaacatgcttttttttttttttaatcacaggtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaaggtaatcctatgttaatctggtttttagttagacctttatattgtctccaattttttttaaattccaaagtaacttactatttcagaatggttcttaattattcagaatgctttttaccctcaactattcattataaaccaaggcgagtaaagaagtgtaataaagtcaggattgactggaaccagcaatgtgtttataaactatggagtaggcttctgaatagagcagatttctttctatcctattcattgtcaccatttctcagttggaaacaggcagtcatttacctttctgtttctgccttacttctggatgtcattgcaatgttctcactttagggggatgctcttctgcctggattatttatgtgaccttcataaaaattctaaatgcccagcctttccttgaaggaatcgactttaattccacatttagaaatgtcattcataagctgtttgtacatgaatatgtctgcaaattactgaaacccctgtgtagctcaggggtttattggtagaaatcaggcttttcgctgaaaagtgctgtttcatttctaaaattgttgaccattctgatatttatgccatttatacatattgcactattaagagacagaggggcaaatcacaggagaaatgtattcttttccactaacagaacttgcctttaagtacatatagttattgagaagtttatctctgaaaaacagattctcatgtaggagttcaaataaatatactgggtttagaaaaattcaagtacttgattatactaaagataaaattactaaaatatttttatctttaagaaaattatgaaaaagatgaagattttttatcttcgacgagaaacaccaacatattaccaactgaagaagaaggtaaacacctagcgccagcttattgtgtacttcattatttttcttttttagaaatgatttttacaaatgtgattaagcctctatggatatattgtaagttactaaaaaaaatttcaaaaagtgaagtttgtaaatccctgtttataaatgtgactaagtggtcttatggattaaaacattccatttatagctaaattatacttttgtttatcgttcacttacactttcttgctgagtcaatctattcttacttccatatttttatttgaccagaactccttaggaattaactgtttgtatgtgtggttctaatttaatctctttgtttctatacagccaacataaactaacagtaataaaattataaagtatttaaaaataaacacaggagaatcattaacacataagctcttgggaatgagactattcaattttgggaggctttttatcacttcttaatttttcaggggttccaagatttaatattgggaagtggtttggaaggtaattgcagataaattatcataccttctgggaattctctcactataaacttaggacccattaagctatttttaaaaatttagagtagcattattattattattcgtattagagacagatttcgccatgttggccaggctgatctcaaactcctgacctcaaatgatctgcccaccttggccttccaaagtgctgggattacagatgcgagccaccacacctggccagtagcattattttaatacatagttttgccagaatgttgctgccctctttttattctgttgtgctgtgtgcttcctttacctttcagattgctttaggtacttggtaacttaaactcactgaacagaatacaagactgatctccctcccttcatgtgaatatacttataccgaagctttgttgttttttaacatatctgttccttcattattggattttctgctgaaaattttgaatgagctttacaattttaaagggatatttatgtttgcagagatattccagaagttagatctatagagttcacttgtactaataacattctgccatttttacactaataagtaaagaaattatttaggctaaagtgaatatcaggaattgtaggaaagggtaaaattgtttagagcatgatacttgtgatattaagtgggcatgggtgtgggagtcgtctccaaggcgcagaaccatctattttgctttggtgaaggtagctaatgagaaatccctctctctctctctttctctctctgtgtgtgtgtgtgtgtgtgtgtgtgtgtgtgtgtgtgtgtgtgtggcaggatacatgggggtgactatagacctagaatcaggagtcccagaatcttttttaaacaaaataaagcacaaacttctaagtgactttaatgcatctgccctagtactagtcctcagacaaggggtaagatattattgcctcttccacagatattttacacatcgtgcaagcctggacaagtcatttgactttccagcaagatcagaggtttagactttatgatttttaaatatatgcctgaaatccagtcttggggcagttgtgagaaggtgagaatggagagttgttctgctaaaggttggttgaatatgaattgcagactgtttttatcagcagcacgattccccactttctccattcataatctcacccgcttaaatcactgtctagctgtgtaaacacagcagacttagaaaaaggaagtgtggaaagagataggactctgaactgaccctcctgtttctcttgcagaatcagttcaaagcttccctgtagtctgtgttcatccttgcatacttatttctctctgtactgaatttgtttatttgcttttattatttttaattgacctataataattgtacatatgtttggggtacagtctgatatttccatacatgtatacaatgtataatgatcagatcagagtaattagcatatccatcacctcatagatttattttttctttgtgttgggaacattcagcacaacatcttgctcctctggctatttgaaaatatgcagtaaattgaagagtgacatcaacaagatggcagattagaagtgcctcccacatccttcttcctatatacatacaactggaaactatcaaagacaaaaataccaccctgagttcaccagaactagagagagaagcagagaaacttcctgggcctacagaattgagaggagccatgactgataagataaatggtaattttaggctgagctgcacccttcctcaaactggcataatgccattcaaagagaatttctttagacccacagctcccaagatgagaggaggaaattggaggtagacattcattctctccactggtctggtaatctttcactggaaatccacctaggtcccattcctatgaaccactgggagttccaggagggctaaagcacttggggtgaattgggagcaaagacagaggcactgatcacagtgactggcatgtatcttggcaggtattctgcactctgataagtgggtacgccatgttgaagatactggctggttccatggtgcttctggggtacaatctgtggaaagatcctgtccttagttggattttctacaaaatcctggtgctctcatggagccatctcctggcctagaaacaactgaaaggttgggattaagttttggtgccagcttaaatcttccccaggctggagacccatagcaggacaacaataaaattctagggcagtgtttaattttcagtgctcactgtaagcctaccctagaggaaataatagcaagtcaaggagttagttccagggaagtgttttagttccagtactcatgtaaatcctccccagaatgggaaaaaaacaacagcccagcatttaagttctgatactaagtagtaaatctctaacaccaccaaagagcacttgcaaaaactggaagaggtagccaactcctcaaatgaaccatcatcaatgtaaaaatacaaggattgtgaaaacatggagaaataggatactaccaaaagaaaccaacaaacctccagcaatggacgcagaagaattgaagatctatgaaatgttgtacagaaaattcagaataatcctgttaaagaggttcagggaatcacaggaaaatatggatagaaaacaaaatgaaatttaaaaaataatccaggatcacaatgagaaatttgtttcactgtatcttttatttttatctttgtatcttttatttttatcttttataaataaaagatacaaaccttagaaataaataatacagtaagccaaaatctcattagaaagttttgattgaagcaaatttgatcaaacagagaaacttagtgagcttggagatagaccatatgaaataaccctatcagaggagcagaaagaaaaaagaatttaaaagagtgaaggagacctatgagaattatgggataccatcaagtgaactaacctctgtgtaatagggactcctgaaggagaccagagagaaaaaggcctagaaagcacatttaaggaaatagtagctgaaaatttctcaaatctggagaaagacaacaccatccagctacaggcttagaggtaaccaactatattcaatacaaagaggaaatccccaaggcacatcataatcagactagcaaaataaaaaaaaaaatactgaaagcatcaagagaaaagaaacaccacattcaaagaagccccaatattgctatattgctttctagcgaagtaatggagaaatttcatgcaaatgggaacaaaaatgaagagcaggagtggctatacttatgtcagataaaataggctaagtgaagaacagtaaaaaaataaaaagacaaggtcattatttaatgagaaaagcatcagtaggtcaatacagcaagcagttataacaattgtaaatatatatacacccaacatcagagcacccaaatatattaaaaaaaataaacctgaagggagagatttactataatatgataattgcaggggacttctgcaccctactttcagcagtagacagattgtccagacagaaaatcaacagtaaaacatcagtgagacttcattgtagaccaaattgacccaatagacatttacagaacgttccgtccaacagctgcagaatacacatttttttcaacaacatatggaacatactccaggctagaccatatattaggtcacaaaacaagtctttataaatcttaaaatatcaaaatcatatcaagtatcttttctgaccataatggaataaaactagatatcaataacagaggaaacattgaaaactctacaaattcattgaaatttaatactatgcttctgaacagtgaatgagtcaataaattaaaaaggaaatttaaaaatttcttgaaacaaatgaaaatgggaacacagcataccaaacctatggcctacagcaaaagcagttctgagagggaagtttataacaacaaatacctacatcaaaaaagaagacagacttcaaataaacaaactaattatgaaccttagaagagcaagaacaaaccaaacccgaaggagcagaaagaaagaataattgtagcagaaataaatgaaattgagacgaaaatacaaaagagtaagaaaacagaaagttggttttgtaaaggtaaatgaaatcctcaagtctttcgccatagtaagccaaaaagacctaaaatagataaaatcagagacaaataggagacactataattgatactattgaaatacataggattgttagagactattatgaacaactgcccactagtaaattagaaaacccagaagaaatgggtaaattcctggacacttacagtctaccgagattataagattaaaccatgaagaaatagaaaacttgaacggaccagtaacaagattgagttggtaataaaaagtctctaattaaagaaaatcccaggacttaaacttcactgcagaattctaccaaacatttaaataactaatccagttctactaaactattccaaaaaattgaagaggagggaatactcacaaacccattatttggggccagccttgccctgattctaaaaccagagaaggacacacaacaaaaagaaaactacaaatccttcatgaacgtagttgcaaaaatcctcaacaaaatactagcaaaccagattcaacaacacattaataagatcattaatcataatcaagtttgattcatcccaaggatgcgaggatgtttcaacatatgccaatcagtaaatgggatacatcaaatagatgctgaagaagcattcaataaaattcaacatcctttcatgataaaatctttcaacaagctagcaatagaaagaacatgcctcagaataatcaaggccatatatgaaaaatccacagctaatataccgaacagagaaaagtccaaagacttttctctaagatctggaacaagacaacgatgcttacttttaccacctttttttcaacataagtactgcaagtccttgccagagcggttaagcaagagaaggaaataacgggcatccagattggaaagagataagtcaaattgtccttatttgcagataaaatgatcctatatttagaaacctaaggagttcaccaaaaatggttagaactgatacatgaatttagtaaagttgcaggatacatactcaacataaaaaataagtagcatacaccacagcaaataatccaaaaaagaaatcaagaaagtgatcccatttacaacagctacaagaaaaataaaatacctaggaataaatgtaaacaaagaagtaaaagatttctgcagtgaaacctacagaacactgatgagagaaattgaaaaggacacaaaaatatggagagatattctatgatcatggactagaagaattaatattgttaaaatatcaatactaccaaaagatatctatatattcattgccatacctatgaatataccaatggcattcttcacagaagtagagaatgatcatggactagaagaattaatattgttacaatatccgtactaccaaaagatatctatatattcaatgccatacctatgaatataccaatgacattcttcacacaaatagagaaaacaaccctaaaattcacatgtacccacaaatgactccaaatagccaaagcagtctagagcaaaaagaacaaagctagaggcatcacaccaacagacttcaaaatatgttacaaaggcctgtcctaaaacacacacacacacacacacacacacacacacacacacacacacacagagagagagattaaagacctaaatataagaactgaaggaaacgttaggaaaatgcttcaggacattggatttgtctgggcaaagattttttatgtaatttcacaaaagcacgggcaaccaaagccaaaatggacaaatgggatcacatcaagctaaaaagctttcctgcacagcaaaggtaacaacaatataaatagacaacccaaagaatgagagaaaatatgttcaagctacccatctgattaataaccagaatatataaagagctcaaaaaactcaatagaaaaaaaatcaaataatctgattaaaaatgcagaaaagatctgaatagacattcctcaaaggaagacatacaaatggccaataggtatatgaaaaaatgttcgtcactgatcatcagagaaatgcaagtcaaaactacaatgagatatcatctcacccttattaaaatggcttttatccaaaagacaagcaataatgaatgctgacaaggatgtggagaaaggggaaccctcataatgctgttgatggtaatgtaaattagtacagccactagggagagcattatggaggttcctcaaaaaacgaacagttaaactaccatatgatccagcagtcctactcttgggtatatatccaaaagaaaggaaatcagtatagcaaagagatatccgtacccctatgttcattgctgttctgttcactatggctaagatatggaagcaacctaagtgccgatcaacaggagaatggatgaagaaagtgtggtgtatatacacaatggaatatcattcagccacaaaaagaatgaagttttgtcttttgtaacaacatggatgaaactggaggacattgtgttaagtgaaataaaccaagcacagaaagacacataccgcatgatctcacttataagtgggcgcttaaaaagttgatttctggaaatagagagtagaatgaccagaggcttggaagagtttgaggaggggtgggatgaagaggtattggttactgggtacaaaaatacaattaactagaaggaataagttctagtgttcaacagcacagtagggtgacaataataacttattgtgtatgtcaaaataggaagaagatttggaatgttcccaacacacacaaaaaatataataaatgtttaagggaatggatatcctaattatctgtatttgatcattacacattatatacatgtatcaaaatatcacatataccctataaatatgtacaattatgtatcaataaaatattttaaaaagagaatatagttaatcatagtcacccgatagtgttagaattgctcagcatggtggcttattggtgtaatcccagctactcgggagtgttactgagaccagaagtttgagaccagcctgagcaacagagcaagaccccccatctaatttaaaaacaaacaaataaacaaacaaaaacactggaacatatttcttctatctagctgtgcttttatatctgttaacctctggactgaatttaattttgaggaagtaacacttatttggggaggctagtcttcaaactaaaaatatatatatatatatagtttattgtttacagtcttttaaggagaaaacagaatcatcttattagcttaaagcataacagacctacaaaatatgcctggaatgaaagctcctggatattcccactaaaagaggaggcaactaataagaaatctgaattttttaacattttttaaatttgaaatttgaatgctaaaaaggatattgaaatttaatttagagaatagtgcctaatagagattttaaaaagacaaatcttacgagtaagaactgttatgaaatatggaaatctttgactatgacttcaaatttctcaaccagtttcttgttttaggtaagcattttaaattcagtattgtttacaaaatttgtttagtgtttttctgtccttttaaaaatttctctttttgtaaattattgagataccaattaataggcttttattttaatgtgtagccttagtttattattatttctttatattttctcatatatggagttacatatattatttgttgatttcatttgtttgattttgtgaaataatagcatagtccttttttcccctgatgaactaaatgaaaataaaacagagaacattgaagacgacatccctttttactgtagcattaccagaggactatgaagtgaattctggaactgctcagagtccttactcgtttaaataaaaattagataatacatgggcactttaatggaggtaaagatttaaaatacatctgttaaaagtgagtagtgtcaaacatacaaattatagggttcttaattgaagtatttaaataattatggagatgagaatagcccatatattgggcgaagagtctgacgtgatacagcgggttctgatcagagaatccttggtacaggatgttaagatgtggagatttctgtagtttgctgctaacttaattgccttgactgtttcagggtatccattactgtcagctgagatagaagaaatagaagatgcacaaaaacaagaagctgctctgctgacaaaatggcaaaggattatgggaattaactatgaaatagtggtaggttagctgaccttctgtaattttctaacttgtaactgtatttgagcaggcagttcgagggaataatagaggcaatcattagagttccagagaagaatcaaatgtacaggccttttttagacaacctaaatatggtgatccaggtaataaaaaaaatttaggttggagaaaggtatatagtaacgaactgaaataaatgggatggaagttttgaaacttgcattttatcagtattttaatatttccagtaatagtatgaataatatagacacaaggaaggatttttctgatttttaaacctatgatttatagaaagaatcaaaatagaatgagtttatttaaaaataaaacaaaatttatcatgacttatgaacagaattgtaaaaggactcttttctactctttcttttccactcctatgtatttaccttcctgaagaggttaattctgcatactttttttcataccacttatgctgtggtgaatgttttatgtttattagtagcctgtatatctagcatagccattgtgatctaccatcccaaaagggggtctaataaaattgttataaattatcaatcttaaggtacataccataccagcaaatttcacggatttcaaaagaaaaaataaaatagtatgttaggtagaatttttcatatttcttgtaatatttatatacctctggactagaagggagaagatacaacagatgacatatattaataactagcgtttatagcatactttgtgccaagcagtagtgttcttagtatttcatttagtcctcatgaccataatcatctttttgtttgtttgtttgtttttttgagacaaggtctcgctctgtcacccaggctggagtgcagtggtgcagtcatggctcactgcagccttgaccaccagggctcaaacttttctcctgcctcagccttccgagtagcttggactacaggcatgcagcaccacgcccaactgatttttgtattttttgtagagactgggttttgccatgttgcccaggctggtcttggacttctggactccagcagtctgcctgcctcagcctcccaaattgctgggattacaggcatgcaccactgcaccttgctataatctttttttttttaaacattcaaaatgattaacagtcaaatatgaattgagtaagtatagctgttactaccattttaaattgacctaaggaaaaatagattaaggtccatcttaacagtggttaacatgaaacttcagaaattattttcatggagggatagggttaatgtggcaggtgtgcataactgagactgcagtccttcgggtggtaattgaataatgaaggagaccctttgactagccattttgttgtaggcatcagagctcagactgaacttttttttttaaattttacttttaagttctaggatacatgtgcagaatgtgcaggtttgttacataggtatacatgtgccatggtggtttgctgcacctgtcaacccatcatctaggttttaaggcctgcatgcattaggtatttatcctaatgctctccctccccttgcccccaccaccctacaggccctagtgtgtgatgtttccctccctgtgtccttgtattctcattgttcaactcccacttatgagtgagaacatatggtgtttggttttctgttcctgtgttagtttgctgagagtgatggcttctagcttcatccatgtccctgcaaaggacatgaactaattcttttttatggctgtgtagtattccatggtgtatatacattttctttatccaaagactgaacttttaactgccctttgtgctcatgctttcttggtggcattcctagtaatctgtcaagtgcggaagtatacaataaatgaaaaaggactaagatatttatgggccttggcaagataaaggtaataagacatagatctgacttcaaattgtttgctatgtagcgatacagcataaatgaaatcataagggaagtagtgtaacaggactgactaatggacattattggatgggacattctcaggggaagtgatgcctaaattgggttttcaggggtgagaaggatttcatccagtattagatttcaaagtcaggtgatatcgcttctgaaactgacttctgcacgttatcattaaaatttgaaagagctctttttaatcaaacttttttttagtccttttatccctcagttgccttaactataaaataaaagggataaagtagatcgtctttggcatacattctgattttaatattttatttattggattctgtgtgaaaatgaacagctttctaatattcttcattatttaatgtaacagtagaaaattggaagttcattctttggttttaaggtttgatcatttttaaagaccgttgtctctggttacagcataaacccaggaatgtggttctgcgttctttgtttagcttcaaacccttttctagctgtgcagctctggtcatggtaccttttctgaacctcgtttttctacttgggaaacaagagagaaattgtacctatttatgagaaacagatgagacctatgtaatgggagcttgcggctcactgcttcctttcagtttgtaagttcatgaaatcaaaagacaccagtactctttcaaaggaaaagccccaaagctttgcagttttacaatatggtttttgaagctttgtgagaaagatgaccacttttgggtaaacataaaacataaaatgtgtgcatgagtaaaaataaaaagaatataaaaattgtggtgatctttttttttttcttttcaggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaggagctatgctgttccttctcctccttaaataagacatggaaaagcttgcaggaggcttaatgtggtgaataaattctcattttaaatttcccctccaaaggggacttgagagaaatctacagataaaaacaacccaaagcagaaattttgtatctgtgtatctgtgtgtacatttagctttagaactaattccatgccattttttatttaggttcagaaaactataaaaacagtctttgaaattttttttaacatttatttaatttttagaataagtaacgcattcagatgtttaaaatcacagagaatacaaagataaagaatggaaaagggtctccttcctgtcccaattcatccagttctcatcacccttcattaggtaactactaatatatttgcttctttgtaatctgccagtatttttaatgcataaacaagaaagtttgaatatattattttccctcactttttaaagtacactagcatacaatatatgtcattgtccaattttttttttactttataattatacaaaatgtcaaagttttatactattcttctccttgtccttttcattctttggaaatatttttattgtctcttttttccagaccactacactggcagatcaaacatagatgaaagctagtggtttttctttgagtgctttagaagctccaattccaacaatactctaaacttgcacataaatttagatagtatttccacaggtctcactatagttctgagcacagtaaactgtggtaatgactatagtaaaatttatatttaataaaaaaattgtgttcaaaagaatgttcatattatgaagtgttgtttgttggacaatgtatcttttttcacaggtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaaggtatcagatttgcatacatgaggctaacctacatatataatggaaaggctaaatggcttaaaattttttaagcatttttcaatttggtatttgatttactcacatcgcccatggcttggaggatagaatttaaagtcagacaaatctgggtttgaatcagacttgacactagctgtgggaaattgggcaaatcacttcatctttctgaacctcagttttctccttggtaaaatgtaagtcatgatgcttgtctcaaaaagttgccctgaaggttaaataaggttatgtaatcatgttagatgttaatgcatactatatacttgtttaatttacttgcagcatttctatgaagtagatgctcatattcgtctccatttgcagaagagaaaactgaagtatatagtgtgtacatagtacatatgtggtaaaaaatatttttaaataacctacccaactctgcctggcacacagttaccacttagtgaatggctaaaatatggatggacacagcatttctgtgtggataggtcttacttgtttacatactatccttttaaaatacaataaatttggcccataatgatacatgtcagataattctctgtgacattcaggaactcacattttcctgtttgtttattgtttttcattcattcgtatcatgatgtcaagaaatggagctaatcagcttttctgaggatacacaatacatagctaaagttaggattaggactttgcataatatgtggtccagtcaaatctcatttaaggtatattgagagatgatgttaggatttgatttatagtatattgaatgaatcagtacaatggaataatttggaaaattttgaagaataaaatgcatagtttagtattcatatgggtgattagaatagggtagaacaagaaacataattccaaattttatagcactcaaagtctagtaccctatatgtatccatacatgtttttatgtgtataatgggattattacaataaagcaaatgggtgtcatttgtatctgtggtcctaggctgtgcaataattgattagaagcaaagatattctacaaactagaatttcatcctcataaacacatctttctttaagttatgttcatacagatgaacaaagttgaattaacctatattaacctagtattttgaatccctatttctgtctgatgctttatatatgttacttcatttagtcctcagaaaattctatgagatgggtaactctgggacccagttgatgaatattgctcaatgtaattcaaattttaaatattcaagctgcttcaagctgggggcaaatctgatttcaaatcttatgttttgccactgtgtatgttaatttgttaatgaaataaccatatgcacaagtcacagcattttagaactcttatttgtatagagtatagaacttttgcatatatccattttctcttgtttttatttatcataagaattccttttatttaatatcaaaatagctttacatttttttctgactagagatgattgaaacactgatgaaaaaagtgacagtcacgcacaatcctgctgtcgagatataaccattgcatattttcatagacctttgaatcatatatttttaatgtttgttaaaacttaggtatttcttccttcttaacaactttcagtaattactaccttaattcctaaaggtttcatgaaaagctgttgctactcttgtttgaggatgttttgtttggacagatgctgggaatatcccttttcttgtagtgttggtatgtgtgtcagctaatgcaatgcctctgaaataagagctgtctgatattatccagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggtaagtatatactacttttaacaatttttaaaggcctattgttgctatcaaagaaaaagcagatgatgatagtttataaccatcaaagatgttttcttttttctagtcagtctttcaaaatagtgatttataggattcactgattatcataaaggatttcttttaacattgagttcattgagctatttttatttcatctcttggaattggaagatacattttaggaatatcatagtgggtgttttttcgttatttgggaagtgcttatgctatttgtatttccatgggcttatttgatgactcatattttagtggtaagtcataaagaagtaggtatttcttttgtctataacatgaatgctaatttataatctgatattccaattaatatttctgctgttccaatcatttgactaaatttatgaatatacttaaattggtcaagttggcctttgtccctgcttgcattgcattctttgctaagggaggagatggtaaagcctgtctgatagagtgcagctgttgttccttacttacactaaatcagaaagccaccttggatgactccaggaagttgtgttcatagggcctgactctggagccttgttaaaacattaaggttgctgtgtgtctgaaaacacttcactaccacatactttatggccttgctctctattctttcatttcaaaaggatgggtcctaccttcagtgcacttatatctagtagtgagttgatgttccatacagtaacaccctatttaacaatgcttttgttaataattaatatacccaacatctggcctccaataatagttataaaatttgataacttatcaaagttaaaattataattttaaagttatctgtacaatttaagaggtctactcaggaacattaggaagtgagggtgccattgtttaaggtgacttcttcctaaaccctctaaaatggagatagcttttgtctaaataattagaaattttgtatggattttttttggcatgaaaatttttaaaggcacttgagacaattactcattcgttacgatttagagtggacgacctgtagaagaattttctttgtaaaatgagctgactctttccttttgccttctgtcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccgtaagaattcagactttattgcttccctttatatttataagcaaaatggttcataggtctacttttcgctttaggtgttctcatgattgaatcgtgacttttagtagttttcatcaacgtgattactagctccattcgtataaagatttagttttgagtaatattcaaaaaaaataaaggaaagaaaatagccaggaagtttataaataaacttctaacttactggtctttggttcacttttgacattgattgattgattgattgattgatggagccttgctctgttgctcaggctggagtgcagtggcgaaatctcggttcattgcagtctccacctcctagattcaagcgattctcctgcctcctaagacctcctgagttgctgggactacagccacgaccatgcctggctaatttttgtatttttagtggagacggagtttcaccatgttggccaggctggtctcgaactccttacctcaagtgatccccctacctcagcctcccaaagtgctaggaatacaggtgtgagccaccacgcccagccttaacattttatatttgataataaggtcatgattaatgcaaaatcaaatattttcaaatgaatatggcttacaatatctataccaatgtaatggggtgttaaaaaaattaatagcattaactaacaataaaatctttaatcacagtgggataaagtagaatctctgtcagagtggcttcaagttgctaaattcagttgacttcaacacatttgctgtctagttactgcagagcaggaaattaaactttccaaaatgggttcatcagtttgtggctctcctggcagggaatagctcccaaatcataaattactgtaataatagaaacaactttatgaatccgtgctacataaagcagtatgttatattaaatgtagtgattgcaacatggcacttatcattgtattgcagttaaatattagagatgttctcaatatttgtgggttttttccagtacgtgaatatagtttgaagtcttaagaaaatgcaaacacataaatataatttcgtaagtagcaatatgggtttgttgatttttgtgaaagaatttgttaaaacagtaagctttgttaatgtattttaagtgccaaagttttgtgcaccactttttagtccacagagaatttcagtagcctattaaaatatatttatgaaaaaagaaagagaaggaggagggcaggatgattgaagaatatgttaatccaatctgaaatcgaaccaggcttgtaaaaattatgacaaaagagcactatggatgggaatgtaagaataaagataggctatcagggactctacctatttattaagattggattatgcatttggttctggtctttctgttggacagagagaaatggcaaacatgactcaatataccttttagttttactgtccttaagatgaaaccataccagttattcagaagcagtcttttttttttctgtatagttccaaaataaatttcttttatgacggtatttgatattttaaattcagtatgccttgcagcatatgataaatacctctacttcccaaagtgaggcttaataaatactaaactcacatatatgggcaaagaagaaaaacagtttcttttcccctataattcttcttctgtatgttttgctgatgccaggtgatgtaggcaggctgattatctaaatattttagcccatttcgtctgagagtggaataaatatgttagcttttctgtcagcgtgaccaagtttgtgatacgatatctctaacctgcaagttaagcagactgtggatatgtagagatttggtttttgtttcgttttgttttataagccatgctaaattgaattcccgtagagttcactaacattccttttcaagtaaattggattctttaaaataatattcttgtaagggatgacagaagttgatatttctttttaatattttgtttttctgcaacttcttttattaatacctaaaagttgcttcatttctatattaggaagtcattgtttgaccagaatattttgcagataaaaataaccggaagattattagaatattaaaaaaaaaattcatttaaaaaaattcttataagaagaatgaaaaattagtagaaagggattctcatccaacaggtgatttttatattagagtaaataatcctcattgtgtcttatcaaatgaatgtcaaatatgaatatcagattgcatacttaccattctatgttgaagtcatatcgtttgaaaactttccaatttctttctcttctcgcccccctcacttttcctacctttactcttcttttccattttctttcttctttgctgttctctctcttttccatgaataccattttttccctgcagctttcaccagaagaaggttatgtttctgctaaggaggattcctttctctacccaccacactcctgtgaggaagcagggctggctgacaaacccctcttcagggctgacttggctctggttagtggctatgacttatcaagctttctttcagaaacctgatatgtcttactttgcctttcaaaatattctgaagaagtctattatattctttgttcattattatatttggaaagataaacatgttttctccaacttagttctcacaattgaaaatgggaagaaaaaccataataaatatgaaaaacatttgtgaggaaaacttaattaacgttgcattgtagcagtatgtagaattaatctttgtgccatatctaaagtttgtggagcatttgtttgctccaatttcacgcttagatatctctaggcattctttaactgtgctcaatattcagtcataaatcactgttttggctgtatttaatgaggtaataggtatcttttttccattagatattaatagtgtgagaatcatataaattggttcagttattaagaacaccagttttatggaaaggtaaaccccatgttttctataaatacatatatgtaagtatactgatttaccagaaaaattataaattaaaattttatttctgtttgatgtttaaaatagtatccattggaataaaagtatttgcaggcactctgcccttaagaaactttttcttgtagagggtacaatgctatatcaataactaaaggataaaactaaataccaggcatgaatatacatgtgacatttactcaacataaatacaacaaattgtacatcctgttcacattacccctactattagagctaggttccttactcaacgttttttgtggggcaaacattgtgcactgttgctaaaaaggaatatacttgctttttaaatacttgtttgagtttcattagactggagaaaggtttaaaacctgttaaattcttcattatgtgtttataactgcgcacatcttgctttaaaacagagtgaattatttctttgactatatatacattttgctgattgtaatttcgggggagacaattccttttgctaatatttttaaattgcaagctcttgaaatagccatttgaaaagttttggtatatgttataataaatgcaataatttcacactgtaatacttaacataccaggtaacttatggccctgctctccatgggtattatgttagcacttcaaaactagatagcttagtatatacaacgaattacatacagtactgtggtgtaaatagtacccagccatagcaaatactttttgaaatgtcacaggatacaaatactatatatgattatttctaaagtacccgacgaaatagcattctctctagcctttacatggcttccttgaacctccttaatggataccaatcaaaaggaagattagttccacttttatgtgagcttggcatcttataatagtaatatgcgtcctgggtcttctccttagccagctaagtaatcttggactggtcactcaatttctttgagtcttagtgttttatctctacagtaaataaatgaattgattgttaatatctctcctaagatcctaagatatcagcaatatacatacaaattatattgaggtattctttcattaatgttacttaaatatgtattgtaatctatgacacaaggcttagttaatagtgtctatctagattgttgtatgttatgtatatttgtaagggtaaacctccacatagtgactcactagtgaatttgaacatgtatttaaaatatattattaggcctatgaagtatatttgaagagaaaatcacttcaaaatggcccacaggtatttttaatagttttttgtaagaatgtgacctgatataatgttataattcttctaacttctcctgggtaagcagtaagttgaaattacaaaaaaaaaattagaacatatggaattttgccaagatagacagaaaatgctggtagtatcagagaaaggtagtatatatgtcagttctgcctattctcaggtatgactttgagtgaattgcaaaaagaacttcaagctcatcataatttaaatattaatcttgattctgtgacagaagacagcaataggattattagagaatatgtagtgaaattctctatctcactctttatgagttttcttacaagtttataacttaaagcttcaccataaccagatcataattaggccccttgtttgttagtataattttagcatgaaatcacagattttctttttggtttctgcaacttgaatggttttaaaatctagttcaagataatttaaacaaaatatatagttttagtgtggcttacaaatatataattgcctagctgcctcattgaataacagtttattttagttgactaggaaaaattatgacacaattttattataaaattgtaagagttgggcatgggaactgtaagaaagtaaatatttttcttaactatggaactgtttaaacatagacttcatccaggccctttgttaattgttgcctttagcccttttattgatgaaataaaataaccttgtatgccagcactttctgctgtaggtgggctatttatccttgttctgctgcattagcagtgtctgatgagggttaagagggcatatagaaaatacaatagataaaagaatgataccagtttgccttttagtctcaagtggagattgtttgtcatatatgtaatagaacagaattcccaactgatattattgttttgtttctaggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggtacaaaggaaaagccaatttttcttttataggaaagtcttgtgtgtaattttccagagctcagtccttatggggagttgtgggaataacatattggagacattatgtttctccagttgtggattcattattggattaaagtacaatttcatttagctaatgttggttggatagctttcagattactagaaactatttaaatttagtgtctgagaatgatagatacagaggctcaaagctttgattagggtttgcatgtcagaaagaaaaatttagcatcatatatttctcaagttgtgtttttagcagtgtatactttggaaaaattacaagaataactttattttcttaatggttttaaaactgacttctatgcaaagttggatagtaaaatatttcttgcattaatttaacatttactagctaagttaaacttaatgctgtcatatgtttttatacaaaatgatgccaaagaatactttacataaaaaatcacagtgaatggtaaattatgtttatgtcactggatgtgaacgaagaatttagtcactatttgacatatctgtgccatttatattttagaaatagattattggcataaatgccccaactctattcattttcttggtgacatactctataatgttcaataagtaatactttaaaatgtatccaatgttttgggtgtgaaatggtatcttactattttaatttggatttcctgattactaatgagaatgaatgtttttttcataatattggccatttgtttttcacttttcatcaaagatctcttcatatcttttggccattttgtattgggttgctcatttttcttttgattctttgcagttgttttttggaaattgatatgcaaagcaattcaacatatatttttaatgaatatctatgtacatgtgtgtagtaaaatctaaaaatgtgttggcaggatacttctcaacttcaaaaaagaagttatccttggagaaaaaaggaagtatgggaatttagctatgtgtctaatacattataacatattatgaggaaagagagattgatgaaaatatggcagaatgtttatatctattaaatcatggcaaagagttcatatatgaatatattttctttatttttctatattggaaatataccataaacatacatttaaaattaagttgaaaagactggacaattttttttaatatacgaaatatgtattttctgcataaattgaattcaatgggaaggggtatttatgaataagttggaaagtagaatttccgtaggtctagcactgttttcctcctttcctgattaacaggttttttggccagaacattttcaaagcattttcttttatgttcaaggtgcacctgttatccttgcaaatgatgctgggcagtctccttgaaatggtttgcaaggtataatcttgagtggagcagctgctcctctctcaccacacctgagactgtctgtctggctgtgtcctgtctggaatgtgttctggaatgtgttcagtctttactggcctcagggctggaagctgagttcatctcctgatggaatctcctaatccacagcatagcacacgtcttcttcccagtggacagattgcattgtttaacttagtaattgttacttaaagggattacacaatctgcatactgagaagcatatattttacagggcaaatgctggctgtatgcagcacaacatattggcttaccgaagtctgtttgcctccttttgtatttatttattttgttttccccaagcagtttactcttttgttgaagcaaattttggcaagctcgtttatcaactgaaatacttaaactacaaaacaacaaagaagacattaatgagggtgttttaaaacacattgtgaaactcctgtgtgcttttagttttcttaaaaagtaggactgttcctgcatcgtggtaaaatctctgcaacattttatatttttggtgacaactttctaatacctagacttttgctaaaattttttatgtaaataaaataaatatataatgtgtccttcctgtttctttgcaacaaatttatattaaaaagacacaatggtgatttgttatggaatttacaattgacaatttttcttaaaagtgagcgtacttaaaggctttttaatttataaagtaataccgtatagtatatgatttttaagaaaaacaaagatgcctctatcttgatttgaaagaaggattaaaatagaatgtgaggatctcagcaattccttagatttttgactttgctaactatgtgattatcttgtagccttaaatggcaacagggtatgaacaaataattttacctgtctcttccccttgatgaatggtcttttggccttcgtcaggtatactaccagaagtgatcagtgctaatcacctacagcacagactcttcatagagggaggcctcgctcttcagggcagcctaaacaccaaagggctgtagccatatgttggggctcttcctcacaaaattatctaatttgggggtccattctgctttacttttttaagagtatgtatttgcttaatttgattagttaccatgtaaagatttacgggaaataacaattactcaagaacctgaaaaatatacccgcctctatggcatttggcttaatagaggcaggtcattgaaatatggattttaagagcaacatggctctagccgtgtttttcctttcttattattttatgtttgatttctttggttaatcattttactccttttcccttgttacctccaaagatatgacaaaatgcagaaataattggtttttaaattggcagacttttgtttaaaattttaacatggtttttagaacatttttttttcctattttgatttaaaaatacaatggataaagatttaatatctattcaagtttccccttctactccttattcacacctctacaccctgccctcccgtgtacactcatactcttactctgtccggtgatgatattgttaccaatgtggtgtctatccttcgttcttgaatatcagttctgccaggaattactttttattctaatgcaggttgaacttgatgtttatcaagataggaacccttttgcaccttgtacgtcaactcaactaacggatttaatgatattttttagtagtctgaacattcttacaaattattacttagtgtcattgtctagcataaaatattattgccttcacatccatgtttagaatgttgatactatttcttatttttttttgcagatggggttagaataaaaaactaaatcactctaatcaaaatgatgagtgactgtgagagtcttagtgacaaaattgcaggctctccaaggtataaaagatgttgcctttttccttagtaggatcagtgtcaaaacaataaaggaagtgtaccttatctcagaaagagtgggagaaggacagttggagcagctttggttgcaatctattttttaaatgtataataaggatcctctggtagactgcttattgaagaaaagcaggttatggctattaaatgctcgtgtatttagttagtttttgtaaatatattatctgggtaaataatatgcccaactctaaccttaatttatgcattgcgcttaagaaatagaacttttaaaaagtatatttgacattttaatttaaccttttttaattttttactgaggacaagaatatatcaagtgaagtcacatattaatatagacttttgaaagacttcactttagatatcaagttgcactgggaaattgtggttatttttgtacatcttatgagggaagaactgtttttcttttagatccacaagacttttaaaaataaaactgagttggttgttgagcaaccagaaacgtttctgaagtgggcgtatgttgtctactgtgttgattagctctttcttttctgtgtgtctgtgttaactccttcatgaataatgcatgggactgttataccatttacagtacaccccagctaacaagggcgacttgacctcttttgctaatgaaaagcaattttgattgttatctttgaggcatgggggagatgatttactaattattataatcaatttagcaatatggaagctaaccagttctgtagtaagtacattattatttttcctaagaataaaattatcaaagttgggtgagggagccaacaggttattgtttagatcctgggcttgtggaggatgataccttcctgtcatttgtttctgaagatactacagatgttaattgcttatatgatatttccacttgcctcaattctttgtactaggaatatctgataattctagagagataataagtcacattcaaggaaaggagtgtaataaattgtgttggagcaattaattacccgtttagaaaaaagtgacagacccatatctcacaccataccctgaaataaatcaagatggttaaaatctaaaagaaagcatttataaaagaggaaaaatactagaaagcatttcatttactttgtgtggaaggacttattaagtaatatataaaacgcaaaagcacaagagaatgacaaatttggttgcagaaataatttaacttctgcacgacaaaatattacctgtacaaactaaaagacaagtgacagactgggagaatatttgcagtgtatatcacaaagactttatattcagactgtgccaatgacaagaagaatgtctattcgtcaccataaatacctgtaaatgcctattaagatagttttctcttggaggctcctgtgaatccagatcaattaacgtcatatgctttatgctcttgatctcttcataaataggaactttaaagtgattagaactgaattgcattttaagtgaaatttgaaattatgagttatttgcctctatatgtaatttgaactcagagaaaaatcggataaagaatatgaagagagtgttaacagaagaaatacaaatggcttatccttgataattgtcaggaacacacatagtaatacactaatatttcttacaaatcagattgccaaactaatctaggactggcaagattcattaacaggtattcccatattttccttctgtaagagaaaattggaacacaagttagcagtatgtaccaaatttttttttttttttttttgagatgcagtctcgctctgttacccaggctggagtgcagtggcacaatctgggctaactgcaagctctgcctcctggattcacgccattctcctgcctcagcctcctgagtagctgggacttcaggcaccagccaccacgcccggctaattttttttgtatttttagtggctcacgcctgtaatcccaacactttgagaggccgaggcaggcgaatcacgaggtcaggagatgaagaccatcacgatgagaccccgtctctactaaaaatatgtaccagcattttaagtgtgcatatcatttgaccaaccattgaaattctagtggttcatagtgaatatatcttcacacatgtggacaaagatgtagaatataaataacagcagtagctaacaattattgggcattttctattaagtcaggcctgtttttagtactttgtggatatgaatactctctgtcctcccaaaagtcctgtattagtttctattaatttccccaattaggcatagtgtttaagtaacttgtccaagctctaacatttaattagtgttgagccaggatttgaactcaggcatcctggttcacagtctacacaccactgtctttcatacttaggaataacttacagccataagaaaattgaagttgacttgtttttaaactgacatggaaatttctcacatcaagatgaaaagatactgcaaaaaaagtaaaagtgctatttattgtatggctgtgtttagtttttaaaaatatatatgtatatctgcttgtatgtgtgagtgtgtgcatgtgtacttatatgtatatattatgcaaatgcattaaaaatttgatggataaacacctaactgatgctagccatttttactggggaagcgaatggaagtagaagccatagcgaaaactcttcatattgtattctatatgcatacacagtatatgtctgtatcttgaatcctttatgcaatagtatgttcatatgctacttttatacattgaaactatcaatgaaagaattgaagggaaaactgatatgtttattcaacagcagtttatgaagcaactgctttcccaaagcactcaagtgatacaatatatctgttgtaagtagatatacatatttatatagaactctacaattttagagtttcagaggattgtagaaattatataaagagaggttctgtgatatacaaattgttaataacagagcctggatttagagcatacattttatgacaacccgtcttactattccttctgttatatcgtacagaatatttatgcaaatttttcctacgataatttgaattgtaaaactttctattcttctccataaatacttataaatgcctatcaaaataattttctcttggaggcccttatgagtccaaatcaattaatgtcatactttttatgtccttgagctcataataaatgggaacttcagactgatgggaaacaaactacactttaagtgagatttggaagtatgctacttgctcttctatgtaatttgaactctgaataattttatttgtaaatagaacatagtatttctaaatgatcttacgtacagtatcttgtacaagtataactcagtagaacgtgagatgtatgactttcaggaaatgtatttaaaagcatttatgaaaataaagatatgcagaaaatctgctaagtgaggaattgtgtttgttaatgctttttgagtaataaataattgttatgttttacatttcactaaatagttgttcattaagaagtgatgttatatattgatgtaattctggtcacatttttcatgttttgttgttgttgttttttaactaccaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaaggtaatattttaaagatatggtttgtgttttatgatgagatagggaatagtgaagtaaggttattctggctaatctcttcatttggaatgagtgcttcttgacactaagattttcagaaggcaacctatgaacttgttttggttgcaggttcttgcaaaataaagcacaatcaattagagaacatgcgtgatgttgaaatcacgctccaaagtctagtttccctttccatgtgacttgtgacttctttttctttcttaaagggctctgagtacctgcttgaacagagctccctggcctgtaatgctgagtgtgtcatgcttcaaaatgtatctaaagaatcttttgaaaggactattaatatagcaaaaggcaattctagcctaggtaagtttctcattttcctcatatacctactcctcaacccccttgacaaggggaaatattgaacatggtaaatttcaattttttatgctgtagataagagaacagatggtagaaattttcctgtagtttttatttctatgtcctcattatttttttgaaatggtttacaggtttgtttacttcatatgagcagaaatccctcattctcttaattcagagtattcacaagcctcatttacattcagtaaaagatatatgaattgtttgtgtatgaaacagcaaatcagaaaaggaattcttagaaaatgaaaactcagcaatttggaattctaaattctttggaaaagtaaattattagttactttgaatgtaccagtgatgtataagtcagtttatatttaatttctttcactcactgaaagaaagactaaaaagacaaccaggtgtgccaccaccaaaatgtaaatgtgagttattcagtaggacttcccaggtggcaggatttttttgtcctattttaaccacaaaaccctctgaattgggcaaaaaagactttctgtagaaatatcctaattacaatagctaaaactgtgttgaggcagagcacatttgttctctcattgagttacacagtcatgtgactcagccctgtctttcttgataaatagaatggtagatgagttgctctgagtgtccaaatgcagcccaagactctggttaattcagcatcagagatccttttccttctatgaagtaagcaaccactacccgttacactgacgtcttatggcagggtcttgtttccttgttaagttttgagatttggcagaggaatccagcagtgcttacttgatgagtgggatttcagccttggtctccaagattttgttccatttgatggtggcggggtactaccaacagcagctaaacagaattgtagcagatagtatttgtgttgttgtaatatttcttatgtacgttatgtttaataggatgatgatacaaagcttgaactgcagaactttgcataactcattaattatgagacagatatctaagccatgccagaattatttcattggctaatttagtatttctgatgccatgttactcaaaatactagttttgtaggatgttaataggagttataaatgagttccaagtttaaaagtttgggatgagataaatttaagaagacgggtttctttttacatctcaatatcttttatactccagtgtgcattgtgaatcactaagagattatcaaatgtagcatttttcacatttaattggccatagaacccatttttcttgaataattgataaggcagagattttgcaaagcctatctgagaactattattctagtgtatttactcaactagcaaacatttattttaatactatatccactatgcatagacaccataatatcactgttcttaacacaagtttaagagagtaagctaattgacatttaaaatcctaaaggcattaaaatattgtacatgctataatagatacttacagagaacattaaaggcttaaaagagggaataactaatccctactctccaagtgtggagaactttagaatggtttcagaaaagaggagatgtatgatttaggtctaaaaagaggagatttttaccacatagttgaggaatttgaaaaagatgaaagctgcttagaagtaaggcagagagatgtgaaatattactgaaactggtttgttatggatgaagtgtggtatgatgactggcaaaatcagagttggaactaaaggaaggataaatgggagacaactgctggatgggtttgtgtgtaggacacagaacttctgctgcagccatctactgccttatccttcatgtaggcagcgggagctaagggtagaagagtgacatgagcagatttgtgttttaagaagagcattcagcttaggttggtgaagcagttaggaggctcttgtaagagccatggtttgggtacatcagattttgcaatctggctatttggattgcttaccaattttttttttttttttgagagagagtttcgctttgttgcccaggctgcagtgcagtggcatgatctcggctaactgcaacttccgtctcctgagttcaagcaattctcatccctctcagcctcctgagtagctgggattacaggcctctgccaccatgcccagctgattttttgtgttttagtagagatggggtttcaccatgttgcccaggttggtcttgaactcctgagctcaggcaatccacccatctccgcctcccaaagtgctaggattacaggcacgagtcaccctgcccggcctgcttaccaatttttaattaattgtaagaatgctgaattttgtcaaagcatttcttcatctattggggagattatatggattttcttatttattctcctaatatgtcaagatacattgattttttattgtaaaatagacacagcataaaattgaccattttcatcatttttaagagtacatttctgtggcattaagtgcactcacattgttgtgtagccatcatcaccatccatctccagaacgttttttgggttccccaattgaaacgctgtatccattaaacaattattccccattgctctctctaccagtcccctgtcaactaccattcatttttctgtctctatgaatttgatgaaatgcttcatgtaggtgaaatcatacagtatttgtccatatttgactgtgtataatgtcttttaggttcatccatgttgtagcatgtgtcagaatttcctttttaaggctgaataatattccattgtatgtatacactatactttgtttatttattcatctactgatggacacttgagttgcttccaccttagtttttaagttttgatataaaatatactaggttaattaagttattggaagaaaacagtgaaaggtagaagtgtccttcctttccatcacatctagaaacccatttaaacctccctcaacagcctgactttaaaattaaagtataaaagagccctgtcatttttttagtgaaagtaaaacatttggccgggcgcggtggctcacgcctgtaatcccagcactttgggaggctaaggcgagtggatcacctgaggtcaggagttcaagaccagtctgcccaacatggcgaaaccccgtctctactgaaaatacaaaaaattagctgagcgtggtggtggtgggcacctgtaatcccagctactcaggaggctgaggcaggagaatcccttgaactcgggaggtggaggttgcagtgagccgagatcgtgccactacactccagcctaggtgacaagagcaaaacttcgtctcaaaaaaaaaaaacaaaaaacaaagtaagacatttaagtgtgaaatcacagcaccattagtttaccattcacactgtaatataaaagtgtaaatcacaattagtttaacttttctgcttcatttccattattgatatgctatgcccaatatgtttatagggctttctccctggcgttttgatttcctgggacccagtgaggttcctctggcattttggagttaaaatttactgcatgccaaggcaacaacattacattactctgttacctcatttcagaggagatgctaaatgttcagatttctatagcacttcgaataactaaatgtaaaggaatcttgaaaaatctatgtaaatattaaagcattaaattaagctttagtgtaggaaggttttggctgtataacttaaagtaacaaaaagtgtgataaatagtatgttaggaagtctaaatagaggctgggtttgtgctagtggaaaagtatattatgaagaggtctatcaatgagctcattttcttagattcatagtctccccttaatcagctatatgcagttgtttgcagttttagctttgtggctaattttttctttgtctagtgatgaccagaagaagttattaataaatgacagctttctgtaaaggctgtcataatccattgttttgatttcatgaatcatttgggtttttgaattttgttaaatttagagtgaaaatatatacagaaatacagatacattaataaatatacacgtgcatatagtgacctttgaaaaattctaatcttgatgctttttgataagtctgtggtcccttgcttaataatgtggtgtttggacttgaaggtaaaaaaacaaggttcttcaggggaaaagaaaggaagtctttatcttcccttcactgattagatacagaaacatagacagactcaggagtttctctgaaattactcaacccttaaaggggtagagtcagaactcaagcctgtctatctctgattttcacatagaccgtacaatacattcagtacttgagttacccaagggcacattatgattgttgtactaacaggcttcattttgaagctgaattaagatttgcatttagtctttagggagcaatgtaaccttgatttgggggagagatgcattttaaacatattttatgagttttgttttgtttttagttttgtgactaaattttgtcgtacactttgtgtcaggtattttcaaagtactattacatatgtgtttctcacttagttctttaaacaaccctaagagtaaatgtcatccctttttaaaggtaagtaaactgaggctctgtgtgaggttaagtcagttgcaagcttgtgctgattggaagtggtggaattcaggtttgtaaccagttctctatttacaaagcacatgatttgggatttgggatttgggatattctttaatacttcttccaggaaaaaaattgagagatcttacaagttacaaccaaaatctggttagtggagattacctccaagttattgcacctggaaaattgtcatttggtgaaaggaaagtataagctcagctaactgatgttgacctcttggtttacatggttgatgtgacctgacagccttaatagctgagaatcgtgagttaaatatgctattaaaagtgaattcagagatcatgttggccatagctcatgataggttccatgtctgtgtcttgccttattgtagtctgcatggtgctaataagaacaagatggtaagttagattcccactgtgatccactgagttaaattttactttgtgctgacacatttttattttaccaaagtacagttatattgtgggtattggtgggaaggctggctttaacagtacaaaatggagtaccttttgaaaaatttcagattcagccttttttctcacccgaaacggtatcttattgttttatggtaagcagaggtgtcttcttaacaatacacttcaaaatcgttagtatgagtcttaacagaatattttaagtacatttaaaaatgttttatttctatcagaaaacagtaagtaggagcctgaattgcccacatccactatgaaatattaggctagaaacaaaatcagaatcattttttaaaatgtttgaaatatcatatctaatttggtatgagtagaattaatatttggaaagacatcattttttaaatatataaaaacctaaaaaggaatttgtgacatctgtcaaagaaaagtttttataaataccctggtagctttatatctctccatagcttgtttaattatataattttgttttggaagaaactttcagcacttcgttttaagtgaacttacattatttttgcaaagtttcaaatataatttataagattttatatttttcaacgaatagaatgaggataggatgcaaagggaacattaattcagatagagtctgttgagaaggactttctgaggaagtgatattgaagagtgagagggagttagctgtgcaagagctgcagaaagaaggtgtcaggcaaagacttcaaaacggacagagacgagatgcatttgtggctagaacttagggaaccaagaaggacataacacaaagcaaggatgcacactgcaaaggccagtgtacccctgtcctacagactgtgctgagcaagtatgttgtgtattactataacaggaaactattgaagagttgcagccaagggactgataggatattacttgtctttttttttgtaatggcctctctgtcttctgagggaagtatgcattgaaggagacaatcatggaaggcaggtgaccagttaggaaggaggcttttgcaaaaagtcaggcaagagaaggtgttgccttagtctggagttagtgtctaaatggaaaaaggtaaatggattcaagataaattttgaagatagaaatgacaggatttggtgttggattaaatataggggataagagagaggtatgcatcaagaaagaccccggtatttctactttgaataatggagggtagtgtggtagtgcaatttaccaaaaaagggaagaaaaatggagaaataaagtgaggtgaaaaattgcaggttcaattttatacatgctaagattgcatttcctgtgagacatccaggggatgtgaaaagagggcaatttaatatccaaattagaagcttaaagaagttcagagataaaatggaaatagattaagttcatataaattcatttcaacaaactgttatactttcccacaccactgtggtaggctccaggtatgaagacttcaatacaggcttcttgatgttaggaattctgtgctatgctgttatcctaagcaaccaacatagtacttggcacatattagccatatagtaaatagatcctgaataaacaagtgataaagaattaaggtaatagcggataattgcttaatttacatgatgaattttccttttgtagtccttttattctcttttatgtgtaaaagctgaactaatattgtaaaactgatttgatactatcatagtactctccctgagagacctttctattcaaggggtcagcacatcacatggtctaaattacattcattccacaatgtagatctgttttgtttataatgtattgactatatacaatttcacaaacatttacaatttacttaaaaatattttttgttagaaacactttttcctgtttttgctatgctttttattgactgaaatgttacttgtattttttaatctataaatcatagaaattattaaattcaaattaaaatgaattgaaaaatcatgtatttaattatatttgcatttctcttttcctgtaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaagtaagtatcatttgaagcccagtttaacttgggaaattcaggaatttcaattaatcagaattctttttcagtattcacttctgtttgagatgcaaacgttatcacattttttttaacataaatcactcaagaaattgactatttttgagtagttctcgattgtaagtttagtttctttgagactatatcagtattaaaaatttggaaacgttgctttgtatttttaattatacttctccagtgatttctacaacaaccatagaagtgagggatgcaatgattctcacagagcaagagggcccacttttaggatcttggaaagatgtttggattggctttgatataaggaattgtaccctacctaattgacctgtgtgaatcctagaactaagacagttctttaagggccaggcatgcaaaagacaacataaaacagtgtccatctgacccaaaacttaccgtttcttgagctatctcatgaccccaggggatagaccaatatgttgatatggtctgtttgtaggtcatggaggatattttgtcaggaagtgcttaaaatttccaataaccccataatgtactaaaagcacatcatatatgtggtttgttttttaagtcactaaccattccttgagccaacataaaaatcagctcattactttattgtgacacttcatcaatgtggcattttcctctagcattaatcattgaatatttgtttttaatgtatgagggataacatcataaaataagagctcagggaaagattgtttacctaaaatcgatgtaatgattactagtatgggggacttttttgtattaatgttattttactgactacattctctattactagtccttttgcaaagtatgtattgctagggcttaggtaacaaaagctgtacagactgtttttcattctgtggtcaataaaaagaagaaaagtatataccatttggagcagattccgctgtcttatataaaaagtattatttttaggcaaaatcttcactaatgggctttcatatttgtgtatgcttttttgacttttgtttacagttgaacagatcatcagatcatattactgttccttaactgccttataataattggagtacaagtaaacatcattaaaaatgtcagtccttttatcataagaaaagagaaacttcaagtgttttctttaccgcttatggccagtgttccatgactagatcatgtggagactatgtatttatcgcagggttttagtttatgtggattagatgtagtataaaatgcagatggactagtaactgttcatctgatttgttgtgccatgatgtacatttatgctgtgtgtgctgataccagtctgctgcccactttttggcattctgatcaccagaattagtacttggtactagccctaccactcagttctaatgtactgcagaactttaaaagtcgttaaaaaataagaccattgtgacaccagtttggcataagtcatgcatctggtcaactctagaaaacttttgaagtacattttcaggctcaaagtcttttttcccctttcctcatttttttgttgtgtatttccgtttcccctctcccactgattcagcagaatttaccctatcatgtgggcagaagctttattatgactatgaagggtatctagagagctagcttcataagtacttgctttaggatctcaggaggcaaaatgtactatagaatcttaaattattttaaaaagaagaaaaatcgtacaaccttccctcctctggaaatcagtcatccattcattcagtcagtgagtctctctctcgtgtatgtaaacacacatgcagacattcaaaacacgttgatttcttctcacatgccttaaagatactctgattcaaatgcttatagcttaactcattgagtaatgataaaaataaactaaaatcatccttacataatgctttttcagaaaaaaaaatatgttagattttaaaacacaaagagccatttaggttgaccagggctgagcagcatgttctgtgcattttgcatgaagtgtttttggcccttaccacttgtttcgtgaagcaaaaggtttagaattaccttgaaagctatgtgaataatcttcccaaaaggaacttttagtccttccattactctgaatagaaccataacattgcctcaggcccattaagctttgtgctcattacctggatctaggctccatccacatctctttctcattatttttctttatgaacctagcttaatctgggtggtggtggaggggtgtattgtaggaactttaaaaaaggagactgtggttgagttacataactgattggttttagggaaagcattgcttattgagagaatgcactggatttcttttttgccatttacgatagatagctaggaacttttgtgtgtgtgtgttcatgcatgcatgggtagataatttgagtttcaagagttcaagaacagccagtttaagatccaggtttcattattttctatggaaaaccagatgcgaagcctcaccagaatgcattctgtttcacttctccctccaccttgccaggagctcttatatttctgtaataatagccagggttttgtgcttagcagcagctgcttataacatctgccagataattactgagctgaatcagaattcacctgccttaacctaaagtgtgggatgaattcctgatcaaggaataaaagactgattgcagttacattttttcatgcttgttaataatcactgctatagacactagtaaagagcagatgcttttctgggggaggtgtagatgggagggaggtggaaagggggaaaaaaaacaaccaggagcacccacttttaactacatatgtatgcatctcacattcagcacaagacattgacatttgttaacaccattgtaaaaagatgccgcggcgtatgcttcacattctagattttctgcagcacctgctgacgatcgagcccccttttatgtgtgagtatcagtgattcgaaagctcattatggctgtgtgttacaacttgtctgtgaaaacaattttgtgcttttgtaatgtcccaatgcaagaatagatccagatatagattttgtatatacattttagattgttttctttgtttaagtaagaacataaaatccaacagagctatgagattgttacgttttcacattgtactgatgattgtgaactcatttgaaaatcatattttccaattatgaagctttcaagctcctttgtaagggaacgatcctgtctgcacgtgcaggaatagtctctgcattaatagccatatcacatttcagcatctctaatggtattcttttttcttctagtccatgtgtaaccaaaagttagtccatgtgtatccaaaagttagtttgaatttttaattcaactctcaaataagcatttcagtgtgttctcgcagctcataatttagctttggcatttttgctggcgatttggaagttctgtatgatcctgtgaccaggcttgtgctagcatggctctgcatgttctgttgcattgtgggatgcttgttctggtggcctcactctctgtagtggctaaatagttaggaaaactaccgtctctactctttctcactgctatgcaaagtatcagaaaaatatttgtaaatgcctacactcctcacctttcggtaaaataaaaaacaactttgaacaaatataaagaaaaactcatttttaacattgtttgggatggaaacatctttaccttctttctcaaaccaataaaaaattaaagacttcgtactgattgctattatttttgctattctatcctgcctttcttccctgaccttttcctggctttttaaacttacgttttatttatatgagttttactgaatctttaggaataataccagttttcttgaataagcttttcacattttaggttttatgtttatctttattttattttttcattgtttaaaatataatcagtcttctttcctgacataatgtattatttgaagggctaaaagcaaatttgctattcaatatatttttgtagcaccatagagaagatgtctttatagatgaataaattaaatagggccagaattggaatgcaactttttcagctagcctagtcttaaatccattgatctgtactttgattcagtttttgacctttgaggtaaaagtgtcacgaagagattcccagaggccccatgtattctgcccaagtgatcagtatgaccaggagagctgatgacctgtgatagcactcacttctatttggattgtgctcctcagcttacagtagcttcacaaaagtgacatcctttttgtggtagagggtatggaggttcagcagtggtgatttaccccatgacactctgcgtggtagcagaactgtgtcttccgactccaaacccaagtgacctcgcactttgaagtgaaagagtgaatgctttctatagaataaccaatatatttgaaattatgtatactcctctttcagtaaattatgacattggtataaatttttattttattacaacataaaagacaatctttttatctttgccctccagtgctgaggttttgtatacttattattttaacagataaattatggacagagggtttaataatctttgtgatttctaatttttagttgcacaaacatgctgtattgagttcagatacagtatttctcttatgttactattcattaatttgaagatcttgaaacagtttactttaaaaagtatgtccaccatgtcagaagcaggacagcaggacagcagtagacttgaattttcatttatcagtttctaaacattacagcaggagtcagcatctggcacagtgtcttccgcataataggcattcagtcagtacttgttgaattagtaaatggccattcacgtgtaaatagtagtcttttctttgagaccaaagtgaattttttaaaattgcttcaaattagtaagagtctttccataaactcaaatggtttaatctcatacttcagacttaagagttcataacttaatagagctaacataattattgaaaatgcttgttaatctctagaattaattatgtattatagaaagatgcaaagtaatttgtgatattcagcattttaatagagtatacctaatttgtttctgctagagatcccagaaatctttgggcaaaattaatgttattgctgacaatcattattctagggatttatagatcttcctaatttaaaaaaaattgttgttagccttttcatttgataatataaataattgttttccttctctgcatgatgattggtaaacacatagttaatcagcagcatttaaaaacttagtttctgttgttactcttccctatagaatactttatcctattgaagtttggattctctgctgaatatactgattaaatgagttgtatgaaaaagtagggagaaagggacaatatgatttgtttcctttattttagaagcttttcctaacaattaggcaaaatattatttcccttcacttccatggattctggtttgttccagaattacttatgtgcctgcagaacatttggaagagttcaaaataagcttgggacaacaatctggaagagtaatggcactggatattttttcttcatacactggcaggtaagtgaaacattaaatctaatacaatgaatggtacagcaagttgtagagaatttggaattcagagtcagggaggactagagcaaagaaaaggtctgaatccttttcctctttcaagattttaaaaaatattcttccctttccctcaattatataagtaattattatatagtatggaaaatttgagaaatatataaatattcaaattaataaattaatatttaattttaccacacaatgtagcacttttaacatgttgagttttgataatttgccccaaatgagtattattccattaatttcttagaacgtaagaaattgtatgatttttttactcttttaatattagcaaacttcttcagaaatgttatttattcttttattaacatgcatacaaattcagaatttttttcttttttttttttttgaggcagagcctcactctgttgctcaggctagagtacagtggtgccattacagttaactgcagcctctacctcctgggttcatgcaatcctcccacctcagcctcccaggtagctgggattataggtgtgtgccaccacatcaggctaattctgtattttttgtagagatggggttttgccatattgctcaggctggtctcaaacttctgagcttaagcagtctgcccacctcgtcctgccaaagtgctgggattcacaggcatgcaccaccatgcctagaccagaaacattttttatttgtaattttcttgctcttttggagaatgttgagctgaacccgttagcatatatgcatgttaggaaacagtgtttggctttttaaaggcacttgatatacaaagtattaagagcctttaaataataaagggaacgttttcttttttcttaggaaaggcaggaactgggttttgatgctgctgctgactgagtcaagatcagggagagaaataatgtcaaactgcttttccatgaagaatgtaccattttacactctcagttgtgggcctgtgtttttcagttgtgctggcaactgactaccaaatttcttgtaagcatgtggtagagcagaaatggccttgcaagcactctgaggtcttctcagaagagagttctacaattcttttttttttgagacggagtttcactcttgttgcccaggcagtgcagtgcaatggtgcgattttggcttactgagacctctgcctcccgggttcaagtgattcttctgcctcggcctcctgagtagctgggattacaggtgtccaccaccatgaccagctaattttttgtacttttagtagagatgaggtttcaccatgttggccaggctggtcttgaactcctgacctcaggtgatccaccagcctcggcctcccaaagtgctgggattataagcgtgagccgccatgcctggtcgagttgtaccattctttagaggatgtcagaacatcccagaacaccacggtctccagtgaccttgcattcattgtgatcttgcttcactgattcctctgcacattacagatgactacagaatacagaaagtgtcagggaaggggaaggtatgttatttgtttaataaagggaaggaatggcatggtccttggggcctcatgaatattatgggaaaaggagtataattgtccctcattatctgttggggattggtttcaggactccccatggataccaaaatccacagatgctcaatcccttatataaaagggtgtagtattcgcacataacctatgcacattctcccatatagtttaaatcatctctagattccttataatacctaatacaatgtaaaagctatgtaagtacctgttttatatatatatatatatatatatatatatatatatatataattttaataatgacaagaaaaaaaagtctgcacatgtattttgcagatgcaaccatctatttttttcccaaatatttttggtctgctgttggtttaatccatggatgttggacccaaggatacgagggataggggagacgcctatatttactttacacttacaaagctcagccacactccaggatttccattgtagggttaatggcatgagttggttatagtttcctggtgcttcctgtcaaactggtaaaatcaattatttcaatgtccctctgaaatattgtgtcaaatgacttacttaaagaatacaccaggtaacatctgagtcctgttaagttctagggccttaaaatactcaaaagttattagaaagaaagccactttgagcactgtgcttcctccaagcacagacaagaggatggcctggattgtcctgtgctgtgactagctgcttcactgcagagaaagtatattttctgtggatatcagaatgcttaaaatagaacacatggatatgcatttttggtggaacaatctgcaagagaaaggttaagtaactttcctgcagctaattaatgccagagccaagtgtagaatgtaagcatactccatgttcttaccattggaagcaaggaaggaattgcacaagtctacgaagcatgtgccatataaaaatatgtggcagcatagcatgaaagttaagagctcaggttttatggtaagatggcctcaatccaaatctcacctatgctgtctgccagtgtctttctcatcatgtgtctttctcaccatgtgactttctgccagttactttacctggtacatatttgcagatataaagagatctacttattatagttgataacatttttgttggtattcagtggtttaacacagtggaaaagcagttgattgacttctttcttggctgagtgcatgcaggaagacatgacacttgagtccctgaaaccacacactaagatgagtaaacaataatcagcacctatagaggagcatatatggggtttgcgaaaggattcaagattatagaatcatctgaagagactggggtccttgtattggattattcaggatatttatcttcttgtacctaaaaaggaagaagcaagatgcattgtggctacggtgtttctgaatagctctcactgcttaggctttagggctaaggacctccccccatcccctgcctgtcactgaatattttaaggactgtttctaagttctaattcttgtctgtcttctaactctgctttcttcgtcatactctgtcctgttgtatttccaggtcagggctaatttttacctctctgccttgcatcctctggacaaagatttcacttttactatttctctgtcaactctttgacattgtttttaggatctccctcttggagctcttcccaccagtcctaccctagtgtcagacttagactctaggagccctaccctcattcgaggcgttattctttaattgcacaggagggaaattcaaacacaaaaccaatgggtaggacctatagcaaagagattttattctaatagcttaaaaacaaaaacttaacattcaggtccaagaaagaatgagatgttcttggagagcctggacatttgcttgccagaaatgttgcaaagcgcattcaagctcagatggatgactggattagatgacttctgatctttaattcaacatattatatcagttgagacagttcagtattcctgtcaggggagaatggctgtaattttacatactttcttttgattcttcagtttctgtaaatatcaactgaaaacatttattgaatcagagtttttatagccttctctgctttaagaggaatatgtggacatatttctttagaaatccaatttttaccaacagccaaggcacaggccataatcagtttaaccattctctattgtcctctcagcctcatttattgatacaaagtattcctttggactaacaaaatatttcttgatgttgttattattgtacagttttctttacagtcaatcagtagactggacacattttgttacatgcctggcatttggcaaaatctaaattgctacataaacggaaggtgaccttgaacacagacgcgttgtaaactgcttcttccattaagaagtattctgtgccaggttcctctggatggggtgaagctggaccaaagtctttcacttaatttttcaaaaatggaaagaaaatcattggtccatccttaggaagcagagatactaaactcttggcaaacttgattagaaattcattcaggacaaggttcagggctgtgcatacatgcttaaaacctacatggtgcttctagcttcctgcacattataggaatttaagacatgcttgttcaatgggttttctttacaaacttggtatttatcctattttccccattcctttcctttatgctcctatgtctcatcaaggaaaaaacagactagacaagagtcttagtgttcagctctacgctatggtacgttgattctaaagcaaggttttaattttgtttggttacgtttttcttccccccgatgtaaaaatattttatacttatggccatgtatggtgaaaacataaaacagtcctgcatttttagctaaatcaatagtagagtacatataatcttgcatgtttttactaggattttggggtactcattgtgtaattctttaaccagagacattccagaattaccagagcgagaagagggagagggtgaagaaagcgaacttcaaaacacagcatatagcaattggaatcagcccaggcggtaaggactatttctgtcttctgtccacccaatggatatatagtgtttaaagataagcaggtgtggtttcaagtactggattacaacttgcttcttgttatatcgggtgagttgtttaatacttctaacccatcattttttaatgtatacagtggagagaataatgtgtatcacacagggttaaaactaacatatatggagatatctggcacatagtagggactaaattaaagaaaattattcataggtagttggaatggataatacgttctgtagagttttatcttaggtataccaaaaagtattcatttaaattttacctagcatttgtagaaactagataggcaaacatatatattcagaacgtgtgtgtgtgtgtgtgtgtttgtgtgtaaaagtaccctcatagccttgttaccacaggctgagtttatcctaagtcataatctgtctagcaccagtttcatgtataatagataagatgacatcctcaaatatacttagatgtatcacgtgcatcactaaaacatactgatgtgtttatgctgagtaaaatcaactttagtttaataggaatttactgagtcctgattatggacctagacttaaagccaatgattttgtgaataacaaggaaataaatagaagatgcaaatcctgcctcaaggaacctctaatgtacttggctgggcaagatgtagagacacatgaaacaatttaagaacacaaggtatttcaccttaagagtaaaacataggtaatcagtggacatccaccccaaacagacctaaaggtcaccatcacaatgtgatgctttgtgttcagtaaacattaatatttgttacatagtgaataaataaaatgctcaagagaagaatttgtaatattcgtaaatgccagtgcaatttaatgacgtcccctgcccaccagtgataacctgcagccatcacatttaaatatttttaaaatataaaaaacactattttatgttgctttcaaagaagcagcatgtatttccagccatctaacatgaatttcttatttgaatttcatcaaaagtcacttaactcacttaaaaaatcccaagctctctatagtgctgcctacattgagaacagggtataagtgctagatctgtggcagaaaatatattctgaggtgttaagtgtcttatttatttgtggatagaggtagaaataagttaaatgaaactgttttgtagcaggtagtcatagtgataaacttgaattttttaggaggacagtaatcacaggaaaaaaagataggttggtcagttttagtaacaatattatgagaggaaaagtagattttagaaggtgatatagtttggctctgtgtccccacccaaatctcatcttgtagctcccataattcccacatgttgtggaaggggccctgtgggagattgaatatgggggcaggtctttcccatgctgttctcctgatagtaaatgggcctcaggagacctgatggttttaaaaacgggagttgccctgcacaagctcttttatttgcctgctgccatccacataagatgtgacttgctcctccttgcctctgtcatgattgtgaggcttccccagccatgtggaactgtaagtacaataaacctccttcttttgtaaattgcccagtctcaggtatttctttatcagcagcatgaaaaaggattaatacagaaggcagtatgcaaaatggttggtgtcagtaagagccatgttaggattttggctctgatactttctaagacaagtttcttaatctctgctaggtctctgctactttatctgtaaaatgaggttaataatagaatcttttgaatttgggggaaaattcagtgtcatctaaaatccttagcagagtgcctggcacatagtgagtcagtggttggctttgtctatattgataaaatatttgtcactggtacctaagcaaagagaaagcctttgacacagaaatcatgaaattttcttatgagaaagaagaacataacttctggactggaaaatttttatgcttttaaccttcatgcaatcctaagatagctctaaaggtgctaacaaccttacgtgaagaatacctccaaagattccataaatccttctaagaaggtactctgtactcactagtgtagtggttctcctagattcactaagctacttctaggggaagttcatagaacatgagaagaaagcttaatggagtaaccagagcttttaataaattaggagttagtgttgtgaacatggttcatagcattgaaaacatgatgggacagtcattcatgaaatcaacaaaaatgtactttgtatgaaaatagagaatttttagcaaaatataaattttaagattataaaatgggctgtattttattttgcatgtgattttcattttacacaattgatatactactacatgtattattttccattttgcttaatttttctctcaattcttgacgttttgtaaatctatcaagcttgatacttaaagatctaattcattcaatttagttgttgtgttgcatttcaatatgtgaatataccatagtttattcattgtcagattcatattagatagttaatagttatttgctattataataattctgttcagtaaatatatttatttctttatacttacacatgaaaatttatctagggaatatatccagaagtggaattggaattgctggcctgtaagtttatatgcattttttactttcagttgtcaaattgctttttaaggttgctataccaattattattattatttttctgagacagagtctcactctgttgccaggctggaatgcagtggcacgatcctggctcactgcaacctctgcctcccaggttagagcgaattctcctgcctcagcctcctaagtaggtgggactacaggtgcgcaccaccatgcccagctaatttttgtatttttagtaaagatggggtttcaccgtgttggccaggatggtctcgatttcttgacctcatgatccacctgccttggcttcccaaagtgctgggattacaggcatgagctaccacacctggctgctataccaatttttatttctatttccaatatatgaatgttcccttttccccacattcttgttaccacatcatatgatcattttttaaaaagttttttgtcaatctaatgggtggaaaatggtactctttctcaataaacaaggtgtggtaggtataacaggattgatcagatagggtgaacatttgctcatttgttgtatggattgagtttcagtttcatatcttgctttcattactgcagtaatcatcaccttcatcaccaccacaaccaccaccatcataactagtaataaaagatttatcaattgcttattatgtgccaaagcttttgttttggaccctacatgtattaattaatcctcacagaaactctgtgtagagactcttgttggctgtatttcacagctgaggaaagtaagacagagactaaataaatgccctgtgtcacataatcattaagtagcaaaagagcaggactggaacccagagactcagttcacagctcaggcagtctggcctcagagctgtgttttacctgtgtcttcctgaatttcattctttttaaacctatgtataaaactcaaataggctgccttttttttccctacataacgatctctgaaatgaacatattctgtagtttcttttctaggcctcctttttctttcactgtgtttctattgtctgttcagtgaataaatgagtctggtttctcattactgtgtcattttggcagttctgtctttgattaccttcttcattgttttaaggatttacaacctttacttccagggagggtattttgctatctgtgccaaaccctatgagagcaaaggtgctattatccaaaggttacttaacctctctgtgtctcttctcttctttgtaaaatggggccagtaagaatgtctaccttataggtatgatgtgaaaattaaatgaaagtatatgtaacttactcagagaataatactgaggacatggtacaacccttaataaacatttgctgttacttatgttttctgtattactcaagaagtcataagaatcactttctaatttgcaccaaacataaagagcccttggagacattttctttccttctttcttttttattttattttattttttattcttaagaaaagagttaaggagtcctacctatgtattctgggttgttaaatatttacacttgtggctgaacttactatatgtaaaatgtactatatgtacaatggctaaacttactaactcatttgccactttgccttaggaactgctttaagaaaacagggaagggacagttgtggtggctcatgcctataatctcagcacttagggaggctgagatgggaagattacttgagcttaggagttcctgagcccaggacattgaggttgaaagtcaaggctgcagtggactatgatcatgccactgcactccagactgggctgcagaatgagaccctgtctcaaaacaaaaacaaaaacaaacaaaaatagggaaggatggtggatgttggttcttttctgtcacagaatttctggagtaagagaaaacaatgaatgggattttaactattttattcacaaaaattttataagatcaaggatcatggtaaggtcgttttaaactaaacaggtagagtttctagagttatagatttgcagtcaagaaaaagagttactggccaaaggaagatgtgcctcagtgtctgctttcatttcagctggttcccatcctttcctctttgtggtgctctttcattcccagcctcttcttacctcaatcattttgcaggattccttacttcaacctttcctcttctctaggaactccttaaatgtcagtgttgaagacatgtttgacaatgctgtcttatcctacttaatgtccaacattgtcttcctttgtgcagcatggagcagattgcagggtctcatcatctccttaaagttctgtttcgtcgattttcctccaacaccctgaactctgactcatctaggccaaagacctcactgcaaatcaccttactctttcttacatcctgctttttcacaagatgtatgtgctttaaatatactcatagcgcttacagctatttgcagttattacatatgaattcatgtctttattttgtgggtataggaaatgtgttcaagacagaggaattagcaagcaccgaggccccaaggcgggagcataccagatgaacttaaggaatagtaaggagatgatgtggtagctagagtggagagaggaaagtacagagcccatggcaggtatattagtccgttttcatgctgctgatatagacgtaccccgagactggggaatttacaaaagaaagaggtttaatggactcacagttccacgtgacttgggaggcctcacaatcatggtggaaggtgaaagacacatctcacatggtggcagacaagagaagagagcttgtactgggaaactcccctttataaaactatcagatctcatgagacttattcactatcatgagaaaagcacaggaaagacctgcccccatgattcaattacctcccaccgggtcccaccaacaatacgtgggaattgtgggagctacagtttaaattgagatttgggtgaggacacagccaaaccatatcagcaggggaggttagggaggtagtgagagaatcatatcctgtaggattttggcagtcactgctcttcatgtcttgactgttagtgaccaggtctgccttggcaagaatgacttctccttctacagaggtgggtttgtgacatagtgtgtgcaggagtgttctttcccttgatttggttgctaagcttagaagctgctatctgtttagcagtagctgatttttttgattacttaatatatgtaatactaagatcctgtaaaatcatccttttacactggtatgtgccacagcctggagtatgagtccagttttacttataacaaatcattttcagaaatacattaatatcagattctataagacacataattgagaaggtattttaaactatctttgttttactactagtaaaaccttaataaattgagcaaagtaatatttgtaaaaattaacatatatgacattttattccattgtgttaaaatatttttattattattttaagccatcctaaccatttgtaagtgtacagttcagtggcataagtacattcacattgctctacagtcaccaccaccgtctagctacagaacttttttcatcttgcaaaactgtaattccatacccattaagcaataactcccctttcttgtctcttcccatcccaggcaaccaccattctactttctgtctctatgaatttggtacctctaggtactttatatgagtgaaattaaatgacatttgtcctttattttacttagatgacttaacttcacttagcataatgtcttcaaggtttattcatattatggtatgtttcagaatttcatttttaaaggatgaataatattgaatgtatatagtattttatctactcatttcttgatagataattggtttgcttctacctcttgactattgtgaacatgggtgtataaatatttctttgagatcctgctttgaattattttgggtataatacccacaagtggaattgctgaatcatatgataattctatttttaattttttgaggaacctatatactcttttccatagcagctacacgattttacatttctaccaacagtacacaagggtttcacacgctctgcattcttgttaatttgtgtgtgtgtgtgtgtgtgtttttagtaggtagtagccatcctgttggatgtgagatggtatcttactgtgcttttgatttgtatttccataatatttagtgatgttaaacatcttttcatgtgcttattggtcatttatgtatcttcaagacacttgcccatgttttataccacttgtttttttgttgttgttgagttttagaagttccctttgtattcagcttatgaatctcttatcagatatgttattagcagatacttttttcctttccgttggttgcctttttactctattgagagtatcatttgatgaacagaagtttttaattttgataaagtacattttatctattttttcttttgttctctgtgcctttggtgttatatataagaaatcattgccaaattcagcatcatgaagctttacccttatgatttttcctaagagttgaaaattttatttattttttagggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtaccctctagtgagctttctgtgctaaaatttgtttgttttgttttatttatttattttttaattttactattattatactttaagttttagggtacatgtgctaaaatttttcacctgctccaccctttgtaccgagggaattgtcatcttcatactagttactcaacccagcattcgagtaaaatgtgtgtgtggataaattatttctttcttatttgtttattttcatacgtaattttctcttatgtatataatgacagattatatgttttgatatagagactgatgtttggagataaagccaaccatttaaaaaaaaatggctccaaggtaaaataattatgttctgtttgaaagaacaaagcacaattctcagggaaaaattttgaattaagattacattagacatacaatatatgtatatgtacacacaaaaatgtagatataattaagttaatgagattttatttcaataagtactttattatcatttcattgcagataaactttgttggatgagttttttttttccaagtgagtcttttttagtaaaatatttaatgctgacacctcagttacctttcatgtaaatccttctcagtcgaagccaggatctcgctccttttcagtgctgtgttcattcatcaatgaaggctctgtatgtgtgcctgtgtgcatgtgtgtgcacatgtatgtgcattttgttatgtgttagaagcatgtcaagttgtgtgtaatctcttaattcaaagcaaagttcaatattttaaatagactctcctctcataagtcactcactcatttactcaacaaatattcctggaacagctgttgcattccaggtgctataacaggctctgggcatcccacagtaaacaaggcactgtgcctgcctgccaagtgggacagacttgacaagtaatcaagtcacttcagaacagtgtgataaattatttcattgggataagcataattttatttagaaggatagagaaaggagtacctgacctagattttctgagttttcaggatttacagagtagactaaaagagacaacttgcaaataaagacaattttattaccactgtaatgaccattatatttactttatacaagtgactctcattttctaaacccatataacttacacactggaagactttgtttagaagaagattataacatatcaaccatgactttaaatgcacgttttgatgactgattgattccttcattgactggctgtctttgagagccttagacggaagaagattgggacctgagcgaaaacagggaccatgtccttttttttttgatgaccgtttataaggaagagtgataggctttttctctctcctgcattctttcattagatgataccttagaccccttttaacgaactcttttatttaggacactacctaaaatttcaaattttggattgtcactaagaagtttattttatgcatacctcactattaaatacctttgacctaaatagcaaaagagatttttttttttttgtagacaagaatggtcataatttgctctcaaatgttgtttaaatatatttaaaaagttaaagttcacctttgaaatggaaaagaaagaacttttttgtgcgttttaaaatactgtatgcaatttagcaatgatttgtgccatattgcaagggcttttctagtatgtaggaagcctcagtcctctgtaatcctgaggattctaaagcgtgtctctgctaagagtttctcaaaatgtatatagactaggtgagtgcagatctgcaaatttggaatactttggtcttgagcaaagataattaacatccttttaaatttttccacgaatggaatatatagtagacatatggtagatgtgaatactgacttttgttctacaaaaaagttagaagctattttaatatgcactgaaaaaaatattgtcatctaagtatcaacctgagggaggtttttatctaaatctatataattcttttaaagataataatgttctatgcaaagatctaataatgttcttttctagagttgtgtccactctgggtttactcttttgttgtatatatcataacatggtaattggaaatgataaaatgatactaacatcctatagttttctgacagaattagcatttggccttttaaactattttccttcttattcataaagtgtgtaagctgagttgatcaatactcaggcaaaccatgatcaataaaatttacaaaataactttcattgtcaaactatataagaattactaacaaataaacacaatttcttagcttccagctcctgtcatatctactgcaaggattcttttgcaaaactaaccttaccattatctgatttttctggatatcagaattttgttttgaacttcaagcttccctgtacagagaaaattatacaaggcatcaccccttacttcccaaaccaccctatagtcaattagaagaaaattagtacagtgactttcatgatgaagacagtgctgctagatagttccctcatataattttgttaatgatactgatttttttaatttaaaggagcagctgagcaatgtaaggagtgcagaagcagagccttcatttcaattgattatgtcttgaactgattattggagacagagatatgtgtccaaagcaagggaccacaagtctgctggacagacagaaagttctgcagcttcacatgtagtctcaattatttttgatattaaaacagattttctaggagtctaaccaagtatccctaaaactccatatccacacatttttttgttgttctatagattcttgaaatgttaagctgaggccttccattgcaggtggatggaatggacctcagagatgcaagccatgaacaagctgtggaagccattcggaaagcaggcaaccctgtagtctttatggtacagagcattataaacagaccaagggtaagcgaacacaaagggcaaggtaggcatatccaaacagtgttcaacttggaatctaatgtatcaagggccaagttgtctgtatgagtaaagatagtgatttttcaaatctcaggagacttgttagaagtttgttttgctttctcagaaattgagttatcctggaaatcccttccaccatgtttaataaagacttttgaggtctgttgaatatacacagaagtagatttatcagtatctctaggtatctagatggttaattattagtattcattttaatcacaaaatacacaagttattaaaaggaatgtggcatcataattcaggttaatcatctgtgatctctagtggagccccttagaaaccaaagaaatgacattttcttgaaatttattctctagacagaatctcctacttatgcaatcccataatcatctgtgaatgatcgttcatgtatttgtgtatcccactgaacgttaaatttgctcagggcagatttggtttgtttacaagtgatttcatcattgctgtactctagccacatcactgtatagctcttcatcactgtatagctgttggtggacagaaacctaccaacccgttttgccatcagtcaccacaggtaaaatagcattaaaaaacattttagaaaatgtaagttacatttaatgaatgttgttaacaaagatacagagcgaggctttggatttgttatgacttgatgctgaagatgaaaattatgccaagagtttaaaactgttttttcaactccttctttatgcctcatgaaaaaaaaaattcacatgcagcagttattaagtattttggattcacatacccctttgaaagttctttagaaacatacacatccattcaaaaattgcataccatttcctagatgtcctgaagcacttacagactccttttttggatttaagttaacaacccccatcatagtgattctctttgaatttcctgcttactagtttttagggttggttgtctttaaaacaaaaatatcaacatatgtgagggaagttgaacgcatcgtctaaaacttaaaatatttaattttatctgcaaaatatatttaattttaacttgtaaagttaagaatttaagatataagggctcagtttaacttgtgaaattaagaatttaagatgttaaggttcaaatgatgaaaataaccaacagctctttagatgagctctgtcaaagtaacttatcaatattctatgccatggactgtaaagtgaccagatttattttaatggcccttccttctgttgtgaagacaggtgtaactgtggtctgggtttactgtaaagagtgaatctagtagtttttaatgtaagcacttcaacatctgcaatttttaatcattcagttgtttattgttaggtaataattatccattcagaaagaaaatttgccaaatggtagggctgcatcatgctgcattctttacaaagctattccatttgtttaaataactataaatccttttacatttattcccatttgtgtgttaaacatagacacagcataataatgttaaatgggtgtttaagttaaagctattttttttgtgtgtgggtggattttagtcctttttttgttttatttataatttacaatttttacatcatttgggacaatactataaattgctgaatagtgattctcaatattgctttaaaaacttaaaactacaaatattcctttcaatgtcaggcacattttccaatgagccgggaagatcttgtctcatacacctggaaaatactcttattttgctctctgaggtataatgatacctgattttatagcaattgttccaggataaatcttgttatgaatgacatgtttagtcaagtcatacttattttgctttagaaaattaaagttaattttgcatttaaaatgagatatgttttgtttcaatgatttacttccttatggaaataattaggtctccagtaatctaaaaggaacaatcacaaatgcacatacttaaaagtctcttactggtaattgtgttatctgtagatataggataaagctcctaggaaatcttaaacataagctgaaaaaccagtgagttgctttggcccttaggctcttcaagaatcagaaatttccagaactagccctggtaatttcaccagtatgacccttcacagaattcagtctgaccacattttctcactgaaaggggggccccatttagaatgggccagagaatgtttttgtcttccctgtgcttcttcgttgttaatatttctgcttttctcagcccctgggactataaacagaagtttcatcattggttttttaataagaaatagtctgtttctaaatatcttttcctaataatagagtaatctaccatttcgtctgctgtgcctatgctatacttttacactttgctatcagggccaaattctaatcctctgagatctgcaaattaaaaagaaagcaaaagtaataaaaatttaaaaactagagctttctttaaatttgttgctagttttgttttctgatgttctacagaattatacaggacactgaaagtccaatgtatggagattagaaataatctccaccttccatagcattgaattattttgcctaggatatatttgtcacctctgcctagtcatttcttccacgttaataaatggtcatgtgccttggtatttgtgatcttctcttttgtaaagcaggagttgacattttaaactgaaaagcagggagaaagttgagatgagcagaaatgtcattgtgcccatttctttttcctgtcttccctctgtaggaaaaacattgcaagaagagcagattgaaagggtaatgtggcataagctttagtgcaggcatactgaggatagagtctttccagagtgttctctcatacagcgtggtgtcacatgacaacctctccctatacttgatgcctgccagtggggcttttttatagagaaaagtaacacaaacatttaattggagccaaaatgaattttaaatgtctgcaatttcccctgaaagatatagtcaataaaagaaaaagatagcgggtgtgaaaagaaggagaagaatttattgtgctaaggaaattacttttttttttaaactatgaaaatgctaaattctatctggcagtcatcctgactttaatatgtattttcaactctaacagtctggctcagggcttattactggcaagccacaaaacctctgagaaacactctaaggcaggacttcaaatattatctaaagcctcataaattctccagtaatatgggcaattttataggaaatttatttaaaacatgaatctccatgtttctacctccacaaaaactgggcagaaatagagaacaccactctacaggagttcattttttaataaattactgtttttttaatttaaaaaatacaattgctctgaagcactttaatatccagtcaaaatatggaaagtttccttactaggatgcaaaataaaagaataatgaaggttgccagtgaactagcagaccaatttataatttgcattctagacagattatttaaaaaaaattagcttttagatgtagataaaaaattttgtggttttaattttgaacatgtttactggtattcataaaacatgtattaatatataagatgggcaaaatatatgtgcctctgttagtaataccgaagacattgagcaaaaataaaagaaatttgggatcagtttgacaactagtttcctttgtggtttgtggcctgatttagactcaggtatagattcaggtcattagagacaaatctttagttccagactgttttaagatgttgctattaatgactggatctgataggatctagtttcacacaggcagttctttaaatcggtatgtactttgcttttaaaactgagttgttttcaatacatttcctttgcgttcagcgcctcttatgtttccttttagaaatcccctttgccttccttgctgcacaacctttaccctaagtacaacttcagcagcactaacccatttgctgactctctacaaatcaacgccgacaaggttggataatgcccattgtcttgctgttggttgccttttgcaaatgttttgttctttgttactactgtgtctttgtcccagttcactatttgctacatttgggcagggaaaaaaaaacaaaaaaacaaagctgtttggagtgggcatgcagatcctttcttaagcacattttcctgccagagaatatttatttttattgctgaaattaaatggcccttctgaagagtaagggagaatcatgagtccagtgcctttctttcattttggtgtcatttaaaatttctgatatttaaatttttgttagttgccaaatgtatgatactttcacacataatttctttaaaaccatgtgttgatttaaatccttttcatacttctacaaggtgatcataaaagctcttccatgagttaatcactgcacaaataattgtgtatgtgtacatgcaggagtctgttgaatattcatgaagcatgcccatgtaattgcctgaatcaggaaacgtaactgtttcaatgctcgtaaatctatacttggatcttctcattttctgatgaaattataaaaccaaaatcgaaacacaaatttataagaatttatataccataatttgatcatgaaaaggaagaaagccatcaacaatttttttcaggaaacactttatgaatattcatcagacttccatgttattgtaacaaataccatgttattgatatggataaccaaagatgctatatctgaaggaatatgttttctattgctataggaattactgaattcaagtagaattatcttccattgttccccaactaacccttttgctcccacaccctttaaggtttgtgtcagtgtggaattttcgtatgtgggtgtgttacagtgtgctttatgtgtgtgctgtacttgatgtatacatacatggcatggagtgatctcaagtatacactgcatttttgacaaggaaggctaaacaatctttgttaaagagctatattttcataaataaattttaaaaagtgtcactaacgaggcagatacatgatcttgatgagaatgagggtgtcagggatatgaaaacataacacctgattgcccctcaagtaaatagaggcttatattggttttattagtcaggtaggttagggcaccattttgatttactcacagtatgaaaatgttgtgcctgagatcccagacaatttttcagataagcaggttttgtttgtttgtttgtttgttcttaaaataacagctcagaaaaattatgcagcaagatgtataaaatgtcatctatagatttgttaaaattatgagaagtttaaattagcttttgttttaccttttaaaaagggaatggacttaatcaatgcttgataaaattttacagagaagtaaattttttttagccagaaaaattctaaagtacataccttgctcctctttactatgataatgaaacttgattggaccaaatgagggttttatgtgtgtgtgtttgttcatttttattggtatattattaatttgagacatttatggcacagcatttgggaacataacaagggttccatttacattagtaacttttatctgtttgtccaatgacatatagactgaacatttcaatatagcagattctgtaatctgacacttacgcccttaaatctctatcagtcagcgatttgctttgccagaaaattgagtgctttctgaatcaacaaagaaaggtcgcattcagtctcaaatagttctagtgttacatatatttttaggtatcctaattcgtggcaccaattaataatttctaagtatttgtgcgtgtttatcatttaatgtatccttacaagaagtcagttttttaaaaaaaatcataatatttttctagatataaacatatataataaaacattgtatcagaggaattcttatgcagtaaaaaagtaaaataaagatatataggaaaactataggttcaaggtatcagggacaacttcataccgaggttagaactttagctggatgttcctgacctttgagtttggtactgtcttatttatgcaagttggaggagacaacatgatataatggaaagtgcactggattaagagttaagcaaaaagaagtctagtaccactgtttgattcgaaacaaaaactttcatttcttgtagcctcaggttccaaaggtttattcatctgcaaagtgaataaaatgaactcagcaacttaaagacctttcaaactctaacattgtttgatcatctgtaacattaggttagtgcaaaagtaattggagttttaatggcaaaaactgcaattatttttgcaatataagaacttgatgatgccaagtacttttttttttttttttcgaaataggacctatgaccctaagtgacagccagtatgccatgctttggctttctattaaggagtctcctgtgtttcctcatttatcttgtgatctgccttggcaagggaaagctggtgttgtccttaaaaccatgccgctcacatccgagtgtgtgctctgtgctaacaaactggctctctggtagacaagcctgcatgtgtgatacttgctgtcctggatttgttaagagaatcatatggagagaggattcaggtagcaataaataattatttatatttagtctcactaataagctttgaagggcaacttctttgttaatttttttttctgcagtttcttggcagatttttctagatgcctcaaatcttacccagacccaaaagttataacttttgaatgacatttttttctagaagggaaagtttgtacaattttctaccaagtcatttaagacttcaaattcattaattcattggcttaaaatagcaaataaaagtttagtgaattattctctgatactacttggtttgatatatttaaactttacctgaatcccatctaatatttcatatctatctatctatctatatatatacatagatatatatggaaataagaatatcatgtcaaaaacaaagactggctttaaaatatcaaacaaataatggaaagctcatatatatacatatatatatatatatgtatatatataaaatatttaacaatctgagccttccattatttgttaggtattatatatatatatgagctttccattatttgttagatattttatatatatattatatacatatatgagctttccattatttgttagatattttaaagccagtctttgtttttgacagtatactcttatttcttcttcttgaagttttcttccttagactgtacaaacccactgcattctttttgttcccacaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggagtaagttgtgtttttgtgatgcatttaattgtaagaggtattaaaatagctctgagtttctcaaggatttcgccctggataagtaagtatgttgcagctttgtgatatatactgcaattctgtgtggaaagaaatagtgtttgttttgcttgaatacagcatacattcctgaggcatgaaatcatgctcttcctttcctttaaaagtgctgttaaagctcactctgccttttgtatgagaattaataaggacagggcactctctcagaagctagtattggatcagccactctgtgtctcaaacaagtcaccacccctttctgggcatcagattcctcatgtgaatgaggatattctggttgttgatatcacaccttgaacttctggtgtattttctataccagaatggtgacatagtataattgtggagataaaaactttaggcattgactaagctgtttaactgtctctaagctttagcctagtggttatctctctttttaaaatggagttctcccctcaggttgctaacattcaattagatagtgccaagagtgctaagcacagtgcctggcgcccagcagtctttcataggcagctgttattaggaccaatagggagtctctcttttctaaggaaataccattttgcaggaaaatatttaaaatttagcccaaagttatcaatgtcattgttttaaaaagttttattttaaaaatcgaattatttcctttaagaaagctgtagtacatctttttaggaagtacagaacataaaagttgtgctgctgtattgtggaaggagtcaggaaatagtttatgaaattgatgcagttaagaatcaatgtagaatgcatggcattggcccattagccatataataacgttttctaagatgactggtaaagtttgtagttttcgcagtctgttctcagtgacactagagcatattgctaacaatcaatgtggtcagaatgtaatcttgaggaaaacgtgaactgaaatgtttcagttttctattatgaagccaccccaaaatgtaatggcataaaacaataatttattattaatctatcaaagggcagtgggtgactgggcccagctgggctggacttccaagacagctcatttacatggttgtcaagtagtgctggctgttggctggtcgctcatctgtggctgtgcactggagcacctgcgtgaggcgtcagccctcttagattaaagagggtgcacaataaccatcacctcttgaagatgtggggtaggagatgtaaatggtctcatctcattaggacgtgtgtcccaaaactgggttacatatatcaagttgtcctggcctaatagctctgtgcaataagaaagctcattctcttcattttgcatatatctatcaagcaactgcccaacatgatgtgatacacaatgttgaaattcctatgggagaaaagctcccactgatcagtgaacacagatattctggatgccttagttctgttctcctctgcaaatgatcaagtttctggtttaatcatagtcttttgagagtttgtaaaatgaattacttctctttggtgtaaccactccaaggtgaactgattaatcagacattgtgctctctgcaccctagatgcaaagaaattcctcaaagtttgggtcctccaggaaaccagtcctgatgcccaagtgcctagtctatttagcttttaactgtcaaagcgtacattttggtataaaatctgtccttttgaggtaaaactaaatagctttccacagtaaagcatttgactgtaaattaactgtaaatatgtatttgttgttgttgttgtatgtagaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagaggtaagtttttgtggaaaattttgaatttattcttgttttataagggtaatggaactgtcagtttccagaaaatcacccataccttatagtgactgagaaagccattgcttgcttaataaaatagatgcattgcagcaaatctggctctaaaccaaatttctaccaagtagagtccatgttcccattaacttccattaaaaggtcatgactgtgtagcaccagaaacaatttttgccccaagatagtaataaagcttacacttcaaaagcatttgttttgtgtgctgcatttttattaggagtttttgaaaagccaagtgaccagtcattccccagaggctgacccactggacattctggaacttgaatcactaatgggagaagtgatgagggtgaggtggggtggggtcaaggttaaggctaaagaacaagcagtaactcagcctgccgaacaaaataaatttgtggaccatactttatagggtttagaattttatttgcttgtgttgtttgtccttgcccctcctgggctgggatccacatgattttatactgcctttatactcttctcatgctgagtatgtttccctatagacacaggaggctcagtcaggcagtggctaaatgaccaaatgactgagccagtcatttgcgttaggcactgtgctgtttaggcacagtttgctgcctaaatcctgaatctacctagcatttcttctcccagtgacctatttccagggcttgagttttgagactaagtgggaaatatgacagtaaggaacttcccaggatggtcttgcaggtcgcaagtttttccacagagccctcgttttgtgcagagcatgctgggagcccagtgcctgccaggaaatttgttgtctactctcctgcagttggtccaagtggtgcctctttatcagcagttcatggatgtcagacttcatttgcattattttaatgctggctttaaacatgagctattctttattcaccatgaaaagtcagtttcatgttttggggaggaaaatatataacatttaatataaaatatattttaaaggaagaaaaaatgtgcttttcattaatgaggaaggatgataaaactttatgatactaagatttcaggcccaactaatgatatttatttctcacagatcaatggtcagattttatatggaagaagtcatcagaatgcctcatcaatcattaaatgtgccccttctaaagtgaaaataatttttatcaggtgatcattttcttttgctagtttaccaaatactttttgttagcatttcttctctgagttcttttgaatgaaaagaaaacatttgtagccgggcatgctggctcatgcctgtaatcccagcactttgggaggctgaggcgggcggatcatgaggtcaggagatcgggaccatcctggcttacatggtgaaatcccgtctctactaaaaaaaaattagccgggcgtggtggcacgcacctgtagtcccagctactagggaggctgaagcaggagaatcacttgaacctgggaggcggaggttgcagtgagctgagactgtgccactacactccagctcgggcaacagaaagagactctgtctcaaaaaaaaaaaaaaaaaaaaaaaagaaaacgtttgtaaatttgtaagtgtcacagttccaggttttgggggttaaataattttctctaataaccttctgactcttgaagtaagagaatgaaaataataccatgatgttataataggttgttgtttttttgcttttagaaataaagatgcagtgaatcagatggccgtatgtcctggaaatgcagtagaacctttgccttctaactcagaaaatcttcaaaataaggaggtatatgtaacttatgtttgtttctctgggaagacttgattgatgtgagccttattaattcaatcaacaattacataacacttagagagggatattagaggtagataagttatagccttggccttcaaggagtgtacatcctagtataagaagacactcatggaaataagcataccacttatgtgaagagtacttgtagtctgcctagggaatagtgagggtaggaaaagagttatcagttctgcctctgaaaagaaattgaggataaaactttatatggaaggttacatatgaagtgtatgttggaagatttggggggcaaaaatgttgcaagcggagggcatggagtgaggaatggcatggagactttggccaatgcaggaagctaaattgtagagcatcactgagcaatgaggggcagggaatggaagctggtggggaaagggtcaatgttaaaggggacagggtcagatcatgggatacattgataggccaacatgtgccagctttgtctttgaggcagtgtggagctcaaagaatgagaaatgtttagttaaaaatttctctggcagtactgtagagaaaaatcagaggtagcaggggagagaggttagaggaagtaagataattattggaataattcaggaaacagttaacaaggacctgaactaaagctggaagagggaatggttacatcagatgtttaagacccaaattgataatacttcatccccaactaaatgtactcactgaggaaaaatgagtggttgaagatgtgtttatccaacaaatattttctgagtactctgccttataccagatactgctctttggactggagaataaaacaggtaggatatacaaggttttcagatatctgacttagtgacatgagggatggctgtcttttactgaatagaaaatacagaaagatatttgcaaaaatatggtacattctatttggggcaggttaagaacgaagtgcctgttggatagcctggtaaaaatgtacattgggacatttggtctccagtttagagatgatttcctgtatatgcagatttggcatttcttagccatggaggctgaggtgcttgctacagagagcatttagagagaaagagggccaagggcagaatcatgtggtagcaacagtaaggaggaaggctaaccaagagatcagagactatgaagaaccaggagggcatgtggcagagcagcggagaagagtgtccttcaagggtacactccacagctctacatgctgccatgtagcaagaatccagtgagaagatgagtagaaagagtcccttgggtgtggtaactaggagactgttagtggtttttgagaaagcaaatgatggacaagaagtcaaggagagagagaggcagtggctagagggtgacagagaattgggagagtggttttgttttgatttaggaaagctttggatacatgtgtatgatgaataaaaggagttagtagagaatgaaaagcttaaaattagaggaactttggtgattatcagtgggggtacctgtaggaagagaaacattctttcctaaatgaatatataaacatagagcttatgtatacataagatagatgtacaaatcattgtctcattccggctgctcctaacgttccactaagccacgtggttatttaagataattaggttataaggtaatatattttcttttcatattagttgtactaaatatgtctcttaaggaaatggagtattttaataacgttcattaaagttttcaattcacttgataaataacacagtaaagaataatgaatggtgtttctgctgatgctctgtcactgagtttcaccatttgttagctgggctaccatcggttttcattatacagtaaacccaggcagtcttcaagccacttggtctatctgtgctctcaactgattgctgtccagttacacctcgtaagtattttgaagagaatgtaatgttcataaattccatagaatgttaaaatagcaaaaatgtattataataaataaatgtattaaaatagcaatagtgtattaaaataaataaatgtaaaataattttatataatgtataaaataattttgaataagtggcctttatatttaaacaaatcaaatttcctaacactcagttgctctttttgtcatttctttccctctgtcagacagagccaactgttactacttctgatgcagctgtggacctcagttcatttaaaaatgtgcaacatctggagcttcccaaggtaaatctgctttgaattggaatgaaatgatgtgagttcctttacctcagtgttctaattcactgtgttctcaaaagtgtggtctccagattaacagcatcagcatcatctgaggttttgttagaactgcaaatacttgggcccactcaaacttatctgcttaatgagaaactctagggttgggccgagaagtttgtgttttattagacccgcctgatgcacgtttacgtttgaaaatgactgtgctgatactttatcaggggtccagcttgcccttttataattattccaagttatgaaatttagttatctgtccattgattccttcactaaggtcctgctacggaggaaataaaaataaagaaacagaagttatagtcttgtcctttaaaaataagaaagctcatatatttagaagtgaactttcggctccgatgattgccttaaaaaggcaatcttactatacatataagagaagtctttatcatggactattattgttgtggttaaaaagaaaagaagttattaaagtctttttacctttctatcaagaagtccatacacttcagtttgagaatccctcattctattgccatttaagagagatgacatcttcctctttccctttctgatttctgctcttagtttcttttcctcctaaatcctgaagtaagagtttataatatttaatgatgcagtcatttccctataatttgttaattatgaaacatttaaatgtatgttgaatactttataatgaatgatttttttaaaaaatctgtttatggtgatctttagaaaagtccaaaattagataatttttaaatatcctttcatggtattgattttaatgtatcatctaaggcttagtatattctaggatataatgactgcccaggaaatgtctgtggaatgaacatgttagatggataaagggcaacatactgtagtgattgggagcagacttaaagccagaccacatgtgtcagagacctagatttgccactcactatctatgagactgtgactttgagcatgtttcttaacgtgtacatagtttcaccttttgaaaatggacttaataattgtccaacttacctcatagacttgtagtgagaattaagtatatattgtgaaaattaaatatacatatgttcagtttccagcacctggcacacatatacaaatagtgcttgctattattattgttttaataattaggaatgaataagctggtatagagttgcctgatggctacctgtcactgattttctctgatgttttctgtttccacatctatttccacattaggctacctgattaaggtgcttgatagatgttcatagcatcttaatcccctactcagaacctcccaaggacgttcatttccaaacagatacattcaagttctttggctgggcatttagcaatgagggtggacagaagcctgtgctgtcagaagcccttctcacatcctgagtgattgcctataaatcacttaatcccattggtcctcactttcgtcttctgtaaatggtgctgcctatattaagggttattgttgggattggatgagctaatgagcaaggttccttcattctgcaatataaaagctggtttctgcctttcgcctccttttttatttattcagcagatgtctattatgtgtacttccctttctaaattagatgctattgaggaatgcaagaccttggagaacctcaatgtattgcccgctgaaagcttccatttatatgtagatttcaaacaaatctaaagctcaggtagctagaatgtatttattgatgaaagccaaagtaagtaaggggaacatacaagaatcttttaaaagtagctagacagaagaggcaattaaccatgattttaatgattttaagtgtgggctttggagtcacttaacttctctgggcaataggcaagccatttgttccatggtgagcaggtatatgcaaagcaacctccaaagactgagggagctggggtcctgaagaaagaggctgacaaatccagtttatcagaaagaaatacttaatagggacttaacgtacagaagccatgctgctggtggccacaagacagtggatcccagcatccaccctctagaaagtattctttacatagcagggataaagacatgtagctggtcacgtctcagaatttcttgctgaaacttgttatcagtggagaggttaggtaaacatctttatgaaggattatttatgctacagggctcgctacagaacaccttggtatgcaggagtcaaacattggtcaccatggcggtttcgcttcaaggtggtgtcactcctgccatacaacaggctgtttttctacaccgtttaacttgtctgggtctcactttcctcctgagatgaggaaaatccctttatattagagatactattggaaggattaaatgaaagaatttatacaaagtgcttaccacagtgtgagttattattattatttttgttaatacttctaaccatgaatttgtgagttccccatagaatatatccttgaacacatctcttgaggaagccattgttacaaatgatgttgagtgacatattacactaagcctggcactcctaaccccattattacatggctctgggagtaaaaattaagcaaagaagggagaaagaaacagcttttaacactcatgaatcagctgaaatcttttgtcatttttactatcctatatatttttaaattatagttatttgacaaagtaatttaatggtaatgtaacatttgttcattatgttatttacttcttagcaaccctgtgagcttgctattattttctccactttgaactgttcccataactccaaatagtagagctggaattgaactctggtcttctgcctccaagtcccatttcccatccattacctgtttcaacttgctactgggccccatctgcctttctgaaatgcctgtatgttccttctaggaatcctgtacttcagtcaaactgatttgaatcaagagctcatggagaaggttttgagaatttatccctctttgccttggtttatatcacttggtctttctgatttcttttaacttatataaatcctacatacactaaagatccaacttaaatctcacctctgtttattttgaaatattacttcaatattctggcttatatagtgcttactattaatgtcttcattttatttgtcacttaaccatgtttgaccctagagcttgtctcctgtgatgaactttgatgtgggtatcttttctgtacatctaaaacatacacatgctgagagaagaaattctcacttttttttccattactcagtgtcatcaacatagttcagactgtaagtatctgcgaaggaagagtgaatgaacggttatgtgccgtacatgcataaggggaaaaatgttgagatcaggagagtcaggaagagaatgatttttgcattgtctaaaagtgggagctctaataacagctcatttctagttctgttttgactccttagaaactcctgagaagtgaattatctttttttaatcttttatattttttaaaaatgggaaaatagaatataagcagaaagctctcatacatagaatctaaacccacagtagctgactgaaatgcaaattcaattgatcagaaaacatttttgattaaagatttatttttgacacagtttgccctaggaaaggacccatacatcaaagcaggtagtagccttctgtgattgtcaaagctgtgtttcatatccatacaagtttatgtggtgaaagccttgaaatatgatgaagagtttttcttcttttgaattttagagaagtttctaccttcaaaataattctccaaataatattaatttgtttagctgaattccacttttaattcttgtttactcttttctagctgtttaattatacaactcgttgttcaaaaatatatttccttggagccaggtacagtggcacatgcctgtagtcccagctatttgggaggctgaggtgggaattcaagaccagcctgggaaacatagcaagaccccatctctaaaaaaggtttaaaataatattttaaaacagaaaaaaacccacaaaaatatatttccttaatttgttttctattccctgtatggtagtgttttaataactagccccaaacaaaatatctcagatctcttcttgctaaggactatatgcactctggtaaaagtaagttggaaagttgagcagttagataaaaaattgcacattcatatgctgttatcctttcttatgtgtcatcctgtttttcttttcatttatttatttttatttatttatttatttatttatttatttttgagactgagtctcactctgttgcccaggctggaatgcagtggtgtgatcttggctcactgcatcctccacctcccgggttcaagcgattctcctgcatcagcctcccgagtagctgggattacaggtgtgcaccaccatgcccggctaacttttgtactttaattagagatggggtttcgccatgttggccaggctggtcttgaactcctgacctcaggtgatccacctgcctcagcctcccaaagtgctgggattacaggtctgagccaccacgcccagcctcatcctgcttttctgatatcaataaattgtttgttgatgtgtatatagttgtttttgtagtattctagttgagtttgggcatattatacatgcagatttgtagcttattgtttcttttaggactcctcttattgcaaataacagaaaaaaatgaactaattccatcaggtttcatcaaggaagaagatttatggactcaggtcagcaaccttcaagggtagttggtcctgtgactgaacagtgtcatcgagagcccgtttttttccctgtctgtgtgacactgtgccatccagtgtcagctttatcccaaggcttgtctttctcatggttttagaatggctgccaaccatagtttggccatgtgctacttcttttacatgtatcttgggagaagggagaggatggctgttcaagccttctgagcaaaagttccaagattcatcctaattgaatcaattcagatcatgtgtctacttttgagccagggactgtgaccatgggactgtaattgtagaattgacttcagttgttcaaaccccattcttggagctccttaacttttgctatgtaacaaattaccaccaaacttcacaacttaaacagcaggcatttatggtctcacagtttctatgggttaggaatttcagagcattttagctgggggttctgctgagaatctcttgtgcaattgccgacacattgccagctacagctacagtcatctcaagatttgactgggctggacattgcttccaagatgatttacccaaatggctgttggcaacaggccttatttcttctaaatggggctgcttgaattttcttaggacaatggcagctggcatcttgcagagcaagttatccaagagagacagcaaggaggaagtgcctttgccttttttgacctagctgtgaaattatacaccattacttctgctgtattctctttgttagaatcaagtcactaagtctagcccatgcttttaggttccttcctgaaggaagaagtatcaaagaatttctgctcatatttttaatctacagcctgaaacatagtgagggaagaagggggaagagagaatatggaggtggaggagagagaggagtgggtgggaaggctagatattctaataaaaatcaatttttatagaggggtaagatgggaagcagtattaggtaaacaatcagcaaatacccactgtaccaataaagtattttcatgactgttatgtgacaagtattattattccattttgtagataagaaaatctagatttcgtaggtaagaaaattgagaattagagatgttaagtggcatatccaaatttctatagttaggtagaaggtaaagtcagttctgctcactctaaaggtgcagcttactctggcagatagacatgactgattgcctggaaagagagaggtggtagagagatggtcagtgacagtttcaaactcatcaggcattaataatctacctcagaagagccacatgttgataatctttaaaatgatgttgaaacctaccttgatgtcacagccatgaccataaacatctctgatggcacatttaacttgtgtgtatatttcagagaaaccatgtcaagattctcttttcttttctttgctttttgtaacttttctctggagaaaaaattagaaggtggctagctctggcaatgaaaatgttaaaaactctgttttaattttattaaagtaaacattaaagaaagctaaaagccaatatttctgaacatttggttttgataaagggaaatgtggaaaatgtagcgaagtaggtgtagctccccagccttggcaggttctcagagcttgtcttgggactgagaggcattttcagtctgcagcagattgaaatgctgttgtctggagaaacaagtctgagtgttcaccccccaaaaggacagagtctgcatcagtaatggcagactgcctgctaaaggaagaagaggggcagaaaagaatgaaggggctagaccctgttgttatttccaagcgacaggccagagaagaagcgggattctttggttggttttgaatgacttattcagtcattagacaaaatttgtaaatgctgaatgttttggttgaattattgaatgtatttttgctgtctagatattttgctaaagttactaaagatgtcagacatatgggaagagtgaaaacacttgaatgtttgatggaggaaaatttattcccattaggaaaatttgaaagtttgtttaagaaaagacaagatttctaagatcttagatttaaagtctaaggtcttagatttctggacttcagaagagttttagttgtttttcttacccttggtatccatttggataaaattaatctgtttcaagtcttctgagcatttttgtttttacttttctaggatcaggggggtttgggtattgctatcagcgaagaagatacactcagtggagtcatcataaagagcttaacagagcatggggtagcagccacggtgaggtttacctttcttgctgtcattaagtagttggggagggaattacttttggaatatcactcaaattcttctacgtttccatttaggatggacgactcaaagtcggagatcagatactggctgtagatgatgaaattgttgttggttaccctattgaaaaggtaattttccaaaataaagtaaatggtaatgtaggcccatccttgggcatgattaaagtgtttgtgtctgcgatcatagagaattagggttatgtagctgtattagacatgttcttaaggaaaagaagagattgttcagaagttcttcaatttctatttcttattttccagttggtgttaaggtatttttcgttgccacacaaattattcaatattcactgggcagttttgataaatatttccattttttccttaggaaaactttaaactccttaacagtgactgttagtgccaaaatattttttaatgaatgtttgctgttataaatatccattgtgtatactactttataaacagattgtaagactcaaccattaaatacgtaatttttattagggttaaacatatcttgtacttgagttccctctcctcaaaagagatcttaatacttatttggtatctcatttgaggccttttatttattagtgccagaaaaaagctttgtttccttgaaatatggtatgctttttctttcttatagtgagagagaaccatataacttatcatttcttcattgtacagtaagaagcttaaagttactttttaaaaattcagtttttagtaagtatttaggccagatcctttaacccataaatctgtgttttaacttttcgtttaccttgacttttttgttgtatacttttcttattctgcttctaacatatgtgtttctattttattaaaactgtttgtgtaagttgcttctatagaatcaggaagtaggtaaaataacccatatatcttctaaggttgtaggcattcagaaaaacggatgagattagagatgtaaaaagttgaaagtcttatataagaaaaaaatgtggtcagagctagacttagagtagaaattaaccatggccctaatctacatcaagcatttggaaaagctagagagaaactagagccatttctttctttacccaagtcctgacaaagaaataatttgcatctgtccctccccttaaccatagagagaattagattccattgataatggtgactcattggtatgtctactaattcagctttgaattttgtttctcttccacacatacaccctgccagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaagtaaggcctctggactcatgagagtcctgcacatatggaacacctgaactcagcagagggtttctgcttgggagccagctgcctacctgtggctcactgtttggaaggttgtagtcagggagccctatggtgagggcaggatataaagagaggacttctggaaaaagagtactggactgttaggcaggcaatctatgtgctgtacattaagcagctgtggcatcttaggaaacctacccactcaaagcctcagcttcttcatctctaaaacaagggaatagtattctttgctctccaaaaatatattgctaagggcaccttgattccaggcctctaactaatgaattagaaatatcatttcgtagattctttttttaagctgggaaagtaatttaacttctctaagcctcagctttcttttctgtagaatggatatgcaattatcctatttcataggtgggatcagtactgcctgccactgtaagaaactctttagtcattgccatgatctacagatctgagttctatgctttaggtgtaatagtgggtcctgtcataatggaaatggatttaggttacgtgaaccatagggtgacactttaatgtgtcattacacttccagtctagtatatggaggtacattattcctttgagttactttttgagaaagaatacactggtgtgtaataaaacagtttcaagctctgcagcatcaaaacaaacaaaaaaaaataaggcattggctttttctgtaacggggggtggaggggagaaatttcttttggcctccaaactgttcttttaacagttttttaaggaaacactagtttaaatcatttgtaatgtagttggatgaaaaagtcttaaagtaatacatctccgaaaataatcctttatttagaaagactggataattcactgaagtgttaaaagattttatggaaattttctcatttttcaattttatgttgatccctaaatagtgttgtctataaaaatatgaaatgctagatgaaaacttaacataaaagaaaatatcttacacctgttcttaccatttaaggagcaagaaaatagtctgtttctgatttcctaaaaagagaacatcttgtctaaagcatacgctactataccaagtgtcctagctttcccaaaacatgctatttgctgtatgctctttgttgtatcgtaaaacatatgatatgaagactctgataaaataatgtgtgaaattatattccccttttctcataatctattcttatctattcatttctgaacatatatgcaccaggatttgacatctgaatgtataaaacatcaagtgagacccaaggagaaaactgcaaatggtgcatttttgctcagaattgattacataagaagagatgctctaggataagaagaaaacaaaaatgtaaaaagccccgaaaagcaggcatcagaaccaaaattattgatatgttttgtggtattccctgaatgtacttctaggtctttgccacatatctcagttatgagttctataaatcttttaattcataagaaatgtgtttgcctccattgaaatggagaatatcaaagtgaaacttgaggttcaatttaattctgttctctcttcttcatatcctctcctttatatctctaccaatttaaaacatgtaggatagcatagaaaataattaaataggtaatttttggcccactaccctaaattaacaatggtgatttaatcacatttgttttatttttaaatataagataattaaaagattgaggtaaatacaaagtctcttttcccacagtcatgggcccatttctctgccccatccctcagagtcaatctgtgtgatgagtttgatggatatgccttagtaaccaatttttatttgtatttcatttttaacttatttttagatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgagcaccacccagaggtgcttctgtacaggccgtccttcagccaggcctcagagacgattatggggagatttctatcagttctagtaaaggaaatgtgaaggccgaaaaaacctgtatttgttattttaatttatagggcaaatattcaattggatacgggggaggtttcctttgagtaagccaataaatattgactcagcaatattctgctacactggtgattttgatcttgaaatttcaaagtgtttctatcagttcaccagtccttgctacattttaatttcctttttgctgatatccaggttgggttaaacccattttaagaggagtttgagccaggtgcagtggctcatgcctgtaatcccagcactttaggaggctgaggcaggtggatcacttgaggccaggagtttgagatcagcctgttcaacatggcaaaaccctatctctactaaaaatacaaaaactagctaggcatggtagcgtctgtaatcccagctacttgggaggttgaggcaggagaatctcttgaacgtgggaggcagaggttgcagtgagctgagatcgcaccactgcactccagcctgggtgacagagtgagactacgtctcaaaaaaaaaaaaaaagagtttgaaaaattgatactttgtagacaaagtcttctagatgtcaaaaataccttaaaagtgatttcatttatggataagaaagttatctctcatctatgtatgcatgttttattttatagtttttttctttaatcttctctatcattaggaaaaaagtataagctcctttgagccttttagcaaaaattgttgttacactttcccttgaattatatggagcttgtactgtagagccagagtttataacccttattgctgtctatcaaagtataatgtgtttggactccatttctgctcaccattcctaggagaatgggataagtatgggtatgttttgtttgggcccttagggtgccattattatccatgaagtttatgaagaaggagcagcatgtaaagatggaagactctgggctggagatcagatcttagaggtatagaatgcctgtttttgaccttcaaaattaacagagaaaaggctcctggggggagtgtttctttctttgcttctttctctctcttcccttccccacctaactctcctttacttctcatgttccttacagtcagtgtcccatttctgtacaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaaggtgtgattgaggaggacaaacccaatgctcccttggaaatgatgggacttaaatcattttaaagagtaatagcagtaggtgaatcttttatcagtggctagtgttcagtaggtagctgttgttagccccctcactaaggaaccataaaaagacattggttttggacttttaaaatcagaatattggaaggttttgaaggcacttaacaaaaagtcatttggtgtatttttgagcacctgctatgtgctaggaaatacgttaagttttcagaaacaaagttaaataagacatggttcctgaactccaaaaactcatcgtctggtgaacgtcgaattaaatatattcttgcaacaaaggaatctattgatgagtgacaaagatgctttgtgggggacccatggtagcaaaggagaaagggaccaagtgaccctatttaattaaagtgaattagggaaaatttccaagaaaaaaggtgtctgagctgaggctaaaagtgataagtgagtattggtttattaaaggagagtggaagatattgtagggagaaggatcagagcgaataagagcgtgccatcaacagggcctaaagcagggggcccgggtggtaatggaatagtgaatgcgcaaaaattcacaacctaattcatttgtatatgagtacattttaaaagtatttacatgtaagtaatattaacaaactcatttataagtgatattaacaaataatccagcaagtttcataaatctttcttccttttagtattataagcccatctggatctgatctcagaatctaccagatagctaaacttgtgaagtcagcattcagtaaaaagtgcccctgcagtctgcagtgtctctaagtttattttgtcatttcttgggcctcagatagccaccatttcaaagcagcttattttttccagtgagtcagaaatctgtgaaatggtgatctttatttcagaatatccttctttggaaataggcattcttcagaattgccaaaccagcagcatagacacctggttctgcagcgacttttctgtatggaaataaaaggacatttacaccattttgtttctcagagacagctaaaggctaattatttttaaacacagaaagaatttagcatattatttgagtgtcagtgggaatatgtctaaaaaatagactttttttggaatacagtatcagtagtctagttctcatgaaatatgacatgggtaacatggctactataggatgtggggtcaccaggtcatcataaaaaccaccattaatgaaccctaaactctgtgccttgggaagaccatacaaagaccgtctaatccaataccctgtttctaaagatgggaaagcggaggatcaaatggtgaaatgatttgatgtcatgaccttggcaagaacaagtgatacagttcagcttttactatatatttctatttatggttatcttcgtatctttagaagttttgggttttttttttatagttttgtgaaagaaaggatgggaataagatttgtgtttattttgcataaacctatctcgtgtggaagatgtgtaatgatttcaaataaaagacatcacagcaatggtacttagattttgagttaataaatggtgtttagtttgagatacacatctgttatgattttcagtaatattaatgatggtgatagcaacatttatgtaaccacaagttaatattattcaaagctccattctgatttggaaagaacagcagattttgcatccaaggactgactcttaagtcttacttttgccacttagtagccgagtgacccataaaatgagaatggtaatacacgcttctactcagtgtatataaatgatgaagaataaatatgcttattggagatcattttaatctatgaagcactgtaagacataagctgttatttatcaaaaaatataattctaatgttgccccagtgttgctccaaataacaaaacttttaaagtcataaaaacaagtaaaaattttgggtaaaaacgtaactttttattaaataagcattgcattacagttgagcaaaagataatgttgaaattcaaaattgtgtgtagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtaaaaaatgcaaaaaataattctgtgtaatagcgtagaagaaaaaagataattttaacattgggctatcatagtcaaattagtaatgacttctctttatttaaagtgtcacctcaaggccaggtgcaatggctcacgcctataatcccagcattttgggaggccatggcaggtggatcacttgagactaggggttcgagaccagccttggcaacatggcaaaatcccatctctacaaaaaaatataaaaattagttgggcatggttgtgcgtgcctatagtcccagctactcagaaggctgaggtgggaggatcgcatgagtctggggtcacaccactgaattccagcttaggtgacagaaaccctgtctcaaaaaaataaataaaaagtcatctcaaatcttttaaaatgaaaagattttatcatttatgttccatagaagggaaagtttgatcaaaatactattctgactcaaaactgttgaactatttgaagttgacatttaaaatcagaagcagatctgtcatccttatgcaacgaaggtaatttaatgcagattcactcagcagtaccttcactggggattatcgtaattataaggcctccatccctagatatcattctaaactcaagtacattttacatcataaaattggtttcctccaaagcaaactcaccatgaaggatcattttctgattggaaaggcagaaccagtttcattttaaaaatgaattaattgtaaagcacagaaaagtcatttgacaatataattcctgggactctaggcatattctctgtcagggaatattccagtttctagaggggatttgcattcctgtaaataggcaatgcttatctccttgttttgtttttttaacctagtgtgttttatgacctgaagaaatataattcaacattgactagaaaactgtcatcatcagtacccatgtcaagggtagcaattaacataagcctgcatgacagtgctcagcagcagtagagctgttggaggtctaatacgctaaggggagcctctgagtggctgggcttcctggagggattttcaagtaggtgcttgttactcacctctcaggtttatataagatctggcatatgaatgtgtttataaatttggttattaaagcaaagttaacattcgtcacttctcattaggtttctcaatctttaaaacataatgtaattagaattctttaaggaggaatacattctttttggagacacattaaaaacaattgttatctctgtaagaattatatatcctaaagaaagaaaaaatggaagcatccataaaacaatgtaaataatttttaaaccagtcatttaaaaatctagtctcaccaggtgtggtggctcatgcctgtaatcccaacactttgggaggctgaggcgggtggatcacctgacgtcgggagttcgagaccagcttgaccaacctggagaaaccccgtctctactaaaaatacaaaattagccaggtgtggtagcgcatgcctgtaatcccagctactcaggaggctgaggcaggagaatcgcctgaacccgggaggcagaggttgcagtaagccgagatcgcatcattgcagtccaacctgggcaataagagtgaaactccatctcaaaaaaaaaaaaaaaaaagctaatctgaaagtatataatgaacaccataaatatttgtataacttacatgtttgttgttggggctgcttatttttgttttattagtaattgttcatttaaaactcttatgtaaataatcctctatacacaacttcatgcacgtaaagttcctcatgcacatagagttcattgaagtgttatttgtaatagtgggaaaattggaagcaatgtggttgacaaaaactatataaactttggtataaatagcaaggatgcatggcaaacatgtatttgtttgaaaggatgttcatgacaccttttttttttttttgagacggagtcccgctctgttgcccaggctggagtgcagtggtgtgatctcggctcactgcaagctccgcctcccgggttcacgccattctcctgcctcagcctcctgagtagctgggactacaggcgcctgccaccacgcccagctaattttttgtatttttggtagaggcagggtttcactgtgttacccaggatggtctcaatctcctgacttcgtgatccacccatctcggcctcccaaagtgtcatgacaactattttaacatgataaaatatatacagtagtcgctcctaatctgcagtttctcttcctgtggtttcagttgcccagagtatagtaaaataaggtatttttagaaggagagagagatcacattcatataacttttattacagcacattgttataattgttctattttattatcctcttatgtctaatttataaattaaaccttattttatgtttataaattaaaccttatatataggaaaaaacatagtatatatagagttcagcactatccatagtgtcaggcatccactggcggggggtcttagaacatattcccccctataataaagggggactactgtaattagtggggaatataagacagaggattgtatttaccgcatagatgcaactatgtaaaatacaatcttataagttttttaaacaataattatgaggtaattgttggacttatgggtccttttcttcccccatcttttttcattttatttccaaaattttctttttactgggcgtaaatcacttttgtattggaaaaattaacacttttttaaataatcaaaacccttgatatttgaaagagaagtgttacaggtaggtgaaagggtcgcaacattacacagtgaataacgtatggacttgttaaccttacagttatgtaaactgaaaatataaatagtttcaagaagagtttggtaagaaaccccaaaccaaacaaataaaaaaaccaacttatggatattacaagtcaagttttgacctttcagagtatgattcatgatcaacatcttcagaataacacatccctttgtactctcatcactgaataataatatcagtgcccaatatttatattaatcttactccattctagacactgtcataagcattgttcatggtttatttatctcaacaacctataatgatgtacatttttaaaattcagagtaaaagatttattaaggttaaacatccattacagtcacacagctaataaatcacatagtctggatttaatccagtgactccaaaacaggatctcaaacaccttcttgtgctacttcatattagactgtgcggcatttcttgcatgcctatggtttatttgtaaaggggtgcaagaaagattgtcttcagttcatgttttgtgttgatagcagtatttatctaaattttatatcataagtctattcaggcacagtgtagtgatagagaatttacccaattatctaagtacctcttccactgagggcaaaacaagttgctgaggtggtggtagtggtggttttattgtgttcgctttttttttttttttttttttttgaggtggagtctcaagtctcgctctgtcacccaggtggagtgcagtggcatgatcttggctcactgcaagctccgcctcccaggttcacgccattcttctgcctcagcctcctgagtagctgggactacaggcgcctgccaccacgcccagctatttttttgtatttttagtagagacagggtttcaccatgttagccaggatggtcttgatctcctgacctcgtgatccacccgcctcggcctcccaaagtggtgggattacagtcgctttgttttttaaaccctcagttattcagcttgtttgtcctatcaaaattagtgtgtttcatgagataattgctcaattctccatttctttttggtacaagtagtctccatagaaatcatgaggtgataaggtaaacacttggtgttgctgctgctgattatttttattagtttgaatgttttataaaaagccattttccacaagggattggaggtatccttgcttatagaaattccaaaaggaagatgcctttcaaaaaagtcttgaagagtaaaatgtattcctaaagatgattatagcattttatttaaacatttccataaaacaccccccatgcccacccccagtgttccctaggcacagtaaccttggaagttggaagaatcaaagctggtccattccattcagagaggaggccatctcaaagcagccaggtgggtagctgtggagttcatcagggcgatgcaatcggcatgccaagaggacacatagatggccctgactgtgggtctgtgtacaaggtctggtcccctggcagcgtgggatagtgactgaggtgcagagtttgagacagagaagaacaaggaatcagaatagccaggtaaacaaggtgtggctgttgagtagtttgtaagtcattctaaggaaattgatttcaagcattcttttttgacatgattcattttccataatctcaaaaggtaactacctaattgtaaagcctaccaagataacaaattttttattattttatttattttatttatttatttatttattttgagacagagtctcgctctgtcacccaggctggagtgcagtggcacaatctcagctcactgcaaccttcgcctcccgggcgaagtagattcttctgtctctacttcccgagtagctgggactacaggcgtgcaccaccatgcctggctaatttttgtatttttattagagatggggtttcgccatgtcagccaggctggtctcaaacgcctgacctcgtgatccacccgcctcagcctcccaaagtgttgggattacaggcatgagccaccgtacctggccccaagataacatattttaaaaatattttatagcaacatcaatcaatattcaactgaaaagtcccatataagtgaactatagatactcagcaccatgtataaaaatatgatgttaaatatttcaagactcttgacaagacctcttgaccttctcctcagtgttgtctactgatgatggaaacccattttcatcagtctgtccttaaagaccccatactaactttctaaattactaccatgagtttcctattagctggccctaattctacagtttttgtttaagtcctagtcttcctacaacatcagtttaaatttaaagaagattagtttgaatgagattatgactatccactaaaattttaggtagattggaatcaatttcatctacccttttagcttcaatttatttatgtcactagacacattctctgtttaaaagaaaaaaaatcagtaggaactgtgtttaaattgctcatcaaattatcaaatgccactgttgcttaacaggtatctgtctctagattaaattctgaaataagtggtatttagggagtatgttacttgcaaaaccttctgaaataattgttgtatatttgtaggtgagtgaaggcagcctgtcatctttcacttttccactctctggatccagtacatctgagtcactggaaagtagctcaaagaagaatgcatgtaagattggttcagtattttaaacatggtttgaatttggctgtcaacactgatttttttgtcttgtttacctctgagctttcttttcccccaaatcatcccatatccaaatataggtacaaaaacacgtgttagcaaaaagtctgaacaacatgaagttctgcctatggcagcttttcccatttgatgtttaccctacaagatacactaaacattataatcaggattctgtaatttttttttcttactaagcagattggtgtttttgattttattccttttctgtgtttaatgtaacaccagtaaatcagaagatgccattaagtgaagccttctttttccatgaagattgcaaaaatttgagaaaattaatgtgatcctcctgtgttttaattacgtgaaatcatgctgcagagggatttttggcttggtgcattggttgagagttgttcaaattgaagaaactaacaatatggcaatctctgtttgcagtatgactaatattctagaaatttaggcacttaaatttgtgaatttttttaatgcatccatgactttattcctctcagccgtgcacatgtgcctttctatgcaaaacacattctgcccttgactcattcaaagtggattacatagttatataatcaacacttaaaatgagaaggaagaatgggatggtatacacgtttttccaactggaaaaataaatagttctgtgtaagacagatctaatcatgtgtactagcagctttgagcacccccttaaaaaaagaaacctaggttatcatttagtcccatccagctttagatattttaacgaacataaaaagtgaatgaacataaaataaccctattttatcttttttgcctttacagtggcatctgaaatacagggattaagaacagtcgaaatgaaaaaggtaacttggggagagaaaacaatataaaccctggcgttttaagagacatcttcatatgtgttttcttgttaactttcttacggttttaaagtattcatctcaaaaagtatgtattcttacatattacatgtgaaataacataatgtagtccttaatgaatttcctgatcacagcacctcatttgaaaaatcgttgtttgcatgctctgttttgctgaaaatagcataaaattgaccccacacaaaataataccatgcctctcacttcttataagtaaacctttctcttcaacagatacttattagttctgaaacagattcccttgacagccatgcacaagagacaaagtaaaagcagctgtgatttattgagcttttactattgttctgagcactcttatagacacttcatgtcatcatcatgtcatttaatattcactgcagccctctgtgagaggcactgttgtctccattttgtaaatgaagatctaatgatttattgagtggagtggacttattccaagttccagcatttgcaagtatgacttcgtggctttgaacacaggactctgattccaaaagtgtggtcttttcacttcatgagtttacctgcttttcatcagttccacaacatgattttcatttagcatgtcttgatttattttacttcctgaacagatgcttattttcctaagccacgctaagcacctgtgtcaagtaaagtaatgcagttttcttgcacttcttcattttccccctcacacttagaaaatcagagttgactatagatatcatgccaaagaataaacaaaaggtcaatgaaaaatatcactttgaccaaaattttatatctgttccatggcagggccctactgactcactgggaatcagcattgctggaggagtaggcagcccacttggtgatgtgcctatatttattgcaatgatgcacccaactggagttgcagcacagacccaaaaactcagagtgagtcgtactatcaaccctagaagccctagcaaaatgtgcagaagtgtttttataaacctttgaacctggctacctgttgcaaggcagttttaaatatctatatttacttttaaatcatctaatccaaccacagcaaggcttgcttggaataaaagataaagaatattaaaagaaaggagaaaatgcagatttgcagttaaataggaagatttatagttgtttcctaatacatatttttatatgttgaaattctgtggaacaagctaaaagagaacagaaagtattttcagaacaccagtatgaagtgaaatttttatcttatatatttgattggtttaaacgccgatttaactctgttaaattgaaaagtattacttatttgcattcactgataattttgcagaagtttaatataaatatgacttacaatgttataaaactatatgcaacttgcctcaaagctgagggattatccaaattgtggagcattgcaatggaatttatgccaactgcccagctctaaaaattacatgaatattccattaacgcaactcagtctctctaaagcaaaatctctatggtttcatacctcaaataggtctcagaacataaccacattttagtttaaatagtctttaggctgggaatggttcagcctcgtttgatatccaaatttatggctgacacttaaaacctgattgtatacatagcacagggtcagtaaacttctggaaggacagatactgaatattttaggctttgtgggacctgtgagtctctgttgcaactactcaactctgcgctgtgaaagcagccaaataagcatggctgtcttccaaccagactttattaaccaaaacaggcagtgggccaaatttggcctctgggccttagtttgccaacctccgacttagagtcacatctaatgattataatagtaatgtccagagaaatttcagtttccaaatgatagtgaatttttttttcttttaataggaagtaatgtctcacccaagagaaatgaagagcagggaagagtgactttctccttctccctccctctcccctggatatggaactcaaccattatgcactgcttctttttgtggttgctgctttttggacttcttggaattagtggtttccttggttatatttcagtggctggtagcagtatatatgtcatgtggaaggtggagaaggaaatgaatacttaggtctcaaagacccactctccatggctgctttagcagatggctgtttctttctctcccttgcaggttggggataggattgtcaccatctgtggcacatccactgagggcatgactcacacccaagcagttaacctactgaaaaatgcatctggctccattgaaatgcaggtaagatttttatcccaagcataattcagaatataggtagcctgaagacacatgagctttgatgttaaagcagtaaaaatgattaaatcttctgctattattttatttaatatttctcttgaacataaatgattaaattaagagttccaataaagtgcatatgagacatattttgtaacattttactctgatgcattgattgttttatactttaaggggaaaaaaatccaggccttagcagtacatgattatttgctggaattttaagtggtgctagcaagtggcttatattctaaagatctttaaaaagtaattacatatgagaccacattttaaaaacatcaaagaactttgtagaatagaattagaagaatatgtttactgtcaggacagttaagagcctctggaccttgtgaaatttcattctctttggttgtattttatgttaacagaaatgtttaaatgaacaataaaatatacattttaatccaagtgctctttctgaagaaaaattactttccctagccacaggaacatgtgttttttctgtttatcctcctcctgtgcgcaggtggttgctggaggagacgtgagtgtggtcacaggtcatcagcaggagcctgcaagttccagtctttctttcactgggctgacgtcaagcagtatatttcaggatgatttagggtgagttcatacatgatgattagtgtatcatttttcacttatgaatcaagtcttcctgacagttgcgttctctgtcccatgtttctaggaattacgtacaggtaaaatgataggatatatgaagtgtgaattatacatatcaggtgcttctaaacttaaataattgtggcatggatttagctgatcaaagataagtagagatagataactagctagatagatatgcgtgctactacccttcccatggtttcagctctgattttggggcggaggacattttagtcttgatgttaccacttcatgtaatatggagcaagtcaaatctatcattttaaaatttcccgcactgcctattcatctaatatattatcatttggactgaaaaaattcacagtattaagtaacaatacttggatacaaaagcattggaaaacagaggagaagagagaggcgcattagaaattttaaataatttgatgcagcttttccattgcttataattgatttttctctctgagcttgggcgtactgatgtttatgacttattctaatatagtcccctgaactttagccctctcactttaaataaactggaaaaagaatgagcttctctgtacaatgagaacatgccatgaatatgttagtttaagggaactgtaaatgagtaatagaattagggtgttaagtaggatttcattagattatgtaaatttaaaataccaagcacagcatgcactgacaatttaagcatctcaaaaatacccgtaatatactccttgtcagtaacaaagagaattatgctagctctaggtggatgtcagataattcataacatatatgtatagttttttttttttaatttaaaacctctttttcctttccttcaccgtagacctcctcaatgtaagtctattacactagagcgaggaccagatggcttaggcttcagtatagttggaggatatggcagccctcatggagacttacccatttatgttaaaacagtgtttgcaaaggtaagcttgcaaattttaaccaccctcttttcccctaaacattcattaatagtggtcagcagctggcttattagtttatggcctgaggtaatgccaaatggttaacagttgatcatttcttttcaaaactccctacaggaacaggtcattaaatatttttgtccaatttgaggtttcattatatttaaaggaaaataggctcaaattgaaactccatggaaactcaacaatatacataaaaatattaatgaactttggttagtaaagcctatttttttttctttgaacacaaattgcacatgatcgtcttttgaaaatgggacattttaaataagtatgctgtagagcactggtatttctgtttgcatttttttgttgtgaaatataaaatagttatagagaagtacataaagtacacatgaaaattaataagcatttattttataaatttaatttcattgaataaaacaaaaataactactgaaaaaatgtagggagtatccagcagccctatcatctataataagtcagcgatttgcaatcaagggattcaattaaaaagactgtatagttataattatataatacctattctagcttaagaaggtttagaataagaataaagatattgcagtactggtaaagctattaaaataatttaaacccatgtaattattgttaatatgttaagtcgtttttcaggggctacaaaattcgacaagattttctgcagggaaaaatttagaatctcaaaattttacagtgtcaaaagaaacaaaacttagtcaaacgtgtttaaaaatttgatacagggcctttggattagtggtatagttctttatggatattttattttattattttggaaaagatcttttttttagccaatttaaagtgttgtacctacaacaagctagctataggcttaatttataagatttttaaaaaagctatcggtatgtccaaaaatacaaacagcatttgctagtgaatagaagagtcatacagtccttttcctcagcctaggaacaatttatttaaggcatgctagttagaacatattttaagaatttcatcattatggattcctcattaacttttccatatttttaattttatatttaattgcataattgtcttctataagcgtgctttaagatggggttctttttctaacaccaatgtctgtatttaatcttaatcatttagggtccataaggaatatgaagaatctctctacccttgggaagtaagaactaagacagcttgaatagctttttcaaaaccacaaaaagaaatagcagtgggttttaaatttagaacttatgccttatcctgccatagggaatgttcaggtggctttgtgcttttgcagacctttggattttgtcatcccccaagcccttgtcctgtaaaactgtttttgttcctacctaatcctttaccttctttctgtaggtcttatttacaggatagaaaatcctggattctattgaatcattcctactaggcaaattcccaaatattctttattaatttgtgttcccaccaactgctgtgctgaacagccaaaaacccatccaactgatctatcgactgctaaattctctctcaaattggtatctcaatgctaaaaccatttaggagaaagaccttctttgtctatgttcatcattgcttaatggcttagagcacccatggagcactgggagcagtgtgtgtgtacaagcagagcaatttacattcctgttgagatctttttctgttgtgagttgcaaggcagcattttttgagaaataaacaagtctactttataatttgcagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaact

SEQ ID NO: 37884 - DNA, 193912 bp, Homo sapiens
atgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaaggtaagagcagccgctctgagcctgaatatgttcccatgtttgtgtgtgtgtgtgtgtgtgtgtgtgtgtgtgtgtgtgtgtgtgtgtgtgtgtgtatacgcctgcatgaaaaacgttccccagctcaggaataagcattaaataagcatttttcctgggggcactcagttgctagacaaccatgttccttcacattgtgccttactcagaaaacgttagggcttccttgaggaatgtttttaattttctgtagatgatgttgttctgaatgggttctctctccctcctgcccctcctaccttttgtttttaaatgatggggtggtcagtattttgtgttctagttgagccagactgtggctaccctcagagctctgggtctcaaatccccaggattgccctggcctgagtttcaggcacctagaaactgccccattctgggagtgggctttggctccaagggcggcaggcatttgtgtgctcacctctaaggtgactttgcaaaggaaatgtgacaagatggtcccctctgccgtggactgagccggcagcacacacgttacgtggcccgtcgtgggaggctcaggaatgcagtccatggcggtgcacctgccagtcaccctgcacgcgcagcttcccctccaaaagaaaacaaaatggcatcacctccccatgagaggggacatccgcccactgtgtgtgtggctcagccatgtggaagtttcatcttggagcttacgcgctgtgccaggggtcccgcacctgtgctgcaggaggcctcctccccagctggcatgcccacctgcctcagactcaggcagctccatagcgagctgtccagagagagaaagagcagatgcatctgtctctgtgagagcatccacgcctgtctgtgtgatttgctctcccctccccctgctggaatctttatctccacacccacccacccttggccactcatgcctccctagaaaagtccatctcctgccctggagttgcacctggcagctgtgtggggccccagaagccaagcctcactgtgctgggcagtagtggttcagcacccacacacacacatgccagtgcccagggacactggtcacacacagagtggtcacagaggcctggactccctgtagagaggactcatgagcacattccaaatctgtagccacccactgggtcagcgtgatgttccgtccgcgttccaagttgaattcccttggttgcgagtctacgtagatgtaaatttggcaagtggtttagtgtggtgtttctgtagctctgtgtggcaggggaggaacttttccatttttagaaccgaaaatgtttagtcactgatgcttttaaagaaaatgacaggcgtgtagacatgtaccacagagcacattatcctgtggtttcagcagagaggccaagaaatatgatggcggccccaaggtgcaattgacttcattgcttgagttgcatcagcccatgagtatgaatctcaagcccttcctgggggagagttggcctggactagccacctgcaatgggagatgagtgggcccacttcctcccggggtcctgtggggaggtcaggcaatgtgaacttggaagacatctcccaggcttgtaaccaggtgctgcttgtcttcccagctgacacacccattgaagaattcacaccaacaccggctttcccagccctacagtacctggagtccgtggatgaaggtggggtggcgtggcaagccggactaaggaccggggacttcttgattgaggtagggacacaggtgtctgtatctttctgcttggggagagcgccgactctcggggagagggtcgtagtcctggcagcacagccacgaggcccagtctgggggtgcttgtggaggctgccatgaactttcattggtcagtttctcccaccgtgggtgccactgcctgtggacctggtgttgggcttgtcttggaggccttggccgtaacccgttggaaggaggaaaagtctgtggaatttggtcattggtcttgaagtagaaggtagaaagaggaggcatgtggtcaccatgatgttggggacatgtgcagacctgtgggtggtttagttgtgactaaataggcaccaagaggagtcatcgtcccttcttgtgtcctatgggtgagtcggcaaccactcttgtgtggcagttgctggcgtgaggtctgtaacattgatggctaagagcttgtagatttgcaggttgtggtaaccaccccatcagatggacgatggccttccaagaccaaggagcccgggcaagagggatggctggtgtcgatggtgcaaaaaggaaacttaggaattcagatgctttgaaaatgaacttttgctggtactgaaaaggaaagagcattctcttcctttagagaatagaggtttgagtgctccggctctgcaaacagtccctacggttggcacgttggtgtgtgcgaggggttcggaggccccagtacatctgatcacctcgcctttttgtgagtttaggtgttcagttttaatcttgttatgcaaaggaacatgtgactctttggaagtaggaagaagaaaagaatgttacaggttgaaaaagatgatattttaaaggttcagtagactcgaatggtcctcgttgggagtgcgcatttcttggatgcacgcgctcttccatgtcaccctgagcccagcctcgtgtacatcagaactccacatgcaggtggaaggggtgggtacgtggcatccagccagccatttggtggtccctgccattgggctggacagacagacattcattctgtaaatgaggagcccacatctccacccgtggtgagagggctacccgtgatcatttctcccaatcaggcctaagctcccaagcttcttgttcatgctatgattctgctagtgatctccttagagatcctcaggactattacggggcaatggaaagtcagaagggaagagactattggagagccaggtaagatggagcaggtgcttaaacttattctgagtgcctcatgttgatctctttgatttgctggaagatgcatttaaattattattgaccaatcagaacctggtttgaatgagaaatgagcttatttgggttcttgtgtgttgaaactgtcgggtgcaccaccagaatgacagagattggagcccgctgtggctttgtgggctaactcgatttgtaaccttcatggaaatgcagagggcctgggttgaatcatcctctgtaggatgcagttgggatgtgagtccccttcgtgtgtgtgtgtctgtgtgtgtgtgtgtgtgtgtgtgtctgtgtgtgtgtgtgtgtctgtgtgtgtgtgtgtgtctgtgtgtgtgtgtgtgtgtgtgtgtgtgtgtgtgtgttgggggggcgtggccttgggcctagcagcagggctgaagtctataggtggtgtaagagtgtgtgcacgtgtgacaggcagggtggggggggtgttgaaataggtcactcttggttcttgattttcaataataaaagagggctgcagatgcaagaacaacccccgttgttcagctcattggactgtttcctggataacctcatcaataagagaaacgtggcctgctgaggcacgtgtgtgggccctgcacttgcccagtgagcggagcctcagtgggttagaagatgtagctgtctgtggctgcagcgctcacctgggtggggctgagaaggtggacctgtcctgtcggtttgaagcctttgtggaaatttggagctttgagagtttccacacttctgtttctaagcacctcctctgacattgcttttaacctctggtatgcaaatagatttgccattttggggcaggttttatattctgggtaacctctgacttccagtattctaggaatggctggtcctgagatgcattagggctgcgcctgcattatgattatcacagataacccaaggagcactgggccctccacagccctacgaggctgctccacaccagtcatacactaatgagggtgcggggtgcaggcagctggacccttgcacgatcctggctcctcccagttcatgtccacagctgcctctgggactcagaaattctcctctaggggcttaagactgagaattccattgagttgtgttcctagcgactggattttgccaccggaatattaaaatcttgtatagcataataggtgcgtgtttgttccaacagaccatgtttctctatttttagtgaagagctttgaccttggagggatggtgtgaaatagcctcacatgtctcacgtgaattttctttttggtgagcagccagtcctggagtcagtggggtttctgagctcccggtgaggtgcaaggtctccacgtgaaaagctgcccaaaatgcaggcattctgtcttccttaccccaagcagcccttggcaagccttcctttctctctgctattttgaaagaacctcgaaagtgtgacagatttttattttctctttaaaaatgcatgctgcggtttgaacttttggaccaatgggcaccctttgaagtgaatgttggcttttaatgtctttggtatctctagaacttcattttccctcgttaactttgtgagaatgccccgacgtggccatccggctctcggccttggtgcctgtcatgatttcctgctgtgcatgactttcttgggtacttagcttgtagaatttatttctctcctacctaagcttttgggaagagtttgttcttttgctgttgtttttgttccttggttgaccaccccctgaccctaccaaccacaatcaaaggctttgagctatctccagatcgggagtctcatgagacagatagatgttatcactcaagctgtgtggtaataaaaggttcacctcagaggtggacgtgaaagataagtgaatgtcccacgggtagggacatttgatcacagtggccccatggatggtgcgatttgccatttcagatcagctagtgtgccggaattcccaggatagacagtgacactaagccgtcccagattgtgaaatgtcagccagcccaggggagaaggagccaaagagatttcagaggccgtgggaggggcagggcggcgggaagttgaatgcccctgcggagaatgcccgtgggacctgctgagggaggctgaagccgaggcttggagcagtgacagcccccgagagaagcagggcaggtgtttctttctatgcaggtcagaggtgaggatggggcctccaccagccaggagtgacagaggcccatgtccctctggtgacaacaggaaacccagtccaaactggttttcataatgattagagcttgtcaggaagctgagaccagagagtttcaaaggagagtgagcctgccataagagtttgctgaagactttgtctgctgtctctttgagatggcccttattaggccccttcactcccacaacatggggctggagagatcacaggttgcttctgaagttcacgacatgtgctaaggaggatgtgggtggttcctggatgacggtagtgcatcaagtgtgtaaggagatgtggaggtggggacgccacttggatgtcatgcagggctcactgtaggtctcactcagtgaaacctggctgggcgtcagtcacctgagggttatagaaacctcgtctccagcccacacgccctgaatcagaatcatgaggcgagagctgggcatccatgaaagctgcagtggtgatgccgggggtcccaacaggcaggcaaggtgatgacccactggcccagtgcaagttgacattccagcctcttgatgtggcctgccaactaaagtctcctcgacccaaacacaagcaggtgctgcgttaatctcctagtcttaagactaggactgtcttccacaaaccccttgtttgacaacctaaatgttgtttcttgaatgacttttgtgatctaaaatatcctgtaactgagacatccttacagttcaactcaacagcaggcaggcagagggcaaacaacatttgcaacaaatgtcccaagaaggctgtgtccttgtttatagcagctgagctggatctccaaaccctacaagccctgcagtgctccgcttaaccctcacagtcatccatatagcatgtgtgttcctccccattttacagatggggaaactgaggtacataggtgcagtaactacatggccatgtagctggtgagtggagaaggtggaattccaacccacattgtctgactctgtaatgtcatggctcaaagatgcctgaacaacactttgatgtgctttatgtataaatgggcaaaaggtaaaaagaaaagcagtgcggtgactgttttattttcaaattagcaaatacttttttgtgactatactccttgctggtgacagcactcatgtgttgctgggggaaagcctaagttgccataaatgttttcacaatcaatgtggtagtatgtaacaagagccataaagctgaaccaggaattttacatctaggaatccatgctaagggaataattttttaaaaaacaggtagaaatcacgcctgtaatcccagcactttgggaggccaagacgggtggatcacctgaggtcaggagttcgagaccagcctggccaatatgatgaaaccccgtctctactaaaaatacaaaaaattagctgggcgtggtggtgcgtgtctgaaatcccagctactcaggaggctgaggcaggagaatcgcttgaacccgggaggcggacgttgccgtgagccgagatcacgccactgcactccagcctgggtgacagagcaaaactccgtctcaaaaaaaaaaaaacaaaaaaaacaaaaacaaaaccaggtagcaattacagtgtggcaaaaacaaggagttggggcagggagggggcggggctaataggagaatggttcagtggcaatggacatctgttgtgaattcataagaaagcattaaaaatgatgtttacaaggagctcttaataccaaccagaaaaggttacattctacttagtgagaaaggcagaatcaaaatgatcagcacaatatcatctaataccatctttccccagtatagtcatagaatagaaaacaaaaaggaaaggaaatattaacccctaggtggtgagattgtgttattttctctttctttcagatgtttgtctcagatttcctagaatcgaagtattcatattttgaaaagtatccatttcatacataggaaactgtgtcttagaagaaagttatctcacagaggagacaaatgttcagcccccttggcacagatagtgctgtttgctgtcagaggaaaaagccttcctgggcattaattaatttcccggggccattccttacccgcctgctgcagggctctgatgacgcctatggtttttgtgattgttttcttggccctgaagtggccaatctcatttttgtgttaatttctgcaaataggttttcccttgcagttaaagcaggtggcagtatccttcatccttgaaaagtggtgctcgagtttgctaattacattttcctcgtattaaatacttgcacgagagagggcgtggatcttctttatactcgtggtttgtatttaagtcaggatgctaagagggatgccctggtgttttcctcggagaccctgggagtatctcataaggccgggtgtggtggcttatgcctgtaattccagcactttgggaggccaaggcaggcagatcacttgaggtcaggagttcgagaccagcatggccaacatggtgaaaccctgtctctactaaaaatacaaaaattagctgggcatggtggcatgtgcctgttaatcccagttgattgaatgccagctctgtgctcagcgcctctgactagcagtccagtgctgagagcccagttcatctcaggtgattctgctactgtcacaaccacccaatttatcaacaggaatactgggacccagcaagcctaatgactgatcatgctgaatatggacttcattttctttcttttttttttttttttttttttggaaggctgaggcaggagaatcacttgaacccgggagcgggaggttgcagtgagccgagatcgcaccactgcactccagcctgggcaacagagcaagactctgtcttgaaaaaaatatatatgtttcttgggctggtattttaaaatgggacttgagaaatgtgaggtggcctctagcatgtttgactttgcaaccaagctggtgtgaagaacagttgttagagctcgctgctcaagggtcaatccccacagcttcagagttaaatattacttggaggaaagaaaatgaagtccaggccgggtgcagtggctcacgcctgtaatcccagcactttgggaggccaaggcaggcggatcacgaggtcaggaaatcgagaccatcctggctaacatggtgaaaccccgtctctactaaaaatacaaaaaaattagccgggtgtggtggtgggcgcctgtagtcccagctactcgggaggctggggcaggagaatggtgtgaacctgggaggcggagcttgcagtgagccgagattgctccactgcactccagcctgggtgacagagcgagactccatctcaaaaaaagagaaaagggaaagaaaatgaagtccagatgcagcatgatcagtcattatgcttgctgggtcccagtattcgtgttgataaaatgggtggttgtgctgaactgggctcttagcactggactgctggtcagaggcgctgagcacagggctggcattcaatcaactttcttttttagagacaggatcttgctctgttgcccaggctggagtgcatggcacaatcacagctcactgcagccttgagctcctgggttcaaaagatcctcccacctcagccttccaagtagttcagactacaggcacgcaccaccatacgtagctaacttttgtacttttttatagagccagagtcttgctttgttgcctgggctggtctcaaactcctggcctcaaatgatcctcccacctcagcctcctgaagtactgggactaaagatgcatgcaccccacccggcctcagtcagtatttgtcattgattatcatcttgtctttcatcatcattaatgatgcctgactcagaagaggaaaccagtggctattagttgaacaaacggggataataatattataataatgactgatgtttgttaccactattatttgaagcatgtagcagtcacagggcacacccaccatgtgccaagtacgtcggacacttccagccaagagtacatgagccatggtttccttgtgcctctgttgtgaggaacatcactaatagaggtacctgtcccaccccacccgccagcctccaaagtccctggcaggcatatctcctcctttggctcaaaccactgctcccagagcacttaccagcctgtacaattctctgttggcatgggtctggcttttagatcaccttggaattcctattcctgatgcccactttgccctctagcagcaaatcccagggccaaggccagagccctgttgtggtttgcctggtgccagcatcccttgggtttagtggttcagccacatcacacagctcacatttctctagctttccttttggggtattgtgagagactttgtcacatgtcctgctggtggacctgatgaccaatctaggaactctccaccccatccccaaaatttcttccactcttatttagatggttttgaatggctacttaataaccaagttaaagaccaaacaccagctgatgttagcaggaacccagggtgactgctgaattcttcagccagggtcacattggtgctttggtcatcaaggccaatatttcattgcattcacaccaaagacaaacagggtctgtcctgcatccctcttgagtgtggggtgtttctgtcctggcagctcagtggcttctcaccgtgtcgtcaggatccattgaccaagggtaatagcattgggggcctttactctctaaggctaatagcactggggatcttcagtctctgaggccaacagcattggggtctgctctctgaggcttaatgcactgtggtctttcttctcccagacagaggccactgctctgtggggagccctggatggcggggaggttggatcccttttctgcatgtggccttctgggcctggggaggtcgttctctttgtcctccatattgactgggaacaggtggttcgggctgaggagtggcccaggaatcttgctgagaaggtggatgcgggcagctcggcaactgcaaatctgaagtcttggctcgttcattttggggttctaatttgaagcatcagtgatttcaatttcaggctataaaaagattcagaatcacttcaggggaccatggctgctgtgctcagatgccatgggactggcagatggcagcacacagggttggagagaggcagagaggagccgcggtcaagggcacaggctgtgccatatgatccaggtttgaatccaggctctgcctcttcctaactgtgtgaacttgggcaggttgctcatttcttggcctcagtttcttgaactgtaaataaaagtgtgtgtgaagcatgtagcagtttctggcatcatgagttctcaacaaatggtggcaattgtaaaaattacttctgaagcttcactcattcatttctgaagcatacattctgcctcccaggtactgggctggaagaaagacgtgaatcagacacagttccttgaggaacacacagtctagaaggggtaggcaaaaagcagagtgtggtgaaggccccaaagtaaatcaggaaaagggcttcatgaaagatggtgttggctccaggctttgatgggtaagtgaggtttttgcaggcagaactgaggaggaaggtcttgagcaaaagcttagggggtcaggaatgttcaaggtggatttggggagtgatcagatgctatgaagctgggcatgaccggctggtctagtgggggcctgggttgttagtgaagtaggtacaaatgtgtgtggctgtacagctgcacagagcaagagcattgctggatctctccagggtgctgaacccttgtgtggcatggtctctctccagggtgctgaaccactccagggcactggctctctgcagggtgctgaactagacagctgggaggattggatgcagccttcctcaggagtctggagaaagccctcagcatgtcccctccctccatccctgcacctttcatttctgtcccctgtgtccttggagtttctgggcatagaggctcattacttagtgacagtctcatctactcgatggagaaatctcttccacaaggaggggccaaggagccaacatggttgagcatctgctatgtcctgccatgtccatctgcatctgctttgagccccactcccctcaccactgaggtttcagctcacatgatgccttctcagagaggcccctcttggcaccctcaggttgccctgactctcacactcacaccgtgtgcttccatgaccataggaatcatacatctcccgtgttaggtgactgacttactatccacctccctcagggaacattccctgtgggtcagagagtttgctgaccaggtctctgctacatctccagcatgcagcacagttcagagagattaagaagcctgcccagggccctccagggaggtctgaatctaagctgactccaaagcttgtttcttttgcactgtgtctgtctgatgctccaggtaagtcccagatcattgggatgtaatcttaacagccatctttttctgtgtgtggatgctgtacacccagccccaggctacatggagcgaaggctgcaggaggcatagtgggctgacatctccatgttggaagctgctggcgccaggtcctctgatgcacccattggtgcctctgggtcctctccacctgcccccctcctccctcccatacacccactgcccacctcccagtgttctcagcaggctcttgttagtactgatttctcttcgcctttggtgccctttcgtggggagtttcatgatacaagtggttagactggcaaatgaactggaggaaggccctgtgctaagtgccccacaggatcttttaattgatggagtttgtcagccctgggaattagggtgtgtgtgcgccaacagtaagcagagtgggatgagaaggggagttagagctgatgctgtggagccctgagaatggtagccccgctgtggtctcatgaaatcaaccacccaccagcaagttctctacttccctctccccaggatcttcagatgggtcccatggagcagactttcccatgcatctcctttgtgttcagtctccatggcaggacctagggggtcatggagatagacagggacggtcctgggcatgtgcacctccttcagcaccctcagggctggggttgcagatggaggagtgggttatatgggtgagaaggggagatggcacgtgtgccaggccagtgaggagatgaacgtcgccattggacactctctctggtctccggaatgtgccacacccctcctgtccccagacacttgcccacagttttgcctcctccacctgctttaccagggcacctcctgcatctgctccctgaaagttgcctgtgatgcccgctcataaccctctgccatagtcacttcctgcacatgccccatcagataagggaccacccagagccgagcacatggcaggccaccaataaatattccttaaggaaaggaaggcaccactgaggagagcacagccaggatagaacttccgtcttggacaagggtctccttcctcccaaaccccttccccctctccatcagggcctgaacttgaaaagctgatggaggtggaggggtggattcatttacatcagagagagcgtgagaagccagcccttccctggaaggtgccagccttctctccccaggcccactggaatcctgaggggtttacagggggaattgtacccctggtcctaggaaattttgagtaaactttacccccatatctgcctgatagccagcttttacattagcattatttcactgtgtttcgagtaaatcatgtcagacacaaataaaattggtaatgcagagaagccaaagaaaaaaccagggatgctgccaccaggagacagtgtccgcataacaaggcttatctttgtggaattttacttctttatatgtgtctgttagtaatacattttgtcatgtgtttatacactttttttttcacttgggtatgtcttttttattgtggtaaaatacacagaccataaaatttaccatcaaacccattagcactcactctccatctccctcccagccccaggcaaatactcatcccctctgggtcttgggtctgcctgttccgggcattttccacccacagaatcatgctctaggcaaccttttgtctggcttctttcagcatcgtgtgctttaggttcatccgtatggtagcatgtgtccgtactaccttctgtttgtgggtgaataacgttccaccatgtggttagaccacaattagtttatccattcactagttcagggacacttgggctgtttctaacttatggttgtgaataatgtcgacataaacgtttttgtaccagttttcgttttcagttccttagggtacatacctaggagtggaattgctgggtcaggtggtcattctgtgtttcttgaaactgctgatgcacaccccagagtccccatccggggtgggatgggcgggtgttcagtgagtgctgagttcaccaccttcgtcacatgcctgggcagaaggaccgcagagggaagggggtcctgtccccttttgttaagacagagctcagatccaacaaaagcttaactgctgagcagcatgatacagactgcaaataagactccgaacagccacggcagtgactgtgtaaaatgcttgcgctgcttgagcacctactgtgtgccagcaccgtttttgagagagttcacacacatgaactcactttgtgttaagtttaactcggtgacttttatcagctcctttctctgcatgaggaggccacagcacagagtggggactcacatacccacagacacacggcgagtggtagagccaggctgttcttccaagatccacgtatcacttcccaccctcctgctccaaccaccctcctgtgccacctgtcagggaggcggggtcttgcccaactggatatcttctgtgatgcagattctagaggaaagaggaaaacaaagaaacagagggagcttaggcagaaagccggaaggaacaaaagttatgcacaggcaagacttgaaggaaaactgggggcttacttctacatacagatgataaaagttggggctaccaaaagatattgctttgtgctttaagttagatttcttttggctgggcgcggtggctcatacctgtaatcccagcactttgggaggccaaggcaggcagatcccctgaggtcaagagttcaagaccagcctggccaacgtggtgaaacccctatctctactaaaaaaaatacaaaaatttgctgggcatggtggcggacacctgtagtaccagctactcgggaggctgaggcagggagaaccgcttgaacccaggaagcagaggttgcagtgagccgagattgtgccactgcactccagcctgggcaacagagcaatactctgtctcaaaaataaataaataaataaataaataaataaataaataaataaataaaataaataaaagttagattccttttaataactggagaagtactattaaagatcagaaaccctgttttctatctgtttggtatctggactgtgattccttgaaaatctttccaacaaggactggaccacgtggggttagggtatctatctgggttacacacatctaccaagttattttgagcaactgcttgttaggctcaagcctggagcctagtggttggtgaaacagatttgaatcctatctgatccttcttcccaaagagtgcagagttcaggtcccatgcttctccatagcccctaagcagagacatcctgcaaagtggttgctccacccctattgtcaaactgaaggaaggagggaaaacatgggctgaggaacttgagggatggcagggtggcccttggagatcctgtgtattgggagaggtgagctgtggctaccatgcaccacgaacttggagagtagagagcctgattgggcactttgccttgggaagccctaaatgctgcacttgggacacaagcttccttacctttgaccaccctggagggctcaggtgcgtctgacacagcctgatggatgagtctttctagctgggaagggaaacgatctttccagcctgaggctcacagtcatttacactgaatgtcctgggtttgagggggcaccaagcacaggagatccaaacgctgcccttgccgccacaggctaccagcatgcgagttctgggggtccacacagctctgggaacaataacaaggactgtttcaataatgacctctgccacttcttgagcacttactgtatgccagggtccccttccacgctcagcagtgtgaggaaggagatggcattagtgtcagtttgcacatggaacagctgaggtttggtgaacataggatgacccatcacaggtgatgatgagggagtgacagggcaggattcaaacccaagtctggctccggctccagagttcttgaacactgtatgccctgctgtggcagggcagggggtcagagggttctcgggggtcctggccaccccgatgctggactcaaagcccagggcactctgccttgccccagctccccagtctgctgctggactgaagcgaaactgtgaggtgtcggccactgaatttgaggggactcagccctgagggcctgtggcaggtggcgttgcctccaattcgtgacatatgcatcattctcttgttgtaaatatagcagctgaacctcggcagcacccgtgtggggtcagcagtgattggttttaattcctgtattgggcccagcctcatcttttccgggaagacattttttgttgtcagttaatttttccagagtgtttttcgatgagccttctgattacagtggactgatttgttgttcagttttttgttttttgtttttgttgttgttgttgttcctggagaacaggctgtgtgcccagcagccccatgtccagccctatccccagcctatagcccccctagacagcccctgcctccgaccagcaacaccgggattctggcattgagcaggatgaagcttgtgtgtaccttgtgtgcttcttcaaagcattcttgatgtgttttttatttttgtttttgtttttgttttgagacagaatctcactgttgctcaggctggagtgcagtggcgtgatctcggcccactgcaatctccgcctcccaggttcaagcgattctcctgcctcagcctcctaagatagctgggattataggtgcccagctaatttttgtagttttagtaaagactgggtttcaccatgttggccaggctcgtctcgaactcctgaactcaggtgatctgcccgcttcagcctcccaaagtgctggcattacagccatgagccaccatgcccagcctttgacgagatcttttgatgaatttcctgcttgttcatagtccctgccaggctggggtcatcttaaaggcagtcaccttcttctccacgtgtttgtctgaggcacaggtgtcggtcttggcaaaaggcatgggctgttgtttgctgaatgcataaaggaaggaatcaatgaaatgagcacagcaaagtgggactcagtgacactgtggggtttagcaagcaggtctggagatggatttcagcactgtcctcacccctgactttgctgagatctgcattgtctctgggaatgcatgttggaaaggtgtgttcttccaagatcaacctccctcttgcatttgcagcaggcgggagctgccatgcgggagggctgctggtcctgcccttggccgggggccccctcagttcctgtcgctgcgtccaccccacatggaggtatccagcctgggacccatcgggaagcagatggacagatgccaggagtggccaaatacaacattctcttcctttgaactgtatgattccgctcaagtgaggttcctagagtagtcacatccgtcacattcatagagacagaaagtaggatggtgggtgtcgggggctggggaaggggatggggagttcgtgtgtaatggggacagagtttcagtttgggaggatgagaaagttctggagatgcacgctggtgatggctgcacacactgtaaatgtagttaatgccatgaactggccactgtaaaatggcaaattttatgctttgtgtcttctactacatttttttaaatttggaatttttaaaaaagcaatgttcttcactttttgttgtttaacttttgaatagttgggctttcctgttaaatctggggcaagtcccagcatgtttccttagctctgaaacaggaccagtgataacccctgctcgccgccacgtacaaacccttgggtcagctgagaccctgggcagagctccagctcagcccccgaccccagatctcctctgcccctctgtgttcctcccccccctccacctgcagtcccttagtcggcttcctgtttattcatagctctggccagcacacggtatggtttctgttcaccttttgttgttggtcagtcttcccccatgggaccataactctatgagagcaaagactgtctttcttgctcacctacaagagaaagcacccagcacatggcaggagctcaaccctcattcaaatgaccaaaaacaatgccaacgtataaaagaaagaggaatatttgcataccaaccacgacgtgattcccaagacaccatcccaaatactaaccacaggtcacagaccaaccactgtagtataataatatttctgcttttttttttttttttttttccgagacggagtctcactctgtcgcccaggctggagtgcagtggcgcgtgatctcagctcactgcaagctccgcctcctgggttcacgccattctcctgcctcagcctcctgaggagctgggactacaggcacctgccaccacgcccggctaatttttttgtatttttagtagagacgggttttcactgtgttagccaggatggtcttgatctcctgacctcgtgatccgcccgcctcggcctcccaaagtgctgggattacaggtgtgagccaccgcacccggcctctgctttttaaaaaagcatgcaaaaatattatatgtattctctgtactccacattttccaagggaacataaatgttatgcaaaagttctggaaagctccacaccaatgtgataatccttcaagataagccttcctccaaggtaacccgttggaggaagagatgggtggagggtgagtcacagggggctcagctatttgttaactgatacctagtaattgtacatatgtacgggcccatgtgacgttttgatacatgcacacgatgtctaaggatcaaatcaggataactgcgatgtcgtcacctccaacatgtatttctttgtgctgggaacactccaaatcttctcttgtatattttgaaatatgcaataaattattattaactgtagtcaccttggctcttctgtaaagtaactttttttaaaaacttgtattctttatctaattagaaataaacgagctggtgaaattatggctctcaagcctgagggaccatctctgcgttattctcagtcgcatggagggcctttgtcatcttcacctcttcagcaggtgcaactcctgagccagatataaatttccaggaaatcagtgtcctgtttgtgtcacttggtgtttcccagaagatgacgggaggtgtcaggggaaggatggaagtggcagcccggcctctgtgtccgtgggagggaagcacccagctagcgtggacacaggggagacacctctcggccccgcctcaactgcgattagacaggctgagccgccgtccccataaatctaacaaagctaccactctgttctccaaagcagttcacatggggtgacctagcaagctccgttctgcccagacttcctgctgaggcccctctgtcactcactggttggtttgttagctaggacattgtctttatcctgggcatttcccccccaccccccacagcactgcgattctggatttaaatttgaatcgaacggaaaatcaaagttttaagacccatgggcatttttaggcgagaaaatttatctcaaaggcagcctaattgccagtagctaggcaggatggtttgaggtcagggcgcagcgcagcaagtattgggttggctttgtctggtttccttttaaagagaccctgcgggcaaaggcttcaccaactggaaaagcctgtgaaatgcggcctccctcaggggaatgccagtgaccccagcccctgtccttctgaccttacccatcctggtacccagtcccccgtagccttctctccagacccaggaactcccaggaaagagcctgaaccttggtcacccagaagagtcatccccagtgggattgcctagtgcaacccttgcccagagagattggcccttttgtgctagcacagctgcaagctggggcaggggcttgcctgcccgctggactgcccacagcccagggatctcgggtgtgctttgtagaactgcacccattttagacattgtgtgtccgtgcccgcaatgctggacaccgtaacaagccacatactgaaaactggctgttcatttgagccgtggaaagatatttattgcccctctcaagtcgggcaggcagctctcctccaagcagcttcaggctcctcccagctcccagctcctccatcctgaatacgcagatgcccaggtcaccgggctcggccgcctctggctggcagaagagaaagtgcatatcacttccgcttctgttccgttgactgcaatctcaactggcggtcattcctccctgcaggggaggctggggcaggcggtcttgctgtgcctctggaaggagagcacatgccattctctgctgttgatctcacaatgccttgtactggatcctcctagacaagctaaagcacgtttaagaaaaaagcatagtccaggcgcagtggcttatgcctgtaatcccagcactttgggaggccaaggcgggcagatcacaaggtcaggagatcgagaccatcctggctaccacggtgaaaccccatctctactaatacaaaaaaattatccaggcgtggtggcatgcgcctgtagtcccagctactcaggaggctgaggcaggagaacggtgtgaacccaggaggtggagcttgcggtgagccaagatcatgccactgcactccagcctgggcaacacagcaagacttcgtctcaaaaaaaaaaagaaaagaaaaaaagaaaaaaaagcatagtaaagaaaaaaaaaatacttagaattttaaaaattctgtacacgatctattgttatttttcatcagggagggatgccaggcagtagccagcccatgttttagctgtctgaaccttcaggcctcaagcgaagaggctctttgcatccctctaagtccccaggctctctgtgtagacgctcattgcctgcactcatggtgctaagcaggttacccagcagtcgcctcgattcttcctaggagctctgcaaggtggacttgcctgactctccgttttacagatgagtaaactgaggctttctgagatggagcaacttacagaggattccagagcccagccttgagggactgttctagagaatgggagacagggagggatcctgactgggcatgcgcccctcctaccccagccctcccctgctcgtagtgggcccccagctccagcacatgcctgtgatcccaggtcagggctcgggcctcagcttcgtgcagtcctctctgaagcatagctgtattcatgtcctgaggccgctgtcacaaatgaccagaaactgagtggcctgagacaacagcgatgcgttcactcacagtgctggaggccacaggtttgaaatccagggcctggcagggccctgctccccatggtggctctaggggaggatccttcccagcctcttccggcttcccgtgtctccaggcgtcccttggctcatggctgcgtcgctcgtctctgcctccatcttcacgtggccttctcctctctgcgattctgtgtctcaaatctccccctgcctctctcttataaagacacttgtcactgggtttagggcccagccaggtaatccaggataatcttctcatctcaaggtccttaacttaattatgtctgtgaggactctttccaaataagatcccattctcagttccggagattaggacctgggcacatctttctgggagacaccactcagcccactgcactagctgtgcgtggccccaggttgcctgcttaccattggcgacacatcccagctgcacctgcacgttctgcagcctccaggcccctggacggcctgggcaaagccctctgagccccagacgggcctgtgggcctgaagacctgccccctcctccttatgtctgagacctagccccttccttggggccgtccctgggtccactgatgtcccaatcccagccacgtagaactccaccactgagaggccgagagtttagagaggagccaggtaaagaccccttggggctcaaggggggtccgctcaggccctggaggccagaacccaccctgtgggcctgcagggcaccttcatgtccctggccagccaggggagcctcaggccaccctccttcctgcacccaccccacctactcatgtggatttggctttacccaattaatgtgttgctgggaaaatcagatggaaattgactctcaaaaagaaaagaaaaagaaaaaccaggccctctttgctgtggtgtgatggtctgtgtcacctgaaaaattcatacagtaaatcctcatccacagtgtgatggtgttttagaaggtggggccttcaggaggggatgaggtcatgaaggtgggtccctcatgaggaggagtagtgcccttataaaaggaaccccagagagcccctttgccccttctgccctttgaagacaccaagagaagaaaccaggacaggggccctcaccagacactgactcttccagcccacagcatggtgagaaatacatttctgttgtctagaagccaccagtttgtggcattttgctacggcaccctgagcaaaggcctgatggactgagactccctttcaggcacttgcggagcccacttccaccccaaactggccatttcctgaggctgccatctgggtccccaacacagaggcctctagatgccatcagggagtggcaagtcctggctgcagagaccctcagccagcaggggaagcccttcccagcaccagcccaggctggctctgtgagactcagggcagtgtgagccatggactctcaatgttttttttgttttttttttgtttttttgtttttttgagatggagtctcactcttgttgcccaggctggagtgcagtggcatggtctcggctcactgcaacctccacctcccgtgttcaaatgcttctcctgcctcagcctcccaagtagctgggattacaggtacctgcaaccatgcccagctaatttttgtatttttagtagagacggggtttcaccatgttggccaggttggtctcgaactcctgatccacccgcctcggccttctaaagtgctgggattacaggtgtgagccaccgtgcccggctggactctcaacttttttgaccaaagccagaatagatcattttctaggaaatctttctattatatttgttggaaattcagatgtttttattattgtacaagaaatgctgagcagactaaagaaaatagggcttcctcggccaccgcggattttccggtgcatctgttgacagaagagctgctccttggtcctcggctgttacaactcattctttgcttccgttaaagcagagaggatcagaggagccgggggtcaggctggcccagggaaggtcatcagcagggcgccgagcacatcctgcagccccagaccctcagctttcccatctgcaagcggggccgggcgtggatgcagggttccgtgacaatagaagcattgtgcccagcacagcagctggtctgtggcctgggtcctctgtcactgggagtagcttgtggtccattgccagctttgggtttcatatcctggcagcacattcttcaagccggcagtccgtggtctcattctatgccgagcctgttccccccggactctgtagctctaagctcctgctctgagcagtgcagtgacgattagtgtatttgccagattatgggatcaacttctttgcaggagaaaattagccccaaattgctgtgtgcctcacagctcactgtgggctgctagctgtcctgggggtactttccagcttcctgctggttggtgagcagacatctgtgaatgggacccacctggcatggggctcttgagcattccccgagaacctgtgctcagtgggcctgaattgatggacagagcggaagccggcttggcgtgagctgtgggcagctcgcagaccccaaacagggctccagccccgtcactgggtagactcactggtcagcctgaggctggctgggataccaaggctccttgggattcccctgggcagcctagagtgtggggtgcgggaaggaaaggggtctgacacctaggtctgttttgcaagactgccaggatctgggccccagggctttcgagggtctggagcagccagtctcccctcgccagggcgccagcctcactcccagtgcctagcatcctttgtgccccggccttcctgagcgctgggcagcggcctcccacgggtcacaccctctctgcagtggctgcttcccgatgggttggtggggggaggtctgaggagctgcctatcatgggctggctctccggccgctcatttgtctctgtgggcacctggattctgcaccgcaggaggagagctggccgtggcccggccaggaggggagtaaacacccagcccagccccacctgcccccatctgtgaatagcaggagggtctctataggcaccctgggtctaatcagttgtgtgcgggccacacactgagtccgtactcagcaccagcctgggcctttttgggatcctgcagagaggaagagcaggccctgccctcacagagcctgagtgctggggaaacaggcactgcacagattgacaggcactatgtgggtcaacaggctccataactggaggctgtggctgtgctgtgaatggaaacacacacatactaatgcacacacacatgcacacacaggcacccacacacgtgcacatacacacaggtacccatacacatgcacacacacgtgcacacacatgaatgcacccacatacgtgcccaccagaggagtgtggccctgcttaccccttgatcttagacttcccgccgccagactgagagaaaaattcctgttgtttgaagccccttggtttgcggtgatttgtcgtgacaaccccaggaaacggtacacatgttcacacacacttgcacacatgctaccatgtgcacacacatgttcacacatgcttacatacattcttataaatacacaagttctcacacatgcccacacacatgttcacacacacgctcacacatgctcacacagatgctcacacacatgctcacacacatgctcacacatattcacacatcatgcatcctcgcacatatgttcacacacgtgcttacacatacacagatgctcacacgtgctcacacatatattcatatgctcacacatttgcacacatgctcacacatgctcgcatacacacactcatacactcacacagactcacattcatacacacacatgcacatgtactaacacgcattcacacatgctcacacatattcacacattctcatgcatcctcgtacatatgttcacacacgtgcttacacatacacagatgctcacacgtgctcacacatattcatatgctcacacacttgcacacatgctcacacatgctcgcatacacactcatacacacagactcacattcatacacacatatgcacatgtactaacacgcattcacacatgctaacattcacacgctcacacatctgctcacacacatactcatacatgtacacacacatgcatgctcgcatacacgcatgctcatacactcagactcacattcacacacacacacgtgctgacatgcattcacacatgctcacgcatatactctcacacacactaggatgctgtgcagctacagggcagagaccacgcctttgtcgacagagtggtcagggaaggctccccaaggggaaggatttaggctgagacctgaagaggagggtagagctgaggtgagggtgggccgggcaccggggtggtgagtgcaaggccccacctggaccagggaaagactctgcgtattctggaacattcgggaggggtggatgtggcagagaaaggggcgggcctcatgccctacggggcctttcaggctgtgtcaaggcctagggcaatggggagccattggaggcccttgagcagcagatgagcgtgaccgagggtttatgaagaccttgtggagagctggcccccaagagatcacagccgccatttgctccattcacttcctcccccctttttttttttacagttatactttgtattatgtttaaaattgtagtacagtgcacataccgtaaaatttaccatcttaaccatttttaagtatacatttcagtggcattaagtacatttccattcaccatcaccaccatccatctccagaaccttctcatcttcccaaactgaaactcttccctattaacactcatccccatcccctcccccggcccctggcacccaccatcccactttctctccctatgaatttgaccactctagggacctcaggtcagtggaatcctgcagtatttatctttttgtgcttggtacatttcactcagtgtaataccttcgaggttcctccgtgttgtagcatgcatcagaatctccttctggtttaagcctgaatgataactatcccaactctacggaaacaccaccttttgtgtgtctgttcatctgtaggtggacacttaggttgcgtccacctcttagctaccatgaatagtgctgccaccgtgaacgcgggtgtgcagatatctcttcaagaccccgctgtcaatgccttcgggcatagatgcagaagtggcattgctggctcacgtgctcgttctgtgtttaaggttttgaggagcagccatgccatgttccacaggggctgcaccactttaccttcctgccagcggtgcccaagggctccagtttccccacatactcaccagcgtcattactttctgttttaggatcgtggccatcctaacaggtgtgagatggtgtcccgttgtagtttggatttgcctttctctaattgattagtggtgttgaacatcttttcagaaaagtccttatcagccatttgtatctcttctttggagaaatgtctattcaagtcctttacccatttttatttatttatttatgagacggagtctcactctgtcacccaggctagagtgcagtggcgtgatctcacctcactgcgacctttgcctcctgggttccagcaattcttctgcctcagcctcccgagtaactggggttacagggacgtgccatcacacctggctaatttttgaaattttagtggagatggggttttgccatgttggccagtctggtctcgaactcctgacctcaagtgatccgcccacctcggcctcccaaagtgctgggattacaggcatgagccacctcacctggccagtttgcccatttttaaattagatttttgtttctgttgttgagttgtaagagttttctgcacattctggatactaaccccttaccagatacatgatttgcaaatatttcctcccattctttagctgcctttttgctctgttgatggtgccctttgatgcacaaaagttttaaattttcatcgaccttagtatttattttttcttttattggctgtgcttttgttaccaagaaattcttgccatccatatacagacggacctttttattcttttttttttcttcagcaaatcccaggcatcgcgtcactccctcttccccttcagtctgtctctcacagcatgggatctttcttgcgggccccagtgtcactgtcccatccacgcacccagcagtggtctctgggtggaatctgaaacccctccattagcacatgtcccaaattatctcagaaatgtcttttcacggtggtgactttgacccaggacccacgtggcacttggtagatatgtccccaggtctccagtctgagccatctcccgtgtttcctgccagcaacgtgttatagggacagggtaggttgttagagggacagggtaggttggccataggctacccccaacccccgatgtgccttctgcctcctgtggtgtcatcggccagtccttgggtccttcccacttcctataaatggaggtgagctcttgcagcgctgttaatgttgggcccagccacacgcaggtgctgtgagcttcacaccccatctccccaggaggcagaaactgtgctcgccaccgctgtgacaaaagctgcacacaggatccaggtggtgatggtgaatccttcctcttgaagctcctcaccggctggtcacccaggggcctctctctggggtgggccctgcagacattgaggagtacactgaggcttgcaggcttgcatctgatgacttcctaatcctggcatgccttcgcagtgatgagctgagattcttccatctcgaagaactttcacatatcaaataagatgacttggttaagctgaacactgtttgtacaagaaggcaagataaatgcttaattctttctttttcattgtcaagtctctctataggaagctgatgcttcagtgatctctactgatgtccagtgagttggttttctatcatgttgttgagggatgaagtagggtctttttcactctccctgtgtcttctctgccctggtctgtctctctcttcctcaccagtatgtcattatgaactcaggatttttgtatattcaactcagtgttatttatatatatataaatatacttatacatgttttatatagaatatatattatatacaatatatttttatgtaatacatatataaaaatataacatttatgttacgtatatgaatatatgtataaatatgttatatataacatacataatatatataacgtatttatatattcaacgtgtctaaatcagctgcagacactattctgcatggtgcccaggttgcccatctgtgcccagtggcagccccctcatgcccaggtctggggatcccaggacctctctcctcaatgagcacctgcgcctgtccttgtccccctgccccgtatccatcaacgctccatgcaaggggctcactgggattaaaggggcccaggcttctcagagacccagcttcccaagccctcatcttgctgaatgatgtccttgtcctctgtcctccctctggtcctgtctactcttcccccgagttaccttccagatcaacatgaccttgtttcaaaaaataaaccaattagtatgttcttctgcagcccggatgtaccctcatgcgcccttttctggttggctggccggcagagtcccagcatccaccgagtgctcagggcgggtgggaggtagagcagcatgtggctgtgtgcccacatccctgggagacaaggattgtcaggcagcatcagggaaaatggtatgtggggagatgattctgttgtaaaaggcggttctataaaacaatcacaatttggattgttatcaaggagagaaaggagcctctggttgaaccagagaggtgggtctgactcagaagtgtttcccagactgccttcacacacctgcagctgttcggggcccgtgatggaaccaggagcagggagcgtggatagcatccttaaaagtccgccagttgggaggctgaggcgggcggatcacgaggtcaggagatcgagaccatcctggctaacacggtaaaaccccgtctctactaaaaatacaaaaaaaaaattagccgggcgtgatggtgggcacctgtagtcccagctactcgggaggctgaggcaggagaatggcatgaacccgggaggcagagcttgcagtgagccgagatcgcgccactgcactccagcctgggtgacagagcgagactgtctcaaaaacaaaaacaaaaatgtccgctcagtccactcttccctgattgaaggacaaatcgcattctaatgtttagcgtctaaatgaagcgtttcccagaacagagtgaacctttccattgtcctctgaaagcatttcaaaaataagggggaatctaattagttaatttctgcgtgtgattccaagaaatgtaatatatttgatagaaaattacctgtggcaactgctttccttctctgagacttgtgttttccaagacgggcgcagatgggcgctcagcacgggccgggcgtgatccaattacacagcagatttcagacgcccagacttggagctggggaagcctggcgccctggggagaacactgcctggagagaggccggggaggtcaggggaccccgactgctttgggccaggcttcatcctacaggcttttgtgttcttataaccccagcttgtcatgcaggaagcatcctcacagacacccagccacatcccccactgcgggggcacctacgctgtcctattcccagcgccctctgggtcaccttgccttggaggccctgagctcagcttgtgcctggcccagcactcagtgactcactgtccgctgggactttgccgagtggattaggagctgagacctcctccatgatggagaaggtggataccaagagaaaaggaccagggacatggttttatttggagaaggcaggtgggagggaggttgtgtgggtgtgtgtgtgtgtgtgtgtgtgtgtgtgtgtgtaactccgggaaccctcagaatggcacggcccccagcaggctcctcccagattctagctaaatgtgccacttgtacaattctaagttgtcatgagtctgggagagccttaggctaccctcccctgttttaggcaacctggaccttatttgctttagaaaagtcagctctcctgttcctaaggcctcctggatgggggcccgcctcttccccttggtggtttgctggggtgggagttcgcgtttcgcggtcctctgaagggctctcgctgctgcttctgtcattcctgccggtcttccgtggcttctcctatgaatgccacagccctttgtgggtcagattccggaatgcaggctctgtcatcaccctctgctgccagttgctccctgtccggtccccaggccccggctagtcctgaggatgcgttgggcgccggagggagggaccacaggatgcgcaggtcaccacactggcctcctacatgctcaccctttgtgctggtgtcctggggctgctctcacaaagggttcaaagccaccagctggggcttgaacaacagaagtgtctcccctcacagttctggaggcagagaccaatgtcaaggtgtcggcagggccctctccctccagtgctctaggggaggacccttccttgtctctttcagcttctggggagtccaggtgttctttggcttgtggccacatcccccagtctctgcttccatctgcacgtggccatgtctctgtgtgtctgtattttccctccttataagggcaccaaccagtggacttagggcccacttattccaggatgacctcatcccaagtgattgcatctccagcaaccttacttccaaagaaggtcacactctgaggttctacatagacgtggattttagggggacaaaattcaaccactaccgtctctttgcttgaaatcacacacaatttccagaggcctagagatgccactttgtccgcagatctcttcctggccccgcctctgcctgggcagcctgggtctgattgtccttctgtctgccaccctcacagtcctcagccgtggcctggttcctgtcctgggggctgaccagccttctggggcctgggacctggggcatcgctgctgcctgccgtctggcctcagggcacctgcaaggtcagtgccagcccagcaggatggctgacctttctcttgctctaagcgtgggctctgcagcccacctcaccccactgccatcagggaaccttctagcatagggcaagctgagtgggggccaaagcccacggtagtgcatctcccggaccagggccaggagcaaaagcagtgtgcatgctgtctgcccctctctggaagcccacagacgatgtcctctcctgtctcattgataagcaccctggggtctcctggtcactcctagcagccaggggaaactgagaaaaggggttttgtagctgggtctgttaactgccaagacaatattagggtcctcatagtgaggaaggggactagaatggatgtcagggggccggatctgctgggggtctggatggccaggcccttcattgcacacttggggaaactgaggcccagagataggcttattggagtcagggcattagagggcaccaggatcatccagctctgcagcaggtgctccctggtgtcccgtgcctctggcccaggtggcaccttcctgacggcagcaccccctctccccggcttggagctgatgtcagagtgcacctagcagtagcggctgtggcagcagttcggaggcccttaggggagctggagtccccagtgtttgccagctcatcccgctgcccttcccaccacatgcggcccccagggtcacggtggcccgcagcctgtgatccagacctccctctcccgccaggccggaacctgctggacgtccgtgtgtcccactccatcaggcctggagacccgggaggccagcagcagagccacactctattctgtgtcctcatcaccaagcactaggttaaatgacagagaactgaccaaacccttcagagagttcgaaagaggcggtttcagtctggctcgctgcccctctcccagccttttcggcagcagcctgggtggtgtgttttagttggtggggcaggggacagggtgtggctcagcggagaacacacccaaggctctctagatggaaggaggggccaggctcttccggtgctgggatgtgggggtggcttggaacactgacagaggagggagggtgcccggggcgcgtttccccactgaattcaggctgcagtgagcacgtgagctgtggcgcgcacatgcctgaaaccatccctctccaagtgttggcgtttccctcccaggctggaatcaactccaggcttaaaattaatttctcttccgctcacaacaatggtacagcctctccccaagtacatcctgtctttgtgcagaacacactgccttgccgcgctgcagcccagagccccagagctgggatgatttacccagccagagcccacagcagtactgtgatcctctgggacctgttcactcccctagtcaagagactcttcctagacactcagtttgagcctgtcctggggagggcaggtgggccgaaacttcggcagcccctcaccacccagaggcggtgctaacagcctgctgtatggtgggtctccactgcctggagctcgggaagccggaagttgggggatgacagcagcatcatgatgctgggtgtggagtgagcatggggctggcgtcgaggccagctctgcctcccatgggtgggccgccttaggctcctcctctgcaaaatagggagctgttgcaggacatttcagagctactataaggactgaaggaggccccggggaaaagagctcttgatatattaaggcactgcttagtagtgactatgcttactttgcgagcagggaaaccgaggcctgggtaggacagaggggggcacatgtgtttactgccctctccgcccccgactttggtgccatcagcctccacccctgctgcgcccgtcagaatttggcttccacgttctgctcccggaccctcccagcctaacctgtggatcctgccacacaaagatgggcttacctgggagatcttcagttttaagaactctcagccaggcatggtgggaggctgaagcgggtggatcacctgaggtcaggagttcgagaccagcctggccaacatggtgaaaccccgtctctactaaaaatacaaaaattagctgggcatggtggcatgcgcctgtaatcccagctactcaggaggctgaggcaggagaatcgcttgaagctggaaggccgctatttcagtgagccaagctcacaccattgcactccagcctgggcgacagagcgagactctgtttcaaaaaaaaacaaaaaacaactctcttccttgctaggcatgttgaccttgtataagggcaccctttgaggtccaatccaggttgagctcatctaaaaatccaaaatccaaaatgctctaaaaccccaaactttttgagcatcaacatgatgccacaggtataaaattccaagcctgacctcatggggtaagtcccagtcaaaacacaatgaaaactgtttcatgcacaaaattctttaaatgttgtataaaattaccttcaggctatgtgtataaagcatacgtgaatttcatatttagacttgggtcccatctccaggatatatgtgattatatgtgcagatataccaaatgtacatgcaaatattccaaaatccaaaaatatatgcaatccagaatacttctagtccaagcgtttaggataagggctattctgctgtagccacctgacctgtaacagtcaggacagcggggttaggctgcagtagcaaataatctccaggttgccatggcttaaaaaaacaaaggcttatttcctgctcactctcactgccctgtcaggtctgctgggtgctgtcctttgccctcctcacttaggaaccgggttgggtgacgcccccaccagctggaccatcatccatttatagttgccacatctgggttcaagggcagtgtggtgggtggtgagttggtcttcatctttcctggagtgacacacgtccctgcagccgccggctcacttggccgcacctaacttcaggagggtggagacctgcagccctgtgtgtgcccaagaaggaggaaaatcggaattttggggaacaactctaatatcacaaacctcaaaaacaggaacctttagtgctagagcgagctgtgagaggagacacttcagggacaaagtcccccaacaccatgccacccccacgccccccacctccaggctcccatctgaccttcacggctgcgccaaagccaaccaaagggcctcccggggtccctgtcttgggtgcccaggaaatgagatacgtgctgacggaggacctgggaaccgcagccttcatccttgctgggatggagtctttcctcttcaggctgcccactctgggctgaagagtgtcatgatgtggcttggggtgcagtatttctccactacagcaacagaggccagctctgcctcctgtgggtgggccaccttggactcctcctctgcagaataaggggctgcatctggacctttcagggctgctacaaggattggcctttcagaggtactacagggatagtagcctctggtccagggctggagccatcggtctctcctgtttcttgcagtccagtgggctctgtggcataaagcttgccactcggcggttgtgggattagaccagatgagactgactgacgagctctgcctctggccgaggactagagctgtccatctttcctgtttcctgcagtccaatgggctttgtggcgtaaagcttgccacctgggggttgtcgaacttgaccagatgagacttaccgacaagctcccaaatcagccaggagcaccaggcttcgctgtgatatgaggcaggatttttccctggtgtctccctgcctcttgatcccagtaccaggcttcatgccatagtcagtgcagatattgtgggtgatatgtttgtttcataaccgttcctaaatatagagtgcatgctaagtgatatctagaagccatgtaaaagaaaacgtttgaaatgtttgcaaagaggatgaggcattgagtggaccagaaaacatgtcttcctaaatgggcccagcaaacggtgctgctgggggtgttttccgttgccagctgagttgtgactcttggcaacggtttcttagcaaccgtgtgtgcggggtaccatgctcagccgggatgggaggctgggacggaggctgcctgggagtgagaacaaggcagcggaactggaggcggggaggccccagaggcctgcagccctcagccctccgagcgggaggggccccaggtttagaggattaatactccaggtcccacgctggcctggtggttgccatggggtgaattactggaaacttctcttcctgcatttttccttcctctacagtgtgtattttatgcacaaacgtgtcttttttttttttttttttttttttttttcatttttgcacagagatccaagaggctgcactgagatttcccccagcttgggcttgtggacctctgggaggcaggggacttggggagcggaggggcctgagtaaaagaggagagtgcagggactggctcagagcccacatcctccactgctcagagcctgctcagatttcctaaggtctgggcctcagttttctgatctaaaatggagggagggaggtctgggtagtgaagcaccaacttgatccaaagagagagctaacctttgccttcacctcctgggaggtggtctctgggctcccagaatatcctgcctgatgtatgtgtctctgtttgcctgggggctttgactgctggacagtctgacagtgtgatttatggtgggagctctgggtcatgccacatcagcttggacctccagaagaaactggagaccagaaggattagccctaacctccaggaggagctggaaactaaagccctgccaccaaggcagtgtgtgacagagccccagcaaagactcgggacaccaaaggtctgggagcatccctggcggcaatgccccatgcgtgttgtcacacgtcatctctgggagggacttatccccactttcccagggaggacggcagacaccccatgtctggaccctcctggactctgccccccacgcctgcctgtccttgcctgatctcagcctggatccctttgctgtaataaaccataactgtgagcataggtgcttttagtgagttctacgagtctttcccacaaatcaccaaacctgagggtggtcttggagacccccagaacttgcagctggtgtctgaattgaggaagggtggtcttgtgggggctgttctctcaaactgtacattggctaaactcctggtgagaacccttgggacaccccccgcaggccaccaggtgagggagccgatagagaccaggctctgggtggaggcatttcgcagagccgccctgccaggtgtggaactgggacagtgttgccccaggacgacaccggggacgtttctagcaggatcactctgctgcgggcccctcctgcacactgtggggtgtccagcagcagcctggcctctccccactccatgccagcaccagcccccagttgtgaaaaccaagaatgtctccagacgttgacacgtggttccctggttcctcctctggttccctggggtttgggggggcaccatcacccctggctgaggactgctgccttaagggaaagacggtttgaggctttttcttttttttttttttgaagaaggttgtggccatgggagcatctctttggaaagatggaaatggattctgagggatgtctgggggtgaatcctggctcaggcaggaggggatggttgttcctctctctgtgaggggtgcagtgtgtccaacaccccctggcctcaagtctgagggccgcagagctggcaggaatcccttgggagcaccagggaaccaggggattggctgggggcgttgctccattcccacctcctccatgggggagaggggtaggatgcaagcctgggaataagaccatgcaggtgacagcccgcccccatcagctctgccctcagctcaggaagtggcaggcatggtgtccgttagtcctgcacactcccccggcctcagcccctcctgaggctgcaggctcccaggaagctccgggcccacccctcccctagggaaaccagggcctctgctcccagaagtccacacccaaggctgcccctccctgcacagggacgaaggtgccctgcctcccatggctccagttcttggtggcagctctgggcgcacccttagccctgagttgtgacccatcctataccccagctccccagtggggtctctgttgctgtccacaccctgccctggcctgggaggggccataggctggaagagatgccctgggaccttcataatgctgacagccctgaattctctctccttccttggtctaaagcaactctgtctggtagaactttctggaaatgtcccatgtgctcgatatggcaccactggccacacacagctactgagcactcaaaatgcagccagtgtggctgaggagctaattcttagttttacgtatttaatatcaattaattgaaacttaagcagccgcgggtggctggggctactgtatcagacctcccatttgatgaaaaccaccttccatctgggaaatgaaggagctgggaagaatttccagtcccctctctccttccttccttccttccagccagtccacccatatttcccaagcacctgccatgggccgtgtcctcatcaagggtgctgtgggggcgcagccttcggggtgcatctggctgcatgatgggacagaggcaggagccaggccagaaagaaatgaataaataacgatgatcctccaaaagggcaaatggtgcgtggagcataagcaatagctgtgcagtgctggccggcagggaaggtcggcaacctcggaggaggtgggcttagagccccagaggcaaaaaccgcccggggacctggaggggcagaggccatgcacccaagtgcgggaagggtgggagaggcaggcacaggccccacaggatgtggagaggaattttttttttttttgattgagacgaaatctcgctctgtcactcaggctggagtgcagtggcgcgatcttggctcactgcaaactccgcctcccgggttcacgccattctcctgcctcagcctccctagtagctgggattgcaggtgtgtgccaccatgcctggctaattttgtatttttagtagagatggggtttcaccatgttggtcaggctggtctcaaactcctgacctcaggtgatccacccgcctcggcctcccaaagtgctgggattacaggtgtgagccaccgcacctggctgtggagaagaatttagactctactccccaggtgacagggtttgtggcagggagcagtggtgcttgcgcgtgtgtgttgttcagcttgtttgacttccgttcggagactggattggagacagtagggggttggatggtgttccacagaactgtgtccactgggaatctcatttggaaacacggtcttcgcagatgtccttagatgtcatttatagttaaggatcttgagatgagatcttgagatcatgagcagaaggccacgtgcagaggctggcaggtgcagttacaagccaaggggagggcaccagggtggccgcagcccctggagctgagggagggccccggaacggatggcccctcccagaagctttggtcttggactggaggccgcctgaactgtgagtgaatcaatttctgttgttttaagccccccagtttgtgttgctttgtaacaaaagcccaggacactcgcacagagggtcaggaagccccattggcggctgttccacatcaaacaccggggtggagaggactgaggctgggggtggttttggggcacagcacaggtgggggcgggggttgacatgagttgagtcctgggctcttccatacactgccgggcagctgtggggccctttgctgagacggggaagcctttggcaggcaggggaagttgcggtgctgtgttggattggagacgtccattccattggacatcctgctgggtttggatggttctagaaggagccgaggagtggttgaccagctgttcttgtcaggctcacccaccccactagtgacaggcaaacacccctttgccccaatgtgcctggggcagccagcccagcaaggtgggccaggcccctccacatggcgctgggctcagctccagaacctcccggcaccgtgtggacagagccgggaagagaaacgagctcagaagttggccctcacccctcctgtgtggacagaagagctggccaggcctgggggtgtgcaggctgggatgtctgtcggcaacacctgtcagtcacacttgatcacctctgccattaagccctcaatcatgcttttctgggatcatttatgggtgtctccagaagagttacagcaatggatcatccccatgtatctccatcattcttccccatacccacgtcctcaggcagagtctccccttctacactcacttgcctgggttgttttgtaatgtaagcagccacgcatggctggggctaccgtatcagacctcccatctgatgaaatcaccttccatctgggaaatgaaggagctgggaagaatttccagtcccctctctccttccttccttccacccagtccacccgtatttcccaagcacctgccatgggccacgtcctcgccaagggtgctgtaggggcacagcctttggtgtgcatctggcagtgtggtggggcagaggcaggagccaggccagaaagaaatgggcagatggtgtgcagggcataagcaatagccatgcagtgctgggctccaagctggtctgggttctgcttcgcatgttccacctgtgacctcaaatgagtaccctggccgctcctgcctcggtttcctcatctgcaaaatagtgatcaggacaagaggggctgatgtcttatgacacttaatctcctcaagtgtctaggactgccccttggacaccccagaaattgggtcttcctgggaggtcagagcaggctgcccaggggctgctgtcattgatgtgagcctgtagaggtgaagtcgggatcacaccctgcccgatcccggtgccttggtgcctgagctttcatttcagcccccacagcctttgaggcaggtgctgttaccatccatccccatttcagatggagaaactgaggcctgttgtggtcacacagatattacgtcataccggaccccacatgtcttattcagtttgggttgctgtaataaggttcgacagaccagggggcttaaacaagcatttatttggagactagaagtcccagatcaaggtgccagcaatttggttcctggtgaggggtcgcttcctgcttataggcagctggcttcctcacatggcagagagaggagagagagagagtgtgtgtgaaagtgccaccaagctctctggagtttcttcttataaggacactaatcccattggatcagggccccacccttatgacctcgtataacccgagttacctccaataaaggccctgtctccaaatgtgtcaacataggaacttggggggatacagacattcagacggtaacaacagactccacattttgtctgggggcaagacaagccttaatgcaacaacccagatagttgtgaaggaaggcgcccatggtgggggtgggggagaccaggcggggcaggcagcctccaggcccacaggcaactgcatttccacagatattggagctctgtgtgtttcttgtaataacgatgggattacctgttctgcttaattaagtacttcatggacagccaccaaaatctccatttctcccaactcaggaggtttctaaaaggcacaaaacaattacatttttgttctgatgaggccccggcaaggtaatgattcttctgccttgggaaagagaagagccagccgggctatgcagaggcctctccccatctcagacaccaggaagcatcagcttggtgccgtggaccgaatgtctgtgtgacccccacactcaaatgttggaaccctaacccccaccaggatggtgtcaggagcagggcctttgggagggggctagggcttgatgaggtcagagggtggggactcatgatgggatccgtgtccttatgagaagagagagggagaccagcacaccctctcccaggatagacattctgttccagtcttaaacaaggtcctcaagtgtccttctaagttccggggtactttgtggctcttttaaaactctcccctcctgcctccctgagcatcagttagcagagctgagccccaaacgtgctcctccaagtcccatggtaacagaggtagatttcacactgggcagcgtctcaccctccagcatccaagggccttgctgttatggaggcctcctccctgtgagccggcactgactagcacgcctcatggaggcagccaggacagccccaaagagaatgagggagatggggaagagaggggccctgaggcgttatcactgcctggaagggtccctgggcagcctctctgcagagcccagttgtgcctgccagtggccagctgaataagggtccccaagatgtccacgtgcttatccccagagcctgtcgaccgactgccttccatgggaaaggcggctttgcagatgcaatgaactgagggatcttgctgcaatcaggaggtcatcacggatcgcttaggggggcctgagtgtgaccacaggcgtccttataagggggaggcagaggtagatttgatgcatgcaggggagaagtccatgggaccccccaaggcagaacttggagtaatgaaccctcagctaaggaacgccaggggtccccagagctggaagagacaggaaaggaccctcgctgagagctttcggaaggagccagccctgccaacgccgctctctcagcctcctgagccctgggttggccctctgacctacagaactggcacgtaagaacatttttgttgttttaagccactaaatttgtagtaattaattacagcgagcaataagaatctaacccaagggtggttgtcaggctgaaatgatgaaccctcaggaagtccttagagtgtcacaggctgggctggggtccgcctcccctgggcagggccatgggcagaaagcgggggtcctgaagggagatcgagcctgcaggacgaagggtgtgggtaagggactggggcggctgtgcacggcacctgcaatgattcaccccgtccatctcctggccatctgccgggtcagcctgtgtgtcccctgtcccagagaagctcgcctgccctggatacgcctctcagggttgctggatttgttccattttaacacaaaggccctggagagccagccttgggtggtttccgggcctttccagggtcacctgcccagttttccaagctcaggtttatttttattccacacaatgacaaatgctcagcatagcgtgatgagggtaagcggcggccagggtttccgcatgggctgatttaacccagaagcctgcgccttgctctcccagtcggtgttaattaagctggattaccgtattcacaagctgaaatgcctcgtaattctgctctaagtagccagccttgtgttttatgacttaattactgaatccgagccatgcacatcacctgcaggtgaggccaggcctggctgtgggcagagccaggggccattcattggaacctagggcggggtggccctgggattctagaacgttccttcctcagatggttaggctagacataaatggcggttaactctggagacttttgtccttttgttcaaagacttttccctctcagtgggttcattctgaccttctgaaatcacccctgcacgaatcacatcagaatcaaacatttctttttttttttttttttctgagaccgagtcttaactctgttgcccaggctggagtgcagtggtgtgatcttggctcactgcaacctctgcctcctgggttcaaatgattctcctgcttcagcctcctgagtagctgggattacaggcgtgccaccacgtctggctaatttttgtatttttagtagagacggggtttcaccatgttgccaggctggtctcaaactcctaacttcaagtgatccacctgcctcgccccccaaagtgctgagattccaagcgtgagccactgtgcccagcctgaatcaaacatcttttttttattattattatactttaagttttagggtacatgtgcacaacgtgcaggtttgttacatatgtatccatgtgccatgttggtgtgctgcacccattaactcgtcatttagcattaggtatatctcccaatgctatccctcccctctcccccgaccccacaacaggccccggtgtgtgatgttccccttcctgtgtccatgtgttctctttgaatcaaacatttctaacatgcttggcatggtagacgtttattcagaaaaatactgtttttcagagttttggtcatatgcacgtggggtaaactccaccttgatcatgaaagcctctttccctcattccggccaccttcttctcccgttaactctgaactcgagcttgctctaggctttgtaggtcccgtggggttctgagggttcctatgcttcccgtggcgacagctgcgtctgccccctagctctgctctgaagcccacgatcagctctgcagaggctctgactgcccgttttgacaaatctgctccacctccccactccgttcctcgcgtttctttcttttatggcagggctgggtgaactctggcctgggggccacattccatccatgactgagtttctgaggaagatttttacatttttaaagggttttaacatgcatgtacatgcactacacactcacacacacacacacacatactctctcaggcactgacaaacatacaccatcatagacattgacacacatgcactctcagtgacacacatgcacacacacacaacacactcagacactcacactcacacattcatagacactgacacacacacacagacagctcacacaccctttcagtgacacacatacattagcatactctcagtcacactcacacacatacacactctcatagacacacacatatacacacactcagacactgccacacctacacacacactcatagacacacacgctcataggcacacactcagtgacacacagtgacacacaacacactctcagacactgtctcacacacatacacacacactatcatagacacacacaggagcacacacggctctgcccctggctgctgcaccctgtggccctttgcggggcatttgtcatctcctcttcctcagcggcccctgtcgggggacgccccgcaggctcccctcgcctggggactggtcaggagccagcctggcaggagtcccctgggccagggagaggctctgggccaccccagcctggaagtactcccttctggcactcccagccttcacccagcagcctccggaggcctcagatccccccacaccccaccctgccttccttctcaggtgtgaatgttttaaccctcaggagaacttgctcaggacccagcactgggcaccagggacctggttccagggtctgtggggaacagtgcctcctctgtcctcgtggcctggccctgcctccctcatccctggactttcagcctcctgagttgtctctgcctccccagtaccacccagcgccctcctcgggcggtcctagcactcgaattcacatcctctgctcagctcaccctctgatctcattgtaggccccaactcagaggtgccatccaggcccctcccaggctggggagggcctcctcttggggtccctggagccagttccgacagcccagtgtggggtcgccaacagacgcagggcctgggccttctgctcattgagacttctcggggaccttcagctcagtagctacttatcggagcaaggagcagtcggccgtggggtccgttcagttgcatcatgtcaaactagcaaatattgaactcttatcaacctacaagaatggcaatctcatgtgccccccatcctgatgagcagctgaggccctgaatgcagggaagggcatcctaacggcaaggacagtgaagggaggatgggttccaaggcctctgtccatttcccagaggcaggctctggtctcggcatccacgctgtctgccactccttcctcagcagccctctcagggacagctggggtctgagtggccccagtaaatgctggtgcccaccctcacctccccactaaccaacaaagagacagaccgaggatgtaagagccacagagagcaagttcctcccttgttgccaacaaagccaataccggccaaggtggcttagacctgtgggtgggtgggcttccttctaccaccaaaccccaggattggactgaatggcctgacagctctgccccaaggtgtggagcaggttcaccacgcgccgcttaccaccttgtcctagcctggtgagccagccgcccacacagcgagttccatgaactggttcattgcttacagatatgcagcaagggacaatagaagcctgggattcggccgagccagcctgtaaggctcaggaaagctgaccggagtcttgactgcatgtgctcccttgcgccgccactaagggaccctggaaagcagctcctcctgggttttataccccggggccatatgacttttggactaaagtgttgatggacatcatgtttccggggaagactgggacagagctcaggctattccagtcagccctccctctctcggggtgttgcatttctagcacattctatggttattcttaagaactgaaagcaaaagagaggggagaactgggctcgtccaaggccacctagaggacagtcccacaccaggtatcaggccctcatcacagagtccaccaggaggagcggggtgtgggctgcattaggcagaggtgtataggcaatgttcagcttctccttctaggcccacccactgttctccaccccctactcattccccaacagctcttggttcagagggaggctgagtgttgagttcatgatccccctctgccatcggaagatgtcttccatgaagcattgcagatggcatgtccacgaatgggttctgtgcatggggggaatccaatctaagcaggcttctcttctttccttccttttgcctttccagttaacccattaaagcaaggccctgggaccacagccccccagccaggagcagcatagctgcccacttcctcttccctctccagaaacctctaacacggccatggggacatccagtactcccgtgttgttaagttagtggggaggggaggcctgcagccctgtgttgagaagggctcagaggctcaccccaggctcagaggagcacacagactcttggagatctgcagaagggcttggtcatccttgctctcacagcaacagacccaaggcctatttggtcactgagacaaagactggaggatgggatgaaggaagggcctggaatgctgcttgtacttatttcttagggctgctaagaaaccacaggttgggctggacatggtggctcatgcctgcagtcccagcattttgggaggccaaggcaggtggatcacctgaggtcaggagttggagaccagcctagcccatatggtgaaacaccatctctacttaaaaaatgcaaaattagccaggcatgttggggcacgcctgcaatcccagctactctggaggctgaggcaggagaatctcttagaacctgggaggcggaggttacagtgagctgagatcacgccactgcactccagccccaataacaaagggagactctgtctcaaaaaaaaaaacaaaacccacagactgtctggcttaaaacagcaaacttttactgtgtcattggatgctggaagacaaaggtcagggtgtcagcagggcagcgctccctccagaggctccaggaggcccttcctggcctcttccagcttctggtggtgctgacactccttggccttccctggcttgcgctgcctggctccagtctcggcctttattgtcacatggtgggctccctgtgtgtctgtgtccaaattcccctcttctggttgggcgcaatggctcatgcctgtgatcccagcactttgggaggcagaagtgggcagataatttgaggtcaggagttggagactagcttggccaacatagtaagaccctgtctctactaaaaatgcaaaaattagctgggcatggtggtgcgtgcctgtaatcccagctacttgggaggctgaggcaggagaattgcttgaacccgggaggccgaggttgcagtgagctgagattgtgccactacactccagcctgggtgacagtgtgagactccatctcaaagaaaaaaaaaaaaaaacaagttcccctcttcttacaaggacagcagtcattggatgtagggcccaccctactcccctatgacctcacattaattgatatcttaattacatctgtaatgaccctccttccaaataaggtcacctcctgagatcctggggtgaggacttccacacctctttttgggggacacagtttaactcataacactgctgcacatggccaggtcttccagagccttttgagtttctacactttgtttttaaaaaaagaaaaacatggccgggtgcggcggctcatgcctgtaatcccagcactttgggaggccgaggtgggcggatcacgaggtcaggagatcgagaccatcctagctaacacggtgaaaccctgtctctactaaaaatacaaaaaattagctggacatggcaacgggcgcctgtagtcccacctacttgggaggcggaggcaggagaatggcatgaacctgggaggcggagctggcagtgagccaagatcgcaccactgtactccagcctgggcgacagagcaagactccatctcaaaaaaaaagaaaaaagaaaaacatgaaaaaaagtcccaaatcttgcaacctctttagaaaacagtagtcattgcccactaatatgaaagacacacctgctgtgcaaaccagcatgtgactccatggcacacacccctgacacattctcccacgtgggccaggagacacacacgagaagtttccaagcacctctgttcataacagcaagacgctggaaatgatgcaagtgcctgtgaacaagaaaggatccggatgccgtgagttgctcacacgtggagtacagtgcgctggtgggagaatgaatgaatgccaactgcattcatcaaggcgcgtgaatctcagacatgctgtggaggggaacgtggaggccacagaggaatacatagagtctgatattgcgtatggaaagttccaaagaaaaaaaggccaaaatgatatctgtaaaatttgaaaaaaggcaaagggaatccatgtattgtttaaggaagtgagcaggtgacagtgagtgctagatagagcgcgggaattgcacgcgcagaccccgggtgcctctgcagggaggaaggtggctgccgggggccgctgggggcttctggagcgttgagcgttttgcatttttcttcgtggagtttcgtttaaccttgcctgtacagtatgcatacttcagggatgaagttccatcagaaagtatgcatggatctaaagatattcgtaattgtacaaagaaggcaaaacacccccaagaatatgtatgcacgcatgcatatgtgtatgtatacgtgtacacacgtatgtagagaaacccaacctttcatgccttcgcctgcagctgtacctggcgagagatgcagctgctatcaggtaaatggcaggtgcttgttcatcttgcctctgtcagagatgggggctacaggtaggcttcctttcccctctgcgtttccctgatcagcccagccctgattctctcctgcccagcacgtgtgagttcccatactcagcagcaggacgccttcaaaacccttattaaagtcctctctgtgagaacacacatccccacaggggccccaccaccagcacagacccctggttcccaggcaggagtcgcaggcaacttccccaccaccccatccagctcccctcctgggcctgtgtcacgcccggacgccgcctccttcctggatcttgggcagaacgctcaagacgctccccttctgtgatgccttcccagtgttcacgcccctcgccacccgccccccctcccccacctcccatggcaagtaaatttggaacgaggcttctcgttccctttcagcagcagcccagtttcacactgctgagtgctgcaagaactgaaaattgccttttttctccattttcagtagaaacgaaggcagtttcctaaactcccccattcatcctggaaggcccatcctgggtgcttgactacctagaaattcttcctaaatggctagaggagtgaaggagtctcagacgacacctccaccaggacaccctcccatcttgccctggggccagtgggtcccttccctttgtacattcttagcctttttgaaatcatggtttgaattagacccaaaataaagaatggaatgataaatgcagaagtagcccttaaaccagacaccctctgtttctgtcccatgtcactctgtccttccaaacagcccagaggtgaggcagtccctgaaggataggacgtgggtcgtggggtggtaaccaagtacccagggctgccatggggcattgcagggaagatggggaagcagggcaggtggggagcagcccagggctctggctggagtgacgatgagttgagaaaactgtcgaggaacgggtaatgccacagccctgcaggctgctggccccgcctcaccatccccacagagaacaaggccaacaccaataggtgtccgtgaacatgccctttgcaacactgataaactcccctttgtgagcttctgccaaccagccttttcctgcagttttagcaccagcctcaggaagtggcatttgcgcttaaatctgagaacctccaaactccttttgaaagctgccacttttcttgcattctgaagcgttggcttcacatgtgaaaaggcaattcttgggttgtggagattttgaaaggctgcatttgcctcttagtcactatggctctaggttcagcctttttctggacgttcaaagggatcagggtgcatcatttgctggtttttaaagaggctggagctcttctgatcaccgtgccccatagttccatatggaagcagtgttcttcaaaggaccatttgtttttcaaattcagagagttttgagctcagaaagatttccgtcattcttggcatgagtcctgtggatccccacaggccctggaatggagtctgtgggctctgagagctgcttaaaagatgcagaaagcccagaggggccggcaggggtgcctggttttcctgcacgccagccccatgccgtgttctgtgctctgggctggcattgtgccggctgccccacggaattctccgggcctgtcccatccgctggagccgatcagcagctctggctggctttcattaatataaaacggagagtcgaggattactttacaaatgtagcctgcttggaaaaccatcatccttggattcagggagagaagaacaaaggccagcagcctgtttctagcttctgagtttgcatgggagaagctgagatcagggacagtgggactggccgggggcacaggcgtgtcatgtgccaccctgactgacagacctcctggccttggcatcagtggcaggagcaggtcacaacattagactcataaaaccaggcaataattcatttttttgcagctgagcagcaagaggggactgggagctgagtttgcacgcctcgtattaagaggtgaacaagcctaagaacaggcaatgctgatggaattttaggggcaccaaagctcccattggtcccataactgttttcttttcattgtggtcaaatacatgtaatgtaaaatgtgccattttaaccatttaaagggggaataattcagtggcatttagtacattcacaagtctgtgtgaccaccaccgagacctagttaaccgccccaaaaggaaccccgaacctcctggcagccgctcccctcacccctccctggtccctggccatccccagtgagctttctgtctctatggatgcactgattccgtatatttcctataaataaaatcacagaatgtggccttttacgcctggcttctttcactcggcgtcatgtttgcaaggtttatccctgttgtagtgtggatctgtgtctcattccttttcatgcccgaattatattccataatatacatattccatattgtatattatggaatatacaatatagatatattatgtatatctatatacatatacaatatacaatatagtacatgtatatacaatatgcaatatagtacatgtatatacaatatacaatatagtatatgaatatacaatatacagtatatacaagatacaatatacagtatatacaatatacaatatagatatattatgtatctattccattctatcatatatcccgcatcatttgtacgtgccacgttttgtttgttcattcaccagtggatgtgcgttggggctgtttccaccgcctctcggccatcacggatggggctgctccgagcatggctgtgcgtgcttgtttttgcctccctgtgtggtggaattactgggtcacatggtggttgggtgtttaacttactgaggaacctctgaatgcttcctgtgacccatgctggtttcttcacacgccaggtcatcatctttctgggggtctctaatttgaacagataaagccacctcctggggcctcctgtgaccctgcaacaggagtcctcggattcttcctctttcgctttgaaaccatctgccgtcagacctagcccagggctgcctttgtgtctgattcctctgttgggtgggccgtcccggagccttgcctcagcagcattgtccgagcagggctttgagaggtgggagccggccaggccctctctgggccgcccggtgccacaggtccgtgaacaaacaacgcgaccacttgctgcagctccacgtggctgggccctcctgccaacaggtttcccttgagacgtctcccgtttcatcccagggttttcttgattgagtcccactgaccatggctaagcgaggagcgagctctctctgagcagtgaaattaattagcatgggtttgtgtttccattatctcgttattcaaaaccgtgccacatctttccagagagttcctggggactgtgttgtaagggttatttatagccgctggaatgaggttttgcgtaatagaccgcgtttagctgagaggtttgtaatttgagatcaattctctgatcggctgcacacagatgagactaaatagcacgagctttcggctgtgaatgggtttccgggagcccgtggccctcacccccgtgtcgaggtgggtgaagcagggagagaggccctgaggaagcagcgctcctgcggctgatggggcccaggctcggccaagaggaggagggacagtagctctcagtggctccctgctgccgagtgctgtgtcctgcccacctgcagagcctttacatgaccccattttacagatgaagaagctgaggctcagggaaaggctgggtgacttagcccaggtcccagaactcagaggtgcagacctaccctccagaccccatgatcccccatcaggagctggggtgttcgagagaaaaagttcccatcgccaggtggccttggaagcctgcaggccccctacgtgttcaactagggagctcctcctgtagcccagtcagtagctgaaaatagtagctcttttcacaaagaggaaagaaatatcccttctggctgggtgaggtggttcgcacccacaatccaagcactttgggaggccaaggcagggagatcgcttgagctcaggctgggctacgtggcaaaaccctgtctctaaaagaaaacaaagaaaaagaaaaatctcttgcaaattagggtcagattccgatttcccacaagagcagctggcacatttacctttatctggcaaaggcagcaggaatcggacatggcgggcagtggtcaggagccctggcactgccttttctgtgtgactctgggcaagccactcagcctctctggtcagagtcaactgtggaaatgagcagctgctcatgctgccccacaggaacgcaaggatggagctggaaccagattcttctttctgaaaggggggctatatgttgtccaagagacagaatactcagtggtctctttctggccaccacatggggcctctcccgcttaaccccaactctcggaactggccagccaggctggcattaggcggtgctgctgcttcaacacagagcagagctggccactgcctgctcacaggatggtggcatgtcctgggggccctgtggtgtggggagttgggagttgcccttgttctccttggacaagccaggggtatacagggaggccatgccttcttccaagctgatctgctctgtttgctgacggccacaggcattttccaagaagtccctggacccgtgggcccagggagtaaatgctggcaaacaggccctagagccagtgtgtgcgtgcaggtgctgggcacagaatgggcacctgagggcagggagtggggtgtgatggtgaccaggacccagttggtcacctctgacttccgggaagacctggccaagcatgtacttggttggggagctgggtgtggggcaggcacatagggagagaggagccggaaagtggccaggttcttagaatctgccagctggtcacctctgaccttccacggaggctgggctcagagttcagcctggaaaccagttcatctgttaaaattcccctaggacctagggtacgtgacctgggcaatctgcagtacccagaccccggagccacattcttcccagacctgaaaaggcacatattgctgttggtgcccggggaggaaggcggatgtttccaggaaggccgcccccgtctgaggggccacagaagagggctgaggcctcagatccgagtgtggattttggacttccactgaccccggctatgtggaggggccaagtgggtgggcaccccttgctggcctgcccctccaggcacctgtctaggagctgcagacacagacgacatgactgggaactcaggtcccgagcctcatccttctccagggctgtgcagagatttaagggctttgcactgaaggatgaaaacagccgaagaacagggttgctcagagacatcacctagcgcacctcccttccgtatcttcctgctgcggtttgacccagtaacaggaatcaggactgcagaagcgcctgaggcccaaggagcagacggtccattccatcttgcacctgggcagctcctaaccccaagccaggacctagaagttacagaaatggtgaggatgaccacaggccctcaaagacacagacgcccaggaggggagtctgaggggtaattgtactgcaggacttggccccccacaaaggacctgctgattcaaactctgaagtctgcacagtaaggctgaggatacaagctagggccttttttttttttttttttttttttttttgagtcaaggtttcactctgtggttcatgctggagttcagtggtacaatcacgtgacacccccccacccccgggtcatatgatggcatgtgccaccacaccctgctaattttttattttttgtagagatgggatcttgctggattgcccaggctggtctcaaacgcctggcctcaagcgatcctcccacctcagcctcccatagcattgggatcaaaggcaggagcaaccaagcctgttcatgctaggatctttaaagagtgagtaggagtctcttcagtggaaaaggtgggggaaggatgggcaatggagccagaagagctgatttccagacatgggttgggctgatttttgagtggggtctttgctggtattggggtggctctggatgaccttccagctgcccccctgccatgcacacttcctggcagcagagcactcatgaagcagccccgatctgctgtcgtctgtctggggagcccgaccctcggatggttatctttccccaggattcttaactgagggtacttcatgccatctttttaccccaaggaggggggggaataataggttgttctagaagggtcatttaaatttgtgcttcctccttcctccttcctcgctggcttcaggcccctaaatccagctctagataagaaagtggtcttgctgccagcccacctgccgtcctggggcctgttgccgtgcagtttcctcgggttttctttgctctggttccaggaggaaaacatcaagaaatgggttggaaatctgcatctgtaactcaatttgtgcaatgagcccagggaaacgtgcagttgagctctgcgttcctcgtccccctccgcctccttggagagagttcgatatggacatgctccccgtgcgcctgatacatctgagcttcactgagcggtcagtagagtggaaatggctaaaaataaggccaccggaggcagccggccattaagaaatctgcaggagctcacatggctctgtggtcccagcgtgctaatcgctggagggtgagagaccagctgcattaggaaaatgcaagtgtggagtgtccagcctaaacatgagtggtcacaggggggcttcctgccaagggccctttcctagccactgagggtgcgcctgtcgcgggctcacccgcttgctgccttctgggcgtggccagccaggctgtctccgggctgggctgcaggaggcttcacttctcactctgggtgttcccacccccggggctcacaacgatggagtggccaggcctagcagggagagcatcttccagaagaggcatgtttactttaagatttggcatgacagggggctttttttatgtagaaagacacgtggccctgttaaaaagcgccatcccaggctcaagccctgcccttcactgaggattctcagagcctcccatcctcggagggctgctgcaggcccctggccctgccccaggctgcctgaccaaggcccatctggtcctgactgtagagcctggtgctgctgctggtgaatcccgatgggccctgaaaccgcggaacctgccttgtgactcacacgctgcccacacaccactgccctgtgtccagcacccttgtgtggccagtgcagatggattgggagggggccagagccaggccactggggcttccgtcccattgccaccctcagcccttctgtgcctcagtttgtcatctgtgaaatggggtgaggatcatatgactgacccccttcaggggccattgtgagacttcagtggttttgtttatgaaaagcactgcgtatgcttgcggcatgccgctatgctgtatgtagaatgcatgttgtatgtatacatgtgtagtatatcaacgcatcatgtatgacattggggaagctttgttgccactgctttcagtgcggtcctcattgtctctacacagcaaccactcaccaggaggtctcgggtcaggcgcctgccctccccaagccgagcgtttatgtctgtaaactggcgtgatcatagtgcccactgcagcccagagcaccagcaccacctctcccaggccaccccctggccctcctggactcactgtcccaaccattcagagggcagagggttctggagggtcctccacgtagctgtgtgccccacagttcccatctgccatgtgcagatctgccagagaggctgggaggagcagggagcgcagggtagccccccacgggcatccagcttcactctcgtgctcttgcaccgctcacttgtgtctcccagttttgctcaccatggaaatgccccaccatgggtgagagagcccttcatgggtgtttattaaaggagggaggagaagggagactctgcctgagcagctgggcctgcgcagagacagaggggctgtccctccctccaggctgctccctccaaggcaccgtctcctccccaaaccctcccgccctctctggcttgctgctggctctgcacacaggcacttggggcggcaggcagctaacatttcatgggcccctcgatgttacttttgcattgctgcagtgcctgtggttaaatatttgcataaataattttatcgggtcgttctgctctcctcaccccacttctgggtgccaagcaccatctgctcagcattcctgcggccaccaccagggcatcgggcaggtctctgcctgtcccctgggcaggggatggatcctgatgagtggagagctccacagacatttccttgcctgcaaattaggctgagaagggggactgtgggattctcctggcgcctcttgagtttttctgaaagcaccaaggctgttgggagtggggagcaggactggcccaggagagggctgcctagcatggaggaggcaccttctccgaggtcccagctcagtacctcactagctgtgtggcctgaagcaagtcactcaaccctctgttccttggtgtcagtgacacattattagtggctcacctgctcaagaatgatttgtgtgcctactgagcaaaggttctgctggactctgggtttactgcagctgtggaccagctgctggacagggtcagggtcaggatgtggagggacactggggatatgcctttctccttcgggcagctgggaagatgggctgctgccccagaggaggaagggaagcctggaggaggagcggtgatggctgtggcttggtgttggtctcaggacggcagccaagcttcctgcccacaactgctcatggggcctgagcctcgggctcaactgccatctgggcctggacccatctggtgtacatggcccatggttggcggtttctccccatgtcatggaagcatcacggaggtgctggcctgagccaagggacaccgtgcagagccagtagggctgtgaggggtcccccaccaccgcttcctcaggattttccttggggttttaccacctgtgttgatatcactaaacaaagctaacgtttacctgttttccagctttctgtaaatggacatttgccacctgcattctttgccgacctctgccacgggccagcagtatgctctggggttctgcctccccggtgtgtgtgtctcgtttattcattttcccacctgtgtaggactctatcatatgatagacagcttcttagtcgctatccaaagcctgtgggtccacgtgcatttcagaataaacatacatcatgcatgtatttgtttaatattgtaaaatgtaatgttatacaatttatactataaaataaatttcagaggatgtaacattttatgtattttatatataattccagtccaatcatgtcatgtaatcaagcacactgatttttctgcatcaaaatgtccaactattcagtgggataaatgcagagagtaaatacaggcgttgccaccagtataattaccgaaaagaagaggatgaaatgtttttgtttccagagcctcgtggaggtgggaatctggggtctggtgttgtgacccgtcccatcactgatgtgtctgttctcttgctgagggacgtgtgaccccctcctggtttggggggctgtaaacagaggaactctgagcactcctgcgtattctcctgatgtctgagtgtaggtgttaggagagcagctgctagatcactaggaggcaagtgttcagctctaccacgtggaggccgagacctctctgcagggagttgcattaggcccttcttgtgttgctgtaaagaaatatctatgactgggtaatttataagaaaagaggtgtaattggctcacagttctgcaggctgtacaagaagcatggtgcctgtatctgcttctggggagggctcagggagcttttactcatggtggaaggtgaaatgggagtaggcagttcacacagcagaagcaagagcgaaagcaagcaagggggagctgccacgcacttaaccagagctccggagaactcactcactattgcaaggacagcaccaagccacgagggacccgccctgagacccagacacctcctgccaggccccacctccaacattgggaattagatttcaacttgagatttgggcagggttaaatatccaaactgtatcagctgcgttccagccacctgggtggcaggtctcctggctccatgctgcagctgcccctgttctggttcagacctggcagcttttgtcaatctgggaggtacttaataatttttcattgccatttgaatgtgcgtttcctgattactaatggacttgagcatcttttatgtttctggactgtttgtggtgcctttgctgggaaattcttattctcatcttctgccagttttctactgagttgttcatccttttcggattgatttgtgttctttatatattctctttactggccgggcgcggtggctcacgcctgtaatctcagcactttgggaggccaaggcaggtggatcacctgaggtcaggagttggagacaagcctggccaacatggtgaaaccctgtctccactaaaaatacaaagattggccaggtgcggttgtgcacatctctaatcccagcactttgggaggctgaggcaggtggatcacaaggtcaagagataagaccatcctggccaacatggtgaagccctgtctctactaagaacacaaaaattagctgggtgtggtggcatgcgcctgtagtcccagctactcagaaggctgaggcaggagaatcacttgaatccaggaggcaaaggttgcagtgagccgagatcgtgccagtacactccagcctggtgacagagcaagactctgtctcaaaaaaaagaaaaaaaaaaattagctgggcgtggttgcatgcacctatagtcccagctactcaggaggctgaggcatgagaatcgcttaaacccaggaggtggagattgccgtgagctgagattacaccactgcgctcagcctgggcatcagagcaagactccatctcaaatatagatatagatatagatatagatatagatatagatatagatatagatatattctctttactaatctttagcttgtcttttcattcttttatgacaagtcatttctaatttaatgtagatgaatttatcaaactttccttcagagtttgtgatttttctgtcttatttaagaaattatcttctcccaagagtttgtaaagctgtttcccaatcttattttccaggagtttaaagtttgtctttcatatgtaagtccttaatccaagaattcagattgtgtgtgtatgtgtgtgtgttatgtgaggcatggatctaatttcactttttcccctgaggacaccccatccttccagcagcattggtggaataaaacacttttctccaagatcttccgtgctggaggcgtcataaaccaaacttccacatggatgcaggtctgtggtgtggctgtccgttggtccatttgtctatctgagcaccaccttcattacctctgaatatttctccccttcacccccaacccacccaccttttatctcttcaggattatttgagcaatcgttggctctttacatttccatatgcattttctttctttttcttctttttttctttttctttttcttttctttttttttttttttttttgagacagagtcctgctctgtcacccaggctggagtgcagtggcgcaatctcggctcactgacacctccgcctcccaggttcaagcaattctcatgcctcagcctcctgagtagctgggattacaggtttgcaccaccgcgcccggctaatttttgtgttcttagtagagacagggtttcgccatgttgttcaggttggtctcaaactcctgacctcaagtgatccacccgcctcagcctctcaaatggctgggattacaggtgtgagccaccgtgcctgctccatatgtattttccaatcagcttatcaagttacaccaaaacaaaacagcaacaacaaaccctattgggattttggttagaattgcattgacccagaatagaccaatttgggaaaaattaaccccttcacaatgttgtcttcctgttcaagaacatgatacattttctttctttctttctttctttctttctttctttctttctttctttctttctttctttctttctttctctttctttctttctttttctttctttctttctttctttctttttatttctttctttcgttctctccttccttccttccttccttccttctccctcttctttcttttcttttcttctttcagaatctcacactgtaacccgggctggagtgcaatggcacaatctcaactcactgcaacctcttcctcccaggttcaaacaattctcctgccttagcctcctgagtagctggaaatacaggtgcccgccaccacacccagccaatttttttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttctgtatttttagtagagacggggtttcaccgtgttagccaggatggtctcgatctcctgacctcatgatccgcccgcctcggcctcccaaagtgctgggattacagatgtgagccactgcgccctgcctacatttctctttcaaactggttttttaagtatctccacaaagagcttctgcaaaaccttttttagatttattcctaggtagtttcactgatgtcacttcatgatatatttttcagaattgcatttgctgattcttgctgaaatgtagaaatatggctggctttggtatattgatttttattttatccagccactttgctgaattctcttattaattctcatcttttatcgactgattatcttttttcttcctttctctttttttctccgctagctaggacctgcaataaaatgctgaatagaagtgggaatagtgggaatacctgctttgttcttgatctttaaaaaaaaaaaagctttcaaaatttctgttgactctagtcttttttttttttttttgacatgcagcttatcaggttaaagtattttattcttttcctagtgtgcaagagatttttatttaattgcaagcggataattaatttcctcaagtccttttttgtatcacttgcaaaaattacatggcttttctttgctaatgaattgtattaattgatgtttctgttagatcagtcttagcttcctaagataaacccgacttgtcatgatgtagtaatctttttaatatgttgccaaattccatttgctaatattgtgtttaggatttttgcatccaaggtcatgagtgagatttgtctgtaattttcctttctgaggccattcttttccaaccggagtcaagctcttgccagtctcccaagaagctggggagtgttctctctttttctccagaagacattgttcgggttagaattatgtgttccttctgcgatggcttgaccctgctcagaaagccatctgggcctcatgttttctttatgaaaggatttgcaacttctggttcaatctctttcaaggttacagaactcttcgagtttttattttttcttgtgtcatttgtgctaacttcagatccattttcagctccttcccagatagtcaagggctccctgccaagcctccatttccagcctcttcctctattcttctccaccttccaatacccttctctccagcccaacttgtgtggccctgaggtcattcgacaaatgacctcagtcattcgtcccgccccatcgcctgcagctgcaaacgggctccatctgcccctctatgggaccctgtctacggcacgttcccctgctggctctggactccagcgcatggccagagttctgcagcccactccacccctgagtgtccagaggggcagttagcggacagcattgccctgtgtgctgtgcagagacgaagcacagcttccaggagctgctgtcagacttggttggtgcaggggtgcccgcaaggcctctctcaggggttgcatctcaggtggggtctgaaggggtctggatcctgccactctggtgttggttggttggttggttgttttgagatggagtcttgctttgtcgcacaggctcgagtgcagtggtgcgatctcagctcaccgcaacctccgcttcctgggttcaagcaattttcctgcctcagcctcccaagtagctgggattacaggtgcccaccattctgcccagctaatttttgtatttttagtagggatgaggtttcgccatgttggccagactggtcttgaactcctgacctcaggtgatccacccacctcggcctcccaaagtgctgggattacaggcgtgagccactgcacccggcccatcactctggtattttctgatatgcctgctcagaagtcccatgaggactttgccaggtaaagaaaaatctcttatcctctctaccctctctatcctctctaccctctctatcctctctaccctcttatcttaccgccgccagctccactggccgcctctcagggggctttccctgtgagccccaaatccatggtgtggcaaagaggcaaccccttcccagggctcctccaggtttcctgtgtctactaagtacttgctgcttcttggcatctccacagttattatggggtgcctgggtagtggaagggagtagctcaaaggcggggggcagtgggtggagagagaatgagggacagggaggagtttcccctggcggcgggtgctgagcctggcatgagtgccaggagtaatcatgggctcagtgaccttgtgcccattttgtgcgaaacctgctcctctgtgctgctgcgcccctgagtctggagggaacagtcaccccctgagcaccggtgcacaattattcagctttgttcatagggtctgaggatgtctgcgcttgcaaaacagatatagaccagtcacccccgagcaccggtgcacaagtatgcagctttgttcataggatctgaggatgtctgcgcttgcaaaatagatatagaccataggagacctcagtcatgggaaaggccccttgcctccaagcctgtgcccatgttgtgccacagcccgacgcactgtcctctgttctctcctcctccgagaagcctcgatgattcctcacactgggggagagcacagctccagacagcccctgagtgtaccccaccaaagtgcccgtgaccccggagagagtggactgttgtggtctagaaggtgagccttgcagcagcccagggaaggcaggaaggaaggaaggcctgagggaaggggcagccaccagtccctgcgctgcactggccctgctgtcctggcagttgccctgctgggcctgccgcccccccgcatcaggattctgccctcagtggtttctacttcaggaaagtcctgcagtcctcttggcatagcaaggcctggtgggggtgggtcccagaccaggaccctgatgccccttccaaccccagaaccctagaacccgggtagggggtcctcagagctctttccctttgccccacccaccctggcctgtcccttggaaataccctggacagtttctctgcctggtgcctgtggctccttccggaactggtgcccatgcccctcccctcttggttcccaggcgccaggtctgcctgtgggaattgaagtcagcaggaggcaccatggcactgggaagcgtccgggctctggcccagccctggcccaggtgccccacagagcaggcggggaagggggctcgcctgggctgccaaacaaatcaccacacgcaggacagctcagcaccgcagagattgatcctcctgcagctctagaggccagaattctgaaaccaaggtgtcagctgggtggactccctctggaggctcttggggaggggccttcttgcctttcccgtatcctggcgaggtgcccctgatgccttggcgtggaggtggtcaccgcaatctctgcttcatcctcacgatgttctcctctgtgtttgcgactgaaaccccgctctgttttctctcacaaggacaccagtcgctggaataaagtcctaccctaatccagcatgaccttaccttaactaaatctgcaaagaccccgtgtccaaatcaggccacaatccgcagtttgagagaagggttttgtggctgggagctgggtctctctgagtcatttcctggtgaagtccacttctgggtgagcctcaatcttcccccgctacccggggcggtggggcctcccagcagctggggaagggctggcaagccccttgtgggtagacacgaattttgggcagatgccattcaacacggtccaggggaacctgagccgtggaagccctgtggttctcaactttccctcacctctcctgtgacaggggctgtaggctgggctccaggccacagttcaccgtcgccttcgcagagggttgtctgggccagcgtgtggttttcagagagagtgagccaagctgggtgagcctcataggcctcaggagcctcatctcagggataaaaactcgactttaaaagaagcctcagtcgctttataaataaatttattaaattccaagttgctgcagatggtgctgcgtatttttaacaaacgcagcggcctcggctggctgcgagggggcgcttggagggtggcactggcaccggggcttcctgagagggggtcggggtggacggccgggctgcacccttcaaactgccctcctggccaaagctgcctggagggccaccccccactccatccggtggccgatgtgaggggccagcctgggtttttcttgtaccctggcagagagcaagccttgggcccattggcaggtgagggctgagaggtggggggccctgcaggctgcagaaaccaccttggggaatgaggaagaatgaggcccacccagatgtgaagcctgccaggaaatgggctcagagagacccggctcccggctcccggccctgaagcccttctctcatcatttgttcagggtcactttttttgaaattttactgaggtaaaatgaaccacgaacatggggtccctgaaggtgcatgcagaggggcatgggctgcagggctggaggagcatgggtgggaatccgcagctgccttgggccatagcgaaagggcagacgcagccactgttgcttaggtgatgggcaacgaatgcccattagctcactcttcactccattcattcactcagtgtgtataatcagtgacatttcgaggttcacggtgttgttccaccacaacttttatccagttcccagtcattttcctcaccttagaatgaaaccctggacccagtaagcacctgagccccattgcccctgcccgccctcagcctggcaaccaccaagctacttctcctctaaaagtgtgtctattccaggcttttcatatactgttgatactcaagctccttgggttgacttcatgcagattttttccaaccaaacatgggtcaaaaatacagtattcgtggaatgcagaacccaccccacgtagaaaggaggctggcttttcatatacgtgggttcctcagggccaactgtgtgacttttgaatattcttggatttgggtctgtgctggggtcctgggaccgatctccagagtgcaccaagggcaaccgtgtgtggactcacgtaacgcgatctttcgtgtttggcatgaagtcgctgagcatcccccacgccccggcatgtcaaagctgcggtcctttttgtggccgaatcatatccaatggtgtgggtagaccacaactgttgactcattcatctgtggatgggcattgtttataaagtcagctgaggcacaataaaattttaaagaattgatgtgagcaagcagcgatttacgaatcgggcagctccaacacggcagtgcctaggaagaggccctggaggacatctggtccacccttctttctgcaagcccctccctggcacttgtatcccttcctcacaccctccacgtgggttcactcagcatctgacaccagcaggtcccacatgtgcatcagtcactattgtatcaccagagcctagaacagcatctggactgtagcaattcattgaatgaatgaatgaatgaatgaacgaacgaacgaaggaactaatgataacagttgcataggtccctccagctgaggccaaagggatccagattggagtccttgtcactcgagaaggtggacactccgtttgcccacaaagtcaggaatgtaacctgcccaaccctgccccaggcctcctgacactgaatgccctttagctcactcttcactccgttcattcactcaacaggagttggttgtggacagagctccctgggggtgttgtaggtgtgggaggtgccttcctgccactctagtattttctgacacacctgctcagacgtcccgtggggcaggcaggcgaggtagccaccatgcccaggtggggaaactgaggctgagtctgatgaaacagcaccagcctcctccaggaccactttggtgtaagagctcttgagcattccaggatccagatctagaaacaacatttcacagccccagaataaaaaaaggcagcaagaatgttcagattagtaaatatttaattactatatcctaccttcattcactgttaaatgcaacattcatttaaaaacaggctgtaggttagatttttctcaatgcagcaagagttctcagaactgcgtggagactgctgagaaattatagaatataataagtagaggagctacacctagccaaaaatgccaccaaagtcctacgcgtgctgggacagtgtgcgttcatgttggaaatggtgctgggaggactttgacaggcagcaggggcagccacaggccttccccgaactatggggccagacagacgtgggaagtttttcatgcgaggccagggctgggacccacccctccgatagctgcaggctcccttcgtgagtccctcctttcggcgagggtttgctggacatcttggggttgcatcacgtaggtgacaggcctgggggcagggccgaggaggctggaaaccctgagtgctaccccaggcgaggtggggatgtctgggtgtccctctgctggacatcgggtccctgaaggtgcatgcagagggacatggctgcagggctgaaggagcatggatgggaatccgcagctgccttgggccatagcaaaagggcagacgcagccactgttgcttagatgatgggccgaaatgggagggggctggaggagggagttggcctaaccacacagcccttgttctaagaggtgaagcaggccaggaccagggctgcacacatttgccctcaacggggggtgcagacagagggacagaggctgcccaagacccgccttgggcagaaggggggccaccgagatgccgcacggccttcagaaagactcccctggccgtggctggagggggtgtgctgggatgcagagctgggtgtgtgctgcttgagtctgtgttggctgcatcagattggtggccacgtcccacccaaaagcctgcgtggaagctccacccgagtcagcagaagtcctgcctctcactccgagtgggagcagactgcatctcctctcggactgacccaaagacagtgccagcctccccaggcaggacccagtcctcacctgccctggctgtcccctgggggaccagcgacagctgcctctgtctttcccctgtcccctgcgtgcagagggaagacggagcaggtagagtgaggaggccggcggtcagcacacatcaattcacagcctgagccacaggagagtattagaggcttgacagggactgggcttcctgcatgccctgtttaaatgtagtctccacacctctgcttgttattttttattatttttattttttatttatttattttttttttagacggagtctcgctctatcgcccagactggagtgcgatggcgcgatcttggatggtgccatctcagctcactgcaacctcggcctcccggtttcagcggttctcctgcctcagcctcccgagtagctgggacttcaggcacacaccaccacacccacctcatttttttgtatttttagtagagatgaggtttcacccttttggccaggctggtctcgaactcctaacctcaagtgatccaccctccttggcctcccaaagtgctgggattacaggtgtgagccaccgcgcccggcccacatctctgcattttaaaaaatgtttcaggagatcagtgtagctcaggtctgcccttgagagaaaacactatttcaggatgttttcacatggtcttcctgtccctttttaagttgttgaaatgtgttatgtttccttggagaagacaaaaatggagctatgatgttgctttttttttctttttctttttcttttttaagaaaagcaaatgttgtatctccagaagttgacagcgtttgagtccagggcaatgcgcttactcctgtaatttatctgcacagattggctctgtggattccggctccttcttctatcttttggttctttcttttctaccttcttttttcttttttttctttttctttttctttttctttttgtttgagacagagtctgtctctgtagcccatactggagtgcagtggcatgatctctgctcactgcaacctctgcctcccagattcaagcgattctcctgcctcaatctccctagtagctgggatcccaggcactcaccaccgcacccagctaatttttgtattttcagtagagacagggtttcaccatgttggccaggttggtctcgaactcctgacctcaagtgaggtccagtgatccgcccacctcggcctcccaaagtgctgggatgacaaacgtgagccaccatgcctggtctctaccttcctttttctgacccatttgtagaccttccctttccctccatttctttgtcttttccttttttaaaagataacatctactggggagagggatactaattataagcaatgaatctgccaggcatgaaagccttggccccaagaggagcctcgttaactccaggatgactctcagctcttgttttctgcacaggccgacctggggatatttgtgggttcagccccagaccaccacaggaaagcaaataccacattaaagcgagatgcacacttttttttttttttggtttcccagtgcatagaaaagttatgtttatcctgtagtctgttaagtgtgcaatagcatcatgtctaagcagtgtgcatatcttaatttaaaataccttattgctgagaaatgctagcaatcatcagagccttcggcgagtcatcataattttgctgttggagagtctcacttcaatgttgatggctgctgactgatgagagcggtggttgccgaaggctggggtgactgtggcaatttctgaaaataagacaacaatgaagtttaccacatcaattgacttttcctttcatgaaaggtgtctctgtagcatgcaatgctgtttgatagcattttacccacagcagaaattctcagaattggagtcttttctctgaaaccctgctgctgctttatcaactaggcttatggaatattctcaatcctttgttatcattttaacaatgttcacagcatctttaccaggagtagattccatctcgagaaatcactttctttgcttgtccctaagaagcaactcctcatccattcaagtttctcatgagattgcagcgtttaagtcccatcttcagctccacttctgtttttgtttgtttgtttgtttgtttagacagagtctccctctgttgcccaggctggagtgcagtgacgcaatctctgatctcagctcactgcaagctccacctcccaggttcacgccgttctcctgcctcagcctcccgagtagctggaactacaggcgcccgccaccgcgcctggctaattttttttgtatttttagtagagacggggtttcactgtgttagccaggatggtcttgatctcctaacctcgtgatcctcctgcctcggcctcccaaagtgctgggattacaggcgtgagccaccgtgcccggccagctccacttcgaattctagttcttctgctgtttccaccacatctgcagtgacctcttcccctgcacccctcaaagccatccatgagggatgggatcaacttcttctcaactcctgctcatgttgacatactggcctcctcccatgaatcacaaatgttcctaatgccatctagaatggtgaatcctttccagaaggttttcaattgactttgccgagatccgtcagaggaatcactatttatggcagctatagccttacaaaatgtgtttcttaaatatgaggcttgaaagtcaaaattattccttgatccatagactgtaagtgactgttgggtcagcaggcataacagcattaatttccttttacatctccagcagagaccttgggtgaccaggttcattgtccatgagcagtaacatttggaatggaatctcttttttctgagcagtaaatctcaacaatgggcttaaaatattcatgctgtaaatagccatgctgtaaacagatatgctgtcatccaggctttgttgatccatttatagagcacaagcagagtaggtttcacataattcctaaggccctaggattttcagaatgggaaatgagtaccagcttcaacttaaagtcaccagctgtactagcccctcacaagggagtcagcctgtcctttgaatctttgaaaccagacatcgatttctcctctctagctatgaaaatcctagatggcatcttcttccaatagaaggctgtcttggccgggcgcagtggctcacgcctgtaatcccagcactttgggaggccgaggtggaagggtcatgaggtcaggagatcgagaccatcctggctaacacagtgaaaccccgtctctactaaaaatacaaaaaattatgtgggtgtggtggcgggcgcctgtagtcccagctactcgggaggctgaggcaggagaatggcatgaacccgggaggcggagcttgcagtgagctgagaccgcaccactgcactccagcctgggcgacagagcgcgactccatctcaaaaaaagaaggatgtcttgtctcaattgaaaatctgttgtttagtgtagccaccttcatcaatgaagttaactagatcctctggagaacttgctgcagcttctccatcaagacttgctactttgccttgcgtgtttacgttacagaacacagcttcttttcttaaacttgatggaagttgctagcttccaacttttttcctgcaacttcctcagctcttcagtcttcatagaattgcagagagttagggccttgctctagattaggctttggcttaagggaatgttgtggacaatttgattttctatccaaaccagttaaaactttctccatatcagtgatatggttgttccagtttcttatcagttgtgtgttcactgcagtaacacttttaatttctttcaagagctttttctttgtattcacagcttggctaaactggtgcaagaggactgtctcagctttcagcctatctcagcttttgacatgccttcctcactaagcctaatcatttctagtttttgatccaaagtgaaagatgagtgactcttcctttcacttgagcagttagaggccattgtgtgatcattaattggccttatttctttttttattcccttggcatgtgaaataagagctataatcagcctaatttctatattgttgtgtctcagggaatagggaggcccaaggagatgggaagagacgatggaccagccagttgatagatcagtcagaacacacaacatttatcagttaatttctctgtcttatatgggtacagttcatggcaccccaaaacaattacaatagaagcatcaaagatcagtcatctcagatcaccatgacagatatcataatactgaaaaagtttgaaatgttacaagaattgtcaaaatgtgacacagagacatgaagtgagcacatgctattggaaaaatggcaccaacagatttacttgcctcaggccaggcacagtggctcacacccagaatcccagcacttggggaggccaaggtgggaggttcacttgaggccaagagtttgaggctgcagtgagctgtgatctcgccactgtactccagcctgggtgacagagcaagaccccatctcttaaaaaaaaaaaaaaaaaaaaaactggacgtgctcaacaatgggttgccataaaccttcagtttgtaacaaatgcagtatccccaaagcacaataaagcaaggggtaataaaacaagatatgcctctgcatcttttttataccttttctctgaatgtcggactcgctgttccataccattttgtaacctaccctttttttctgaacatgtggggaatattttttcctgtcggtaagcactgtcatccatgcctttgatggctgcgtagaatgccccagaccaatttcgtttttccctgactctcatgtttacagatgtacccgtggtgccgcgacaggctcctttctccagatcgctctccccgcttctcccctctgccccattagggcctgtctagttaggggtcctgttggccaggctgcctttagagaaagcatttagaggagggactggcaagtgcattgcttcatttcttggtgattcatgtggcgtggcatccctggacatctgagagaactgctttcataaagcccggcccagctcgccgtggaactctgtacggcagtggaagtgacgcaacaaccctagtgttgtggtcgggagagcaacacaggccctcagcaaagggagtgggctgcagaggagccatgggctagagtgtgaccccattttgttcaacaagagcactggcatgtgtctgtattcctgcatgtgcccagcggtgcatggagaatgacctcgaataacaatcttcggagtgacgtttgaggtcgtctctgggagaggagtgaggtgggggagggaagagggagactttgccttttctgcattattttcatctttcccaggagtgacgtattctgggatggcgtctctaggctctgcccactctgggggggtgaggtactggtgtccttccccgttccggggagcggtaccctcgagacacctgcccactcccggctccagctgcgagccgtgcttccctcgccattcccctaggataagggtcaagagatataaataagggaaggaaatgcttttttcaaattgctaaatttctcattgccagttggtttccacagcaacggtgccagaggctggcgatctgtactgagagtctgcgtcccagcatgtgccccttggccagccatgcaggggccgcctcggagttagcttccgaggtctctgtgaagagtagtgtgtccaggctgcccagctctgagtgacaagctatgcagcaccttggggccctccttgccactagccccggccacgccttaagagaagccaataggtgaccccggccccagaacctccctcattcgcacctgcccctcctgcccccagcaagccttctaaggcgcaagtgatccttgtgcccagcttttaaagattcttccagagggtccctgaggaggcaccccattcccatcttcctgatctgcccccactgcccacctcacagctctctttcctcaagcactcctctctcccttgctgactcctgggcgacattcagtcctgacagttacatcctagagaagccttccctgaccttccccctaattagaatagcctccaccatgttacacaacccagggcaggcacctgtgcgattctccaagaaacttcaccacactcgtggctacttgttcagttgtcacttgcaggttgcaaactccacaaggtcagggttgaatcggtctttttcccagctgtctccctatgggaggttgtcattaaacagttcagatagctgttggatggatggatggatggaggaatggatgaaggatgggtggatggatggatggggggaggatgggtggatgcatggatggatggatggctaattggatggacaaatgcatgggtgggtgggtgggtgggtgagcaaatggatagatgagtggttgggtagttaagtggatggatggatagaggatgggtgaatgcatggatggatggatggatggatggctagttggatggacgaatgagtgggtgaatgggtaggcaaatggatagatgagtgggtagtggggtgggtggatgaatggatggagggatagatgggtagatggatacatgaaaagagagatggatggatgggtgaatacatggatgaatgaatgagtgggtgggcgggtggatggatgaatggatgtctggataaaagcaagcctgtccttattaggaacaaagaacagggaatgattctggtcaatttgtgttaaatgccaggtgaaattggagagtattgcagggcagtgtggcctgggacttagagctgtgaggacctggggcagctttaccgactggctgcttccccattcctccctcatgctgtccctgccccactctgccagtctgttctattgtcactggtcccaaattctctgcttcaaaaatcagcccatccagctggctctactggtcatccctgccccattggcagtgccctttgcatcagctcttggctttagcccctgccagccagtggatggaccacctgtgatcaggagcccaccctcgagtcaggcggtctcccagggcccagagcctggcaccatttcccttgagccagagtgggcgtgctgtggcctgagctgtgccagctcagaggggctgcgaggcggtattcaccatgcccccacacacaaaatccagtgcatccaagcccctggggtggtagccacggagctcaggggcttgtcctccagcccttaggcctctgcgtctccgctgacgatctcaggcaccagcatgcaccagaccgtgccagcactgccactcttttcagaacatgtagtggaatgacacaaaacaattgccttcagggacttgctttcctggatcctttgtcaggcaggtcctgtgtaccgcagtgttttaaaatgtaggttttattattattcaggtatggcgagaccaacggatcagggggacagctgctaactcactcttcccaggaggtaggggaggccatgccttgggggccattcagggaagcacaaggtccattaggaggcagagggagaggggggaaatgtggacaggagctttaccatgatttctgcaggaaggagcagactaagtaggcagtgtaagtgggtttagcgttggcagctggaatcatttcagagctctggggcctagggcctgtccctggctgtccggtacccagccctggggtgatgggggcagggttagtggctgggagcatgggacccggatagaggaggggtggggtggcctctgttttagttggttagcatttgaaaatccagctctcaggtgagctgtttactttctctaggaattgcctgattcttgaggggccatccctccagggtcagcaaaaccctggatgccagagcatcagaaagagaaaataaaagacacagatgataggcctgtcacacgggatcggaacacagactcagccctgcatgtgattcgagcgccaggatgcctggcttagtaactacctcctaccttcggactcaccagacccgcaagtgtgcccttgatccaggccccactctcagagctggggacacatcaggggccaaccaagggcagagtggagccaaagcgctggcaggtagacccgagtcacaggcagccatcacggccgataattgaatggctctgggggtcggccggggatgagaccttgaggagcatgctcgcggtggctgcagagtcatgcacggtggtcaggccatgcccagaggttagagggaagcaggagggctgtgcagctgggctgagcaagctgcagagagtggcaagggagagaggggaggcatggctgggccaggccgtgggaacctgtgggccactgggccatgctggcttttacctgtgaggagcgggcagcccgcagacgttataccgtggggtgatggtgagatcttgttgggttgcggaggatcgttctggccactgggtggacaaaagactgcagaagggacacacagcctcgatggttcattaggaggctcctgacagtgagcgtggagtggacaggctccagattttatcctgagccactcaagatggagggggctcaaccccagtgaatttgggattcgatgacccggagtgcatgttttccgtgccatctgggcagctggcatttagctgcgctttcctggcactgccctccttggagccagaagtcagccagccccttgcaagaatcagagctcatgaaaatcgcacctgccagtattcaccgagcacttgctgtgctgtaggcacagggcaggactggactccctctgcctgtgccacagccccgaagatcagggcactgtggatgctgctgccacacgctggcccctgttctgcggctggatcttctggctctatcctggccctgtacccttgccctccaggtcaccttctcgccacatgctccctctgccagcaaggcctcctcccacctcttgcatcagttggggacatgctgctaggccttctggagtcagcctgggaatcccccatctttggagccatacctgagcccgtagatagatgaaggcatccccgctctggcctccgtaactcccttacatgttctcagccacagcccagtgcccctgccccagggccaggcaccatgcagattctcccccaatcttccctctgtcccccgctccatgtggctgtcagagtgctgagctgcacccccagccacagggcagcaccctggccccacgagcctgctgcaagcctcaggagagtgagctgcacagcagaccctgccagtgattcctggggcttctcagacctcaccaacacctgagggtcctgctcatcagacacgcacaccccacccccatccccagcccagactgactgactcagatcaccagggagagggcccagggtctacatttgtctaaagccccccaggtggttctgaagctccgccagcttctagaacaccaccatagcacacacagatgctgcctgtgacacgctgtgttttcggctgtcatctctgggataaggccccttcagggaccccgacagcatcggaagtgagaccctgcatccccacacccgactgggtgcccaccaggacctgtgaaggcccatcgctccagggccaccctcagtgaacgaggggagaggtttgcgtatcctcccgctgcctagcctgcacgcactggtcagatatggacctgagcttatatctgctgcctgccgcctctatagggagctcagagggacacactggctcagggactccacagggaagctgagtgggtcccatctgccgagcaggcctagcagagagcatctcaacccagccctcccgtcacttgcagatgtgtgcatgagctaattggatccggccggggctggcggcctccacggcattcagtcagcagtagtagagttagcggcttggaggccccggatgtgtggggacagttaggtggtcctttcagctggtgccaatgccaggccccttctcatcatgaggatggcggcattggccccctggggtggagcccctctctgctttctttgcaaggccttctctgactgatggcaccttggactctccgccctgggtctgtctgctgtctccccaggccaacccctcctctggcctcagctcttcggcagggaaaggagactggacctggcccgggatctgtcccctcccattgaccagcagctcctaggggaggcaggatggcctctgtgggcatgaggctcggggcagagctggcaaacatttacggccccaaccctcgtgtgcccaagagaggagatcaggagctttgctctacaggacattaaatcatagtccaaagagattaagtggcttcccaggggccataccgctcacacagctcagagctggcagagtgaggcttggggtgagttcctccagttccagggctggactctctatactcatggaatgctgctgtgtgcaccaggccccaacttcagtctttgccttcagctagctagcttgattgattgattgattgattgattgacagagtctcgctcggtcacccaggctggagtgcagtggcacgatctcagctcattgcaacctccgcctcccgggttcaagtgattctcctgcctcagcctcccgagtagctgggattacaggcacgtgccaccacgcccggttaatttttgtatttttagtagagatggggtttcgccatattggccagactggtctcaaactcccaacctcgagtgatctgccatcttcagcctcccaaagggctgggattacaggcatgagccactgtacctggcctagctagctttaaagtacagtgagttatggtgttggtgagaagtaaaaaaaaaacagtaacaaaaactgaagcaccaacaaccttaatgtaacacaaaatataccattcagataggaagatgccatctttgaggaaggcagaggcctttcctaaggtactggaacagccagtcaggtttgtggttttatttcagtgactacaagagcttttcttcccttgcccttcaaacgctagacttacttttgccgtcgtccctgatggagatcctcatggtgatttctggagaagggagtgccctgaaccttaatctattcttggtccaggtgcctcttgcccctagatctggcatcccccctccctggtggctcctcagaaggcctcgcagtgacgaacacttaggtgctgatgacggggaagagccagaactttgagagcccctggacctggtgggctccaggtcagggcagagtgacagaggagtgtggggtgtatacccacacgtgtgtgctgcagcatcctgggacccacagagggaacaggaggtgagccccccagggtccccccagccaaactggctccagactttgagagcagcacaggctttgtggtctcagggtggcatgaagatgtggcccgtggcctgctggcctcgctgttcccgcctgccccagccctggctctggctgggcagccagcagcggggaagcggcctcaggcctgaagagtgggaggaagtggctcctgtaaccgctgagccagtgccacggcgctgtccttggtcctggcaaaacaccactccctcctccttcatcttgagcccccgtgggtgccaccaggtgcccacaatttcttctggcaacaccgagcagacccagactgcccagacaaggccgggtccccagcagcccaggctgcaggcccacgccgctcattggcggtccaatttcatcctgcaggagggtaagggacgcgattgagcattctggaggctggcacggtctgcagtgacaaagggatgttcagagacaccctgctggtggccccctggacactggggccatttggggtacagggctgagctctcaccttgtggctcattacagggtcttcagttgcaaaatgtagccagtaaggctgcgctgtgcctcagcccagccaccccacgcccctgtttattaatgaccaaaagggaggggctggtctgcaaagtgtcccttcgcagcagcctggtggatgtccacggctttctgatgttctcagccttgtagaagtcagctgtgcacttcccgtggctgaggcattggcagcaagtcaccacgaacctggtggcttccagcaacacgtgtttattatcttagcgttgtgaaagccagaagtccaatgcagggctcactggcctaaagtcaaggtgtggtcagggctggtttctgctggaggctccaggagagcctgtttccttgccttttccaccttctagaggccgcctgtgttccttggcttgtggtcctccatctccagccaacagcgtatccctccaacttctgcttccatcctcacctctccagctctgctcctcccggctcctcctccacttatcaggacgcttgtgatgacgctgaacatcagggccatctccaggtcttcatcacatctgcaaagtcccttttgcggcttatggtcacacaggtcccagggattagggcgtagacatcttgcagccgtggctttgctgaccacagcaggctgacctgcacaggacaggtcccggggacaccgggggtcctgggatccggcccaggcccgggagacaccacctggggcccagctccatccatgcctgtcttacattcatgccatcaccgcccaggcctgggagatgccacctggggcccagcctcatccatgcctgtcttacattcataccatcacccaagactgggctttgccttatggggtggcctgcaagcgccactttctgggcagaaggaagggaagggatgtagtgccagctgcagcctcttctggctgtcctcagaggcagccaccattgtcctgtcccacagctgggccttttcagggacacttcatgctcctatgagggactttgatctgtgtttcatgtagttgctaaggtagcccagtgagctcactggctggaaatgattttcttgagaaatatgatgccccacgcccagcacagggcagggttggactggggatgcatccatgcccttggccaccttgccaggggtgagctggacctggagactgagcaagacctaatttaataaatcagagtagggcctagggtgtgcagccctgtgtttctactcccctggatccagcacaggcctcgttctcacctgcattcatgctcctctgtgttcaggttcccacgtccctttattcagcaacagctgggcagagggtggatggggtcgcccggctggtgctgaggtgtgtgggaatgcgctgtaaggggaggccgcccatcctgtggggaggccagggaagagctgagagtgacccggcagatggtctctgggctcattgcatccccgacatctaaaccatcatgaataagtaacatttccaaggaaagagcaatcatccccctttgagaagaaaaccaatctcttggttatctctgaactgggctaaaatcttccatgggccatcctgttgctccatttcatgtaaattagcagattcgatgacaccaagcatgaggtcacgcacctggctggttcatgatggtgtgagatgaaggttctgcctgtgagacgtggcccagggccccccaccttctcggggacacgctgtctactccacaggggaggaaccactgtcagtaccagaatggtgcaaatgaaggatgtgggcctccggagcccgtcgtggccacgagctcttgggccgtgcaatgctgtggtccaggatgggaaggctgtgcgtcgtgatgcgcctgtccccctgagacctcgccttctgtgccaacaacatcaccatcctcaggtgagcagggaaggtgccattcctgaaacccactcttgcggggctggaataaaagttcaaaagcaatctgcgttcctcctgtcttgggggagcaggagtctctgtttcttgcagcctgttgtggttctgggaagtacagtgtgccctgcaggcatcctgccgggattcgagtcctaccttggacaggcgccgtatctgtaggccgcttccctgtctgtgcaatggcgagagtacagtgtatgagatgccatggcaccgcactaagtcagtgtgtcttcgtgtgtctgagtcagctcaggctgaccacaacgccccacagactgggcggcttacacgggacgttggtgggctcacattctggaggctggaatgggagatcaagatggaacagggctggttcctcctgaggcctctctcctgggctcgcattcagctgccttctccctgtcccctcacaggtcatccccaccagtgtgtcagtgtcctcatctccttaaaggacaccagtcctactaggtcagggcccaccctaatggcctcattttaatttaatcagctctttcaaggccctatctgcaaatacagtcacgttctgaggttgtgggggtcgggactgtaacacaggaatggtgacccacagtttacctccgtttatcagcccacctggctgtggggtacagtgcagccagggcagggagccacgagtccagtgcctgaatgctcaggtgggggtgggcctgggtgggaaaccagtcctggcccctcaaatcaatctgttgcctcatctattttgtgcacatcaggaaaggatgattcccctgcaaaaggagtagcagcagtgcctgtgggcctgggggtggtcactggccaggaccccacgcctgttacctggctcaattctgcaaacccgcctgtggcttttggtccccatttgcagtggaattgaggctcagggaatcatgtgactttccccagcccagagatgtctcgtggtccgtgggtgccatgaagtggctccaccaaggagacaggcgtggccacggccctcctcactctccacatggttgggtcattcctggtggtcttggggtcactggagaaatcatggcccctgcctggagctcggggttttgacactgatgatcccttatcatgctttccagaaaaatgcagctctgagtcactcttccttcctctcaccccacggggatcacgagtcctcctggggctgtctgggctccacggtgtcacgtctgtgtcactgtatccagactgagggaagaggctggcgtctggtgatgtggggctggggacactgggggagctcatccccagggagggagacagcggcgtggcctccgtggcaggtgcaggacgggcgctctcctgggctcccacagtgtcctggccaccccttccgctaactgcgtgatactcattatttctagagagccaccagcactcaccaggcatttaccacctgcctgctgtgtccttgttgctgactcatggcccccctcacagtccctcagagttggcagcactactgccctatttagtaggggagaaaagtgagggataagggtatgatgaaacctgtttgcaggggctttcgttgcctcacagcagccctgggcatcccagtcttactgatggggaaacggaggccctgggagagccaggtagcttcttcaggctggtaagggcagagttaggcctgggagtgtggggttttttgtttgtttgtttgttttttgagatggagtctcgctctgtcgccgaggctgcagtgcagtggcaagatctcggctcactgcaagctccgcctcccgggttcatgccattctcctgcctcagcctccccagtagctgggactgcaggcacccaccaccacgcctggctaatattttgtattgtttttagtagagacagggtttcaccatgttagccaggatggtctcgatctcctgacctcgtgatctgcccgcctcggcctcccaaagtgctgggattacaggcatgagtgtgggttttttgactctaagtccagtgctccccactggcacggctctctccccaggaggtgcatggggtctgccgcagccgcttgctgtccctcgcaggagggctctgcaccacatcttcacctgcagcttccgtgtctgtacccccagcctctcctttcctcgtctgcatcccagcacctgtgacaacaaagggcttgtaagaagtgctgagggacaggtagttccccgtagacacaaatggcctggtgctcagattccaagagtctgtctgccaaaatttaagcccgtgaaatgctctccttgtggggagaggggggaacacatttccactctgggaaatgggacatgcagcacaccgaagctcattcctgactctcaatgctcaggtgtctccaccaacaaataattactgagcccctgacactgccaggctgcagcacggcccaggggattctgccgtaaggaattaaaacctaccagggccccagcctagctccgaggaacctcacaggagctcagcatcctccaccctatccagcccacgccccccaagtttgccaccccatcacccaccacgggcgggggctatgcagaagccagtcagcagccacctcacagccctagagtctccacacatctcatcctgcgccccccacccaccacctgagtgtcgacttacttgcagtctgtaaagcgctcacacattgcaaaacacatgtggaaacaccaaaggtggaggcagagggaatgataaagaaaagcctggtgtctcctccccaccccaggggactctgtgtccccgctttggggctgactctgttggcctttgtactttcttttttttttgaggcagagtctcaatttgttgccctggctggagtgcagtggcacaatctcagctcactgcaacctctgcctcccgggttcaagcaattctcctgactcagcctcctgagtagctgggattacaggcacccaccaccatgcccagctgattttttgtgtgtgtatttttagtagagatgggtttttgccattttggccaggctggtctcaatctcctgacctcaggtgatccgcccaccttggcctcccaaagtactgggattacaggcgtgaactaccacatccggctggcctttgtactttgacagtcaccgttgggtgaccattcctctgctgcccgcctgggtggcttggcctggaccccagtgtccttcccactcagtgtgatgtccttgtccccacccagagcagggagcaaggagggcccagcttgaatgcaccgcagaggatcagctgcaatgaaggctttgaaacagaaatgtgccctttgtgtgtgtggcttcctgtgtgtgagtgtggggatggggatggttgggcagggcctgaaggacagatgggactcatagcggggcctctctgctcagcctccgggtatcatggcaaaatgaagaggatggggaaggaaagcaaagaaagcttgccgggcagcgaggtttggggtcagagttttgtaaggctgccaaccataatggtttcagaggggcttccatgtcctgggtgtcctcgcactacagcaaacatgtgacctaatcccccagttcatagactgagacccccggtctgtgctccatgctgcagaacggcctggtccccagtgcacagggtggatcccatcagagccagcccctccttctcttcctgctccgtggtggagccagggctgcatgcagagtcagagaaggggaggggacccttcagggcacgccacccccatgggcaaagggacagtcactagaagtcccctggcaaagtgcaaatgtgtgaaaatgggaggagccatggccccagagtcagatgaatgagtgaaagaatgactgaatgaatgaatgggagacattaggtgatcagtcacagttgcagtgctgggatggagcagaagcaggcatcaagccagcctgttctcctgcctccaaagacccccaccccctaccctgatgttgcctctcccagtggggaaggtggggaatttagtgccctgtggtatgagttcccagcaggctgtggggagtgtggggaagctcagaagaaaggccccaaacaagcatgggctggctttgggccacacctccgcagtctgtgtcggcccatctggagattgatcagcagggtaaactgaggcagggtctaagagagattgggcaggggccgccatgagtgctgtgagccctgtggtcatagacaagaggaactggccgagttctccatcagcaccatgctgggggcttggccatccctcggcgctggtaggaggagatcagacttcctgagaagtgtccatgtttggagaaggacccgggctgggggccaggtgcatgggtcttggtggctggagagaaactggcatagcgccatccgcccctggggcagggtgtggagcccaagaccacatcatcagcccaggcctttcagggcccccagcgggttccgctgtcaccaggatggtaagtgtgccttgaagtcttcggtgtgagaagtactttgcatactctaagtcagacagaacataaaagtggccgttggctgaagtgaggtgtggggttgggggcttggggcatcggctggcgccccgtttcccctcctcaccctcaggggcagccaggggcttgcgtgggatgtggactccagctctctcccagaacctgaagcttgatctggtcaatgtaggaggggccactggggtcatcttcatgtcttggtcccagtaactcctattttctttatatcaaatgccatgccccaccccccccccgcccccacacacacagacacatggggcaacctctcctgtggtatcggtcatatcatgatacactttttaaaaactttattggggcataatcaatgtccagtcaagttcacatatttaaagtgtgcaattctataagttttcacgtgtgtattcttgggaaaccatcgccaaggtcaaggtgacaagtccatccaccagccggcttgctcctgcccccgccccccccccccaccgctggagtgaccacccagctccatcacagcccccccgcccccaccgctgcagtgaccacccagctcacatcacagccctgccccgcccccaccgctgcagtgaccgcccagctccgtcacatcacagcagcctgcaccctctagaacatcacataaaatggagtcacgcgactgaagctattttttgggttggttcctctcaggcagtgtgattattctgaggcgtgtgtgttccggcagtccgttccttcgcgttgccgagtgatgggccgtcatcatgtcgatggcccacaatttggtgaccagtcacgatcgatgggcgtttggttgcagccactccgacctaccacgcataaagttgctgtgaatgtccatgcactagacttggggtagttaggtgccttcatttctcttggatactcagaagaggaaagcctgggtcacgtgatagatggatgtgtaagtttgagagacggccaagcggtcttccaaagcagcctcaccatcttgcatccctgccagccacgtgtggcgggtcagcctctcctgggcctcgccggcacttggtgtgtgccgtctttttcatttggaacagtgtgaggtggcgtctcattgtgactttagctcacatttccctggagacccctgatgttgggcctcttttcttattcttgccaaccatccctgtgtcttctgtgaagccggaagtggaatgttgtggggaacagaggggctttctctccttgtttccctcttctctctcctcccttagtttccttcccttcccttctgtctgagtcagctaaatccactagggcaaaataccctagatggaggggcttcaaaacagcaggggtgaccaggcatggtggctcacggctgtaattcgagcactttgggaggccgagacaggaggatcacttgaggtcaggagttcaagaccagcctggccaacatggcaaaaccccatctctactaaaaatgcaaaaattagccgggtatggtggtggggacctgtaatcccagctactcaggaggctgaggcaggagaatcccttgaacctgggaggtggacgttgcagtgagccgagatcgtgccactgcactccagcctgggcgacagagtgagactccgtctcaaaacccaacaggggttgattttctcccagttctggaggctgaagcctgagaataggatgccggcagggccggattctggcgagggcctgtccctggtgtggagatggccgccttctcacgctgtgctcaagtggcagagggagaaagtggaagcgagctctctggggtcccttttataaggctaccgatcccatcacaagggctcagtctcctcccagaggcctcacccccaacaccatgccattggaggttagggtccaacccaggaatgttgcagagacatggacattcagcccacagcacccagccctacccctcctcctcctctctcgctttccagttccctctcccctcgtctccactcctccttggggccccctgatgccgcacccctccctctcctcagggttcatcacttctccctgcacgcaccaccctcctttgccgactcctccagtatcgacctcagcccttgcctgtaggggcctccaactgagctccctgcacagacacctggatcccctggttctgccccaaggacagaatttgctaggctcagctcacctctcctccctagacccaaggccactgtattagcctgtggggtcaggggaccactccagctcagccagctattgctggggtggggcacatggtgggggtagcatctagacttttatactggaaaatgaacattttatttcaaagaaaaagtagcacgatggtatccaagtatccaggacctgctgccatgccctttctctgcagaaggcctggctgggcccagtggcctagccgagagcctggcgttgattctctgcccttccattttcgggctgtggatcaccggaagtcactcagcctctaaggtgaatacccacaaggtatttgatgcttacttcatgctcacaacactgtccttggcccgcagcggggaggattaaatgccatcttctgcagggcaatggagagtcacaaacacgggtgcagatgcagagcccagccttgaccccagagtggacactcctgacctccagggagtgggggagaggctggacagggtcagagaggccttgggggaagccagggagagtcattccctagaatccgcctccaggacccagctgctgtggttttctgagcctcctggattgcttcagaagaaagaaatgctaacacccatgaacaccaccgcacaggagtgctttgacccccaagatgcagcatagttatgttatgcacaagataactacaagatttatgaaactgtccactctcagagccccacccatatttccagttgggtgacaagcagtgtatgtccctggaactgcacccatagctccacagggagctcagtgtgaggccctggtgggtgtgggccccgggtgtgagtgggcattgattcccagagggcctcggtctatgacaccccattccccactccccactccccactccagtacacccacatcctccagccccttggcactccctctcatggagccagctgggctgcagtgatcctggagggtgaccctgtctgaagctgcagcccacacacaccactggaggccgcagctgtggaggcagacccgggcctgcagcagagcaggtgaggagctagccctgtccaaaggaggagttcacagctcgggctgcccagggcccctttcagggcaaggcctccctggggagcctggcagtgggaccccggtcctggtcctgcagcaagcaggggtacctttgaccacagctcctaaagagagccagacagtatccatcctgggtcaggggcacccacgcgtgcaccctagggaggcgctggggcctgaagttctaccatcaggaattagaaataccagttttagaaaattaatcatcaagaacgggagcgacctgggccccttgtaaacccggcagatctaaaagagggaagggcttcaaaggggcaggactcctgcgggtcggcgtggccgccagccaaacctactttctccaggactctcggcggcaagccacagaagttccctcttgtcattcggtcaagccttgtgaagctgccatttttataggtcaaaaaacagtcaggtagcgacagcttatgaggcccaaccgaacagctcaagtttcataggtgaataatgtgcagggggagactcaacagctggaggcaggagtccacaatggtgctgggggcctgtctctgtctctcactcccttctctctctctctctatgtctctgtgtctctgtctcggtgagtgtctctgtcttgctctgtaccgtcgtccccgtctcctcgtactgacctcctgcccttgcttctttgtgccggcctcagccttttcccgggctgaggaaccccctccgtgctcacacatctgccagcatcacagccccccagggacaggagagcatcttccccagtagatgtagaggaaaaacccaggcaggattctgattggcctggatgaccatccctcaaccaatcactgtggcctgggaaacgggaacccctgattggccaggactgggtcactgggcactcctgagcccgagggctgtcctaacctcctcggtatcctccacgtggggaggggccacagaaaggagagggctgcggcaccagcagaggtaagatggggaagcggccggcagcgccacccatgcctctcttcctggggcctcatcgttggtcaaccccgccatccaccctctgcccagcacagcagcctacgagccgccttctccctcaggacccaggccctgctcactctgccagccccggagctccccgctccaccgcacctggaaaccggggcaagatgcgtccatgaggcgcatgagcaggatcaccccagacgctcccgagcctgaccccccaggaccccagcggcatggcttagccaccagcctcccctggggtcactacacacttaggctcgggatggcccgggggtttgggactgtcctcagtccgattggccctgagaggacagaggatccccctctctgtgggactgaggtggttcaggtggggccttcctgcagaatccaggacaagtcaaggcagattcgctttcctggctccgttcactgtaagtccagcggcaggagtggggcctgcatgctgcatgcctgaaaacggggaaagggcacatgggcagccttgaacatcttcagagaacgtgagcagtccctcggacgtggatgctgagtccactggccacacagctgcactcttgctggacacaggcaggcttctcagccatctataaacagctgggttgcggtgccaagggctcaagtcctctgtcagaaaggaaggagggggctgtctagccatggtggctcaaagaatcaaagtcttggagccacaccctccagagggtggtttatcttgcagaattgctccctgaacctggcttcttccagacggaccatgcctggcctggggcgcccctgcctgctactcgtggctttgctgaaaagaacagctcccggccgggaggaagtgggcggggggggcaggaatccgctgcccacatgggagaggggaggtgctgggagatgtatcctcccagaaggaacaacaactcgaattggctttggggaaattcaaacagtttctctccagctggaggctccaccaagaataagttccccagcttcacggagctccgaggattgcagccgcctccaagaatccattaaatgagttcttcagactcgcttttaatgcttttccgaggttattaaacagagaagttctctgcaaggagctttcagggagctgtgagagaggcaaggaggcttcacccaccgagtgaggcactgccttgcctgagctctgtccctaagctcacttccagggcggtttcgaagaggaagtgaagattcttcctggtgctggagacggcgccgcccctcgaaggatccctggctccagcctcctcagcttaagtctcgcggaagaggctgcagctacagctgcctgcgggcctgctttctaggttatccttgttggaagctttgccctgaccctttcactggatccattgcaggcaggatcggagccagactccaccaccccgctgctggcctcacggcagttttgcacccagcctccagtactggccatcagctgatggcccagacccatttcacatcctgtctccccattaactcttttgttgcccgtctcctcgctgagttttggtttgaatagctcagtccatttgacgtgtttgggttggacaaatacatagggtgtctgcagcttccctcccagccctgcagctattccagggtgtggcatctgtcttagttcgggctgccccagcaaagcaccacagacagggtggctgggacagtagacgttgactctcacagttctggagtccagaagtccaagatcaaggtgtctcagggtctgggtcttccttccatggcttgtaggcgctgccttctccctgggtcctcccgtagtcgtctgtctatgtgtgtctgtgtcctcatctccagttctttttttttttttcttttgtgagacaagagtcttgctctgtcacccaggctggagtgcagtagtgcgaccttggctcactgcaacctccacttcctgggttcaagcaattctcctgcctcagcctcccgagtatctgggattataggcacccgccaccacacccggctaatttttgtattttcagtagagacgggatttcaccattttggccaggctggtctcaaactcctgacctcgtgatccacccacctcggcctcccaaagtgctaggattataggcatgagccaccacgcccggcctcatctccagctcttataaggacaccagtcagccgggattaaggctcatcctcatgatgtccttttaacttaattacctctctacaggccctgtctccatatagagtcacacccttgagtaccggaggttaggtcttcagcataggagttaagagggacacaatttagccaatcacagcttcataacagatgctctgcagacacctctccatcaatcatagcccggtgtgtttaacttagagtagatggtggcaccacccgataacaatggtggtggcattcagcagcagctcagagggttccagaagcattcctccagcctcgaggggaaatggtgcctctggctaacggagggaaccatcaaagccgggtatggtttctttgatcgtgtttagccgctttgtggctgagtagagattcttccttcttcctgtccaggtaattaatgagggacttcaaaggcatgaggcttttctgctccaatcaattattcagattggcatatccaaaggtctctgaacaggaaatagagaggaaatggattgctaagtggttatgatggagactaaatgaattacttgttaatcacccttgtctgctctggtagtatctgtgcaagccaggatagctgctcggggcacactcaccatcaaacacgggaggggaagggcagggtggggtaaatttcactcttagaaacaccagaatttcttccttttcaggatcaatgtcacccatatcttgtcaattgtgactgcaaacttcagaaggactcagagtggaaagtcttggcaaccatgttgcggttcagacagtgggagccatgcttctgcgaatgagcctggggactggggactgtggtcccagccctggatttgatgaggggagtatccctgtcctgcgagggtgcagtgtcacttttccactcccatttggggtcaactcttaacagcatccctgagaagtgaggtggtgtaaagtcagggaagtgtggtctttgtcttattaaaaataatgcgatgagatggacgatggcagaagcttcagggtagaccatggagctcatcatggtatttgatatggcttggctttgtccccacccaaatctcatcttgaattgtagctcccatgattcccatgtgttgtgggagggacccagtgggagataactgaatcatggggtcattctcccccatactgttctcatagtagtgaacaagtctcatgagatctgatgattttataaggggaaacccctttctcttggctcccattctctcttgcctgctgccatgtagaacatgccctttcccttctgccatgattgtgaggcctccccagccatgtggaactatgagtccattaaacctttttttctacataaattacccagtcttaggtatatctttatcggcagcgtgaaaacagactaatacagtattactctttacattgctttatgtttgcgattttccattagaaaaggaacttgaaaattaaaaaaaataataataataatgcctacttctgctccaacttctacttgtggccaagatggagaaacagaaactggatttacctttcctcatgaaacaactgaaagaaaagataaaatatataaagtaataggttttacaaccagacaccaggtaataaatgatagtgatcactaaagcatgagaaacagatgggatgagccctatacttgccccagcttcttgcactgagcgtttccaggctgtggggcagggagagggaactcaggcagagactggaagaacatccacattgaagacattgaggccaggcgtggtggctcacgcctgtaatcccagtgctttcggaggccgaggtgggtggatcacaaggtcagtagttcaagaccaacctggctaacatggtgaaatcccatctctactacaaaaatacaaaaattagccgggcatggtggcacgcgcctgtaatcccagctattcgggaggctgaggcaggaagaattgcttgaacctgggaggcggaggttgcggtgagccgagatcgcaccactgcactccagccttggcagcagagcaagacttcatctcaaaaataaataaatggatggatggatggatggatggatggatggatgaaactgcttccaggtgacttaactacacccagaacaaagctcaagaccaggatacagaactacccagcgcccccaacaagtacaattcatgatgtctggcatccattcagaaattcccagtcttgcaaagaagcaggaaaatacagcccgtaaggaagagaaaaatccattatcaaaattgactggggattaacaccgatgttagagttagcagacaaggatattaaaagaatcattaaaactgtattccatatgtccaaaaagttaaatgtagacacagaagatattttgaaagcccactggaatgtccatttttaaatggttaatatgataaattttgttgtatatattttagcataaagcagttctttacattttaacccaaatcaaacttccagtgatgaaaaccacagtgtctgagatgacggatacacaggatgagatcgagggtagattaaatgttataaagtaatagtgaactcagagaagtctcaatagaaactatcctgagtgaaacacagagaaaaaaaaagaattctttttaaaagaacatcagtcagtgagctgcaagatagcttccaacagcccaatatacatgtaagtagagtccctgaagagggggcgattgtagggggaggggagaaaaaatacttgaaggctgggtgcggtggctcatgcctgtaatcccagcactttgggaggctgaggcgggcagatcagttgaggtcaggagttcgagaccagcctggccaacacggtgaaaccccatctctactaaaaatatgaaaagttggctgggcatggtggtgggtgcctgtaatcccagctatttgggagactgagtcaggagaatctcttgaacccaggaggcggaggttgcaatgagctgagatcgcaccactgcactccagcctgggcaacagggtgagactccatctcaaaaaaaaaaaaaaagaaaagaaaagaaaaatatttgaagaaataatgagggaactttttccaaatttgaagtaaacaatgaactcacacacccaagcagctcaatagactccaagcacaagacacatgagagaaaaagaaacaaaaacacacccaggcacataggattcaaattgctccaaattagagataaggacaaatatgttaaaagcagccacatggggataaaaggacacgtgacacatgaagacgaaagagaaagatgacagcaggcatagtgtcagaagcaatgccagtgagcagatcgtggacaaatacctttacagtattgaaagagaagaaaaaacagaattattcaacagagttatttcaacataattcaaacagaattatttcaacaaaggtaaaatacttttgaaaaatacaaaaggtttaatcattcatcaccagcaggtacactataaagaatatgaaaggttgtctttcagataaaaagacagtgcctggggtcgggagttcaagaccagcctggccaacatggagaaaccccatctctactaaaaatacaaaattagccaggtgtggtggcatgcacctgtaatgccaactactcaggaggctgaggcaggagaatcacttgaatccaggaggcggaggttgcggtgagccaagatcacaccattgcactctagcctgggcaacaaaagcaaaactccatctcaaaaaaaaaaaaaaaagtgaccacagatggaaatacaccaaggaaggaaggacttagctgcatggctatatatgtaaaatttgttttgtttaattctttcgaaagataactgtctttaaacagaagaataaatgtagcttggggattacgacatggaaagatcgtaggtgtgacaacaatggcacaaagtctaggaggggaagagtggaagtgtactgttgtaagttcttgtattgtacacgaagtggtagaacatcagcagtgataagttaagggtgtctactataaatataaattctaaagcaactgctgaaataacaaaacaaagaataatagctgataaggtgacagaggaaataaaatggaatcataaaaaattatcaacccggccaggcacagtggctcacacctgtaatcccagcactttgggaggccagggtgggcggatcacgagatcaagagatcgagaccatgctggccaacatggtgaaacccctctctactaaaaatacaaaaattagccaggcgcggtggtgggtgcctgtaatcccagctgttcaggaggctgaggcaggagaatcgcttgaacccaggtggtggaggttgcagtgagccgagatcgtgccactgcactccaccttagtgacagagcgagactctgtctcaaaacaaacaaacaaacaaattatcaacccaaaagaaggcagaaaatgagagaattggcgggggtgggcaaaatatacaagggacaaatgaaaagcaaaatggaaagaggacagagttaaacttcctatcaataatcacatattaaatgcagacgatataaacacccttattttaagggcagattcttcaagttgaataaatgctcacctccaaggagcactcgctttaattataaagacacaaaagagttaaaagtaagaaggtggaaaggcatataccacattaacactaatccaaagaaaactgggatgacgatattagtatcaaaatagattttagaacaaagaatgttaacagtattaaagaaggttatttcattatggtaaaagggtcagttctatggaaggacattaaaaacactaaacatgtatgtacctaataacagagcctcaaaatacatgaagcaaaaaatagacctgcaaggaaaaataaataaaactacaagtataatcacttctccttctgtaactgatggaagtgtacagaaagtcagccgggatataggaaaccatgaacaaacccatcaaccagcttgacttaactgacagttgtggaaagaatcctctgtgctttgttttcaagtgtacttggaagggttattaagataaaccatattttagtccataaaacaagtctcaataaatttggaactattcaagtcatacagatgtgagctctaaccaaaacggaatcgtattagaaaccagtaagagaaagatctctagaaaatcccccagatattaggaaagtaaatagtattattttaaataacaccgggatcaaagtagaaatcaaatgggaaattagaaaatattggaaccaaatgaaaatgaaagtacaacatatcaaaatgtgtggaatgcctctaaagtgtctgtaagggaacatttctggcacaaaatatctatactagaaaagaagaaaggcctcagatcactgcttcagcttctacctttagaagctaaaaggaaaagagcaaattaaaaccaaagtaaggctaagtgtggtggctcactcctgtaatcccaacactttaggagaccaagatgggaggatcacctgaggcaaggagttcaagaccagcctgggcaacatagtgagaccccccctgccatctctacaaaaagttaaaaactagctgggtgtgacggtgcacgtctgcagtcctggctactctgaaggctgaagtgggaacatcacttgagcccagaagtttgaagctacagtgagctatgattgcaccacggcactccagtctgggcaacagagtaagaccctgtctcagcaacaacaacaacaagcaagcagaagaagtgattaagctcacagcaatcaatgacatagaaaatagaaaaacaaggaaaatggagcaaccaaaagttggttctttggcaacgtcgagaaaatcgatgcactttgggaggccaagctgggcgatcacttgagctcaggagtttgagaccagcccgggcaacatggcaaaaccttgtctctactgaaatacaaaaattagctgtgcgtggtggcacatgcctgtagtcccagttactcaagaggctgaggcaggaagattgattgagcctcagaggtagaggctgcagtgagctatgatcacaccagtgcactccagcctgggtgacggagtgagaccatgtctcaaaaaaatagaaacctctagccaggctgatccagaaggagaaaagagaagacacacatagccaacagcagaaatgagagaggaagaatcctgcagattcctactctgttgaattgcctttgccctttatcaaaaacccgttcttcgtgtgtgtgtggggctatctctgcgctctcttttctcttccattatctatttgtctagcttggtgccactgtcttgattactgtatctttatagtaagtgggccgggcaccgtggctcacgcctgtaatcccggcactttgggaggccgaggcaggcgaatcacttgaggagtttgagaccagcctggttcaacatggtgaaacccatctctactaaaaatacaaaaactagctgggtgtggtggtgggtgcctgtaatcccatctgctcaggaggctgaggcaggagaatcgcttgaacccgggagttggaggtcacagtgagccgagatcgtgccactgcgctccagcctgggtgacagagcaagacccagtctcaaaaaaaaaaacaaacgaaaaaaagtcttggaatcaggtcaagttagtcctccaactttgtccttttttacagttgttttgcttactctagatattttgcatttcccatgaattttacaatcagcttgtccttttctaccaaaaaaaaaaaaaaaaaaaaaaaaaaccctactggggatgtgacaggaattacattgagtccatagatccagttgggagagattcagtctcctgccacatgatctaaaacctctccatttattgagatcttccatttctctcagccatgtttaatgcttttgctatacaggtcttggcacatcttttgttctatttattcctagtttgtattttttgaagatatggtagaggtattttcgaatttctgtttgtgatcattttttgctagtatatagaattactcaccggggtgtccagaggatccaggacattctgctccacttgaaatacaaccccaagccgagcacggtggctcacgcctgtaatccaagcactttgggagtctgaggcgggcaggtcacttgaggtcaggagttcgagaccagcctggtcaacatgccaaaaccctatctctactaaaaatccaaaaattagcttggcgtggtggtgtgtgcccgtaatcccagctacttgggagggtgaggcaggagaatcacttgaacccgggaggcggaagctgcagtgagctgagatcacgccactgtgctccagcctgggcaacagagtgagactctgtctcaaaataaataaataaataaataaagcaaccccccagaatatgggtggtctggggcaggaagaggaaagggctgttttgtgtgagggctctttttttggagtctgatcatctaccatttgggcaggaggggactgggcagggcgcaccgtcttctgttttggggagaggttacgatgcacgtcctccttggaggacagctcatcaattcctatgaaaatgatcgatgcagatgccctctggcccagcctctgtgctaacaggactggatcccacagctctacttgtccaggtgtgtccccaggaaagcgcgggccaggtaagctatggagcgcccagtgtgaggagtgccgtgccactgtcagaaagctgaggcggctctgggggtcctgctagggaatgatctcccgagtaagtgatttgaggtgaaaaaagccaggagcagacagactgttaactgtgttgctatttgtgtgagaaaaagaagcgtggtgtgtggaaactctctgaacgctctctgcattggtttcttttggtaaagctaaaagtgttctaaaaaaaatagggtctatgggccgggtgtgatggctcacgcctgtaatgccagcactttgagaggccgaggcaggtggatcacttgaggtcaggagttcaagaccagcctggccaacatggtgaaaccccatctctactaaaaatacaaaaaattagccgggtgtggtggcaggtgcctgtaatcccagcgactcaggaggctaaggcaggagaatagcttgaaccctggaggcagaggttgcagtgagccgagatcacaccactgcactccagcctggatgacagaaagagtctccatcttggaaaaaaaaatatagcgtctgtgaaatgagaaaattgttattaagagtctccgaaatgaggaaatcgttattaagaggcgtgtgtgtgcacattgccccgagcacatctctcttccgtgtgcagacgcgctgcaggccgactccaacgggggctgctttctctccatgcagcagctgtgctgctgttttctttcacgtcctccaggaagccggagccctcctgtgctctcctgtagctgcctcatccctgcgctctgggccgtcagtgtgtctttctggtcgcctcccgctcaggtgtgcacagtcctgtctctttcggttcactcacccagtgcccaagtgtagaatctggctctctgcaaaactcaggggcccaaggtgcatcaggccctggactgactacctccccacgtggcctcccagctagcatccccatgggggagcactgatcttgcctctgtgttacagacgaggaaactgaggcacagagaggtaagccacttgtctaagaccatccaagtgagagctggcagatccaggcttggaaccctggcaggctggctccagcctgagctccgaagctctgtccaggcactgtcttgaaggccagctctgtggcggtgacaggcacgactgggctgggtcgtgcacgccgaatgggctgagcccgatgctgacgcagggggaagccggctgctcccttcctgctgagagctcccgtggcattgtccagagggcaggtacaggtgtcccccacatgacatcaagcccacaagcccatggcctgacgctcctaccgaagccccagtgggcaggtgaatgagcctccagtcggggggccagggggctccccctcgcacacctccagatagaaagaacctctccgagaatccccagaaagacccaggcctccttggtgggcagctggacccctgccacggaacagccagagagcatggaccccgggccccctcacggtctcgcctcctctcccttctcccctggcatttccttgctcagcagatgaaggatgatcagagttcctggtggcatttgttctcaattggtatttaacatatttgccaaagactgtcattttgaaggggaaagtgttcaaatagtagcagtgactcagccccggctcggcacgcctgggagctgtggctgcagaaagcccagctgcagggtccaggtgggctcagatgcactgggcagctgtgtgcatgaagaaagccgcttgtccgttggaaacgtgcaggcccagcctcctcgggatcactggggatctccggaaccacttgggcctttgcacaggaaagcccaggtcagggggctttctgcttgtccttccagactgtgggaatcttggaggacacagctgtgagggccccccacccacagctcccccaggccccactgtcagctcttgccctggccccgcggtgctgccagcctgctccctgctcccggctttagcagcaagaccgacatcaagctctggaatgagcctcccaagggtcacatccagcctcagagccaggactgccaactccatctgggctcctcccccactgctgagcatccagaacatctgtctggaagcttccatatggaacgccctccatgtgagtcccttcttaggaggaggtggtggttagcagcaagagcctcagggtgggctggcctgggttcagtccccgccctggaactcacatgtgatcatctgtttgcttgcttgctttttgtctgtaattcgtgagatcctgaggccagttgatagcttcattcccagcacccaggacacagcctgcatctaggaggcacttggtaaatattgagtgaagaggtgaatgaatgaatgaatgaatgaatgaatgaatgaatgaggcttttagtgcaatgcctggtatgtggtgagcacttgaaatatggaagtggttgggtccttctgagtcacaccagcaatgccactacatttatggccctggctttgtaaaaatacagtcaggctcgcctaggtgtggtgactcatgcctataatcccagcaccttgggaggccaagggcaggaggatcacttcagcccaggaattggagaccagcctgggcaacacagcaagaccccatctctaccaaaaaaaatttaaaatgagaaaaaatgaggccaggagcgatggctcactttaggaggccaaggcgggcggatcacttgaggccaggagttagagaccagcctggtcaacatggagaaaccccatctctactaaaaatacaaaaattagctggacgtggtagcacatgcctgtaatcccagatactcaggaggctgaggcaggagaattacttgatcctgggaggctgagactacaatgagctgatttcacaccactgcactccagcctgggtgacagagtgagaccctgtctcaagaaaaaaaaaaaaaaaagaaaaaaattagctgggcatggcggtgggtccctgtagtcccagctagtcaggaggctaaggcaggaggatcacttgagcccaggagtttgaggctacagtgaactgtgcctgcatcctggcaacccagcctgggcaacagagcaagacaaaaaaataaaggaaagctagagagagagagagagagagagagagagaaagaaagaaagagacagagagaaaataaatgtgatcaggctgcacgttaagtgcttatagcagctttattgccaaaaactggatgtagcctggatgtccttcagtaggtgagtggtcaaacaaactgtgatatattcagacaatggaaaagtattcagcaatgaaaagaaatggctatcgaggcataaaaaagaaatgaggtgtattgagtcacaaaatatatggaggaaacttaaatccgtatcattaagcaaaagaagctaacctaaacaggctacattgaaaacctgttgttcagtgtagccacctttatcagtgatctcagctagatcttctggagaacttgctgcagcttctccatcagcacttgctgtttcacctcgcacttttattttatggatatggcttctttccttcaacctcatgaatcacccttgctagcttcagacttttgttctgcagcttactcacctctctcagccttcatagacttgaagagagttagggccttgctgtggattaggctttggtttaagggaatgttgtgaccggcttgattttctatccagaccactgaaactttctccatttcagcaatgaggatgcttcactttctgataatttgtatgttcactggagtagcgcttttttgttgttgttgttcttttgaaacagggtctcactctttcacccaggctggaatgcagtggcatattcacagctcactgcagcctcaaacccctgcactgaagtgatccactgcctcagcctctggagtagctgcgacctacaagcacatgccaccatgtccagctaatttatttgttatttttcatatagatggggtctcaaactcgagggctcaagtgatcctcccaccttggcctcccaaagtgctgacattacaggcgtgagccgccccacccagcccagagtagcacttttaatttccttctagatcttttcctttacattcacaacttggctagctttggcacaaaaagcctagctttcagcctgtctcagctttcaacatgccttcctcactaagcttaattgtttctagcttttgatttaaagtgaatgatgtgtgacgcttcctttcacttgaacacttagaggccattgtagagttcttaactggccccatttcaatagtgttgtgtctcagggagtaaggaggcctgcacagagggagagagatggaggagtggacagtcggtggagcagtcagaacacacaatatttatcgattaaattcaccatcttatttgagtgtgttttacggcacccccaaaaaaatccaatagtagcatcaaaaagtatagatcacagatcacgataacagacagaaagtttggaatattgtgagaattatccaacatgtgacacagagatgcaaagtgagcacgtgctgttgggaaaatggtgctgatgggctgactctctgtggggtggctgcaggccttcgatttgttaaaaaaaaaaaaaatgcaatgttcgtgaagtgcaatgaagtgaggtgtgcctgtatatgacattctcaaaaaaaaaaaaaaatggagatagtgaaaaatcagcagttgccagggattgggggcagggagggtgaaagatggggcacagccattgttgggcagtggcgctcttctgtatggcactggagtgggggaacggggcgttatagatagttacaaccaacgaatatacaatgcccagaaggaaccctctgatgactgtggatttagttaattataatgtgtcagtatcggttcattaattgcaacaaataacagccgattcatgcaaggtgttactaacagaggaacctgggggaggggggaggagagggaatctgggaactctgaactttctgtgcagtgcaatttttctgtaaatccaaaaatgttccaaaatataaagtctttgttaaaataagatcaggtaggtccttgcaagctttgactcatggtggaatccaggattacaaggggaacccattatccgagaggacagaacaggtggaaaagaggccgctctggaaccctccctgaagctgcactgtgggtgatcatctgagcacgcattgacttttgaggccatctgagactggacccccttgggggctcatcaaagccaggctcttaggaggggaatggaatgttctagaagtggttggagggtcaaggaggtgcctgtgatttcttatcaggaggggagggttgcagatgttgtgttttctggggacaggggctggactcgggagttcctcccctatcagcacaggctgttcctaccatctgctccccacaaaggagaaggcaaagcaaggttgtcatccccagcggggacttcctgcagccagtccggtcagcgaccccaggccatttcgagttctctttcatgactttattcagattgctgctgacttcctgtccaccaggcctgtagcctcttctgcggcacacgcagggacccctgaatcacccattgcaagtgagcttatcccaaccccacctggatgaggagtgactcctgatgtgactgggctcttattcactgagggggtgttaactaatatagggatgtatcacacatcctgacttcaaccctatgtcacgcagatcatcactggaagctcaagtggcagggcagaagcaaacctctgacattgtcttgttctgctgcatgttcccccagagaggagaagcgtcttgctgatgatcgcatggccctcggtgaaagagcccgggtgccaggctcctgaccctgaattgacgtgcgtcccactgcactcctgcacctcacgtggctgagtgttccagtgactgagctgtcaggacaggagctgggaccggcagtcaggatggcagggggctgctggggatcgtcacagctgagttgtgtccctcaaaaatccatgcattagcgttccaatccccagtacttcagaatgtgactgtatttgaagacagggtctttaaagagatgattaagatcaggccgggcacggtggctcacgcctgtaatcccagcactttaggaggccgaggtgggcgaagcatttgaggtcaggagttcaagaccagcctgaccaacatggtgaaaccccttctctactaaaattacaaaaaaaattagcctggcgtggtggtgggcagctgtagtcccagctactcaggaggctgaggcagaattgcttgaacctgggagacagagactgcagtgagacgagatcgcgccactgcactccagcctggtgacagagcaagactctgtctcaaaaaaaaataaaggagattattaaagtcaaatgaggccattagagggggccttaatccgatatcactgtgtccttaagaggggatttggacacagacatgcacagagggatgaccacatgaggacacgggggaaggcggccatccaaggagagaggcctcaggaggagccaacgctgagatacgttgctctcagacctcagcctccagcctgtctgtggtttaggctgccctgtctgtgctctgttagggcagcccaagctgacgactagaggcttccggaactgggtccagcttagagggcaggtgggcaccagagtcaccctccgtcctgagacacgtgtgtaaggaaaacgtcccgatgcagctggacacggtgactcccttgcaccccaggctgtgtccgtcactggccccctgcgccacggagaaccctcgagccacaggtttaatgacgcccagcgacgagccccagaggcagcccatggtggcccgcggcttgcccaggatcagcctctgcctgtgtcatcttgggtagaaagtgacgaatcgcttcatagacgaatgcctggagattagagcctgggaaatgagacatctgatccccttgcagagttaatcgcttgctgttgggattaatttttcagttgttgtcaagttgaagcactcgataaatgactcgctgtgacatgggacatacaggaactaaattgagctataaatctccctgagcttggtgcacgagtgttccagggccctgctgggcaccaggagtcccaacctcccgaggcttggcctgggctggaggcgcccaggcattctctcagcttctctcctcccaggagaggcccactctgtctgctcgcctgtgtgcgtttgttcgcaggcagcctggctgtacctgggaaatgccggttgccccttccaactgtcacctcacctactcatattattcttcaaagccgaggtcaaagcctcctcctccatgcagccctcctgggaatcaccctgacctcaggcattgtcactggtaaacgtggtcttgggtactgcctggaattactcatcgcatttaagtttcatccatgctctccaataaaatgtacagaccccaggagggaggaagctcacacccccacgggctcccccgtgcctcgggctgggaagctggcagcacaggcttggcgcatagagagtctcgctccccagccctccagcctcaaggccatacggcagggtcctagcccagcactcctgactgtgcctgctacagaacccagagtccaggcctgcgggagtttcacatcactccaggccagggaccaggtggacgagcagagacaccacatccccaggtggggcccacagctgaggctaagtgggatatagggctatgcttcatgttgatggagcatatttattttagtgtcttagtacaaagacgtaactagcgcatcgttgtagaattaaagctctattcatgctcctgcttagtggaggcttgggaatttgagtgaaaaaaaccactgagtcagcctgaggaagcagccatgcctggaatgcaggccatggcaagcatcacaccggggctgccgaggccgggggtagataacaggcatgcggtcgccatcagagcccagatgctggggcgaaagtcaggtgtgacattctgcatgtggtaggaatgttttgagaattctgcccacaaattaagaggtagagctccactccccgtccacgcagcttagggtcagactggccgggtggagatgggggaggcggtgggagggagggggaggggcagcgggcagggcacagagcagaggctccagcctccgtctcaaggcctcgggaaagagcctcagacacatctttgaagctgaaagagccacatcataggcaacaccaggggaagtttctgtatgtgttttctccctcaaaaagaacatttgctgcagcagacacaggcagagtgagcacatgtgaaaatgcagaccctggtgaagcccccagcaaagtacagggatgaggtctcggagggggtgggagggggtccgctggcactccagccccttggccctccccgcttggccctcaggggcatcgccttctcagtgtccctggaccttcctggagagcgtttaccactgcagcgtggctgtttgggtccacacgtgtctgctcatgaggctagacaagttcctctccataaccatccatccacacctcgatgtttctcagacctgctccatggaggccctgaggctggactcacatttccaccacctctgggccctcctggagcttgtcctgccctgagattcacccgctgactgcctgggagagccccgtggcccaggactgaagggaggtttgggcgctgagcctacagggtatacccccttcaccaccgggcccctccccagggttctccttcacgtgggaccttcgctaacaacatcgctcagttcttagcccaccaacccacgcgaatccgggaccaaatgcgagccgaccccttggatgtggtctttcctcctgaacggaggcctcgccagcagatccagcagatgagattttcactgagcagcagtagcagtgggctagactttagtcttgaatagaaagaccctggtatagtgagaagcagggtccagggtgtagaacgcagcatttgccaaaaaccgaagagcatcccctgccccagcccacctgggggtacgcatgcagcaggctccagcaggggaggggtggcgtctgctccaagaccagctgtgctcctgcccaccctccaggtagggagggtctcctctgcctaactgacatggggaaagggctgtaaggaggctgaggtcgttcatggcagggatgtgtccccttccagaggtgctaccgggagtgggtctgcagcagaacacctgggctgctgggtgggcatagagggggtgggttgatggtgcctccctttccagggatacaggaaccccaggcaggagtaggaagaggggagcctggcgggagctggtaggcctgagctgctcttggcttcctggcttctggggtggtggccaagccggtgcggtttttctgggggaccggggaggctacagggcagtgccctgcacatggggaggcctcggccagcactggacagagccctgacagagcccagcaggagagagcccaccaagtcccccagaggcggtggctgcgagtgaaccggagcttcgctgtgtctttcgcaagccccttgcctggtgaaaaacccaaacatggaggtatggtgagaatcacgcctaaaatgcagctctgtttcctcgagcacctgtgtcggtgttaactgtctgtggaaaaggtctcacctccaagaggcatgaattccaacagggctgaagattccttcgaggtcctaatacattcgtcccatcccagggacagagctctgggaccctggtgtcccactcaagctccccagtccctggccggggacctcgggtcacttcccagctgagcccagcttctgagaggggagccacggcccccgcctgcccctggccacactgcctcgagcaccaaaggagaggacagcggaagcaacctcgcttcgcaaatgtcatgaggccgtcctagtcgatgtcccatcaccaaagaggaagcaggcagctccatttcctaaatacagaggagcacctttctcggccatcgggagcttatttttaagggcccttcactagggggaccagtgtgactgtgggcttggggtgagagaggcagaagaaacttgaaatgacccgcacctcatccatgtctggaagggatgcctttggctcagtcggcgtggaatcctttgttccgctgcacaggtcactgggggctgcggtgcttgcagcctgtgataagtacctacgtaagtcggaccatggtctcagggcctgtgtggtcagcatgagctttcacgtcgagcgcccccgtgtgcacagctgtgcctgggaatccatttcctggggctgctgtcacagcgtcccacagaccctgtggctagaacaacagaggcgtggtctctgacagtttgggggctagcagtctgaagtcgggatgtcagcagggccatgctttcccggaaggccctgggggaggagccttgcctactcctccagcttcttcctgctcccggtggctgctggcaacccctagcaccccttggcttgcagcagcagcccccatctctgcatcagtgttcacctggcctccttcccaccatgcgtgtccacattgtcctcttgtttgagaacaccaatgactggattaggatgtaccccagtgacctcatcttaacttgattacatctacaaagaccctgtttacaaataaggtcacgctcacaggctccgggggttaggacatggacataggtttgggggtaacacttttcaacccacaataacccgtgatcccaacagccagggttcagcacttgcgcagggcagcctctcccatagaccacacctgcctcctaggggagaaagtgacagcctctgttctcatccttggggactctggaaggggaaggacagagagtgggctccatgtccgggcacaggcgccggccagcctcccactaaactctagatgctgccctgagaacggagcccagcgggagacgggctgaggtcaagagcagggaagtggcgggtggacgggatgggacttgggctaggcagccctagaagcagagtctccccacctgggatcagggcagtcccagtaggaagggaaatccagccatccatcgattgttagagatggctgtgtgtgcacgtctgtgtcagaggctcttttcagaaagatcaaaatcacaggagaaaactggaagcatctatttcaggcagcgggccgctgagtggggagagcagccgcctgctccaggggtggccagtgtctgggcacagcccacccggatgctggcaacccctgccggccatccttgggaaggaaggcggagtgagagggcagtggctcccacatctgtccagtacaagccacatatgtcagcgcctcctttgcccagaaggctgcaccaggccaggccaggatgctgatgccagccacacccacagccttctagggcattctgtgtggctggcagggagacaggatgtttccggttctagttcaaactcagtgagctgataacaagcttatcttcactctgctgccatgaagctcagcctcgggcttgcaggggcttgccaagaacattgaaattctctgtctcgattgtgtctaaatggttatggggaccaaggattcctttagcagagttaatttgcacttggaagacaattacgtagagtaagagctcagcctttcaagtcagctattcaagcgggggtcccagagaagttgcttttcttttcaaatcagatctgtaccttcctcaagactgaggaatagctgtttgatactcagacacgctgtccagctgggattacaggcacctgctctgtgctgggctgtggggtgactagagctgaacagaagttaaagcgataggacaggtgcggtggctcatgcgtgtaatccctacattttgggagggtgaggtgggtggatcacccaaggtcaggagtttgaaaccagcctggccaacttggtgaaacggcatctctactaaaaacacaaaaattagccaggtgtggtgacaggtgcctgtaatcccagctactcagaaggcagaggcaggagaatcgcttgaacccaagaggtggaggttgcagtgagccgatattgtaccactgcactccagcctgggcaacagagcgagactctgtctcaaaaaaaagttgttaataaatacagtttttatccaggactattgcggtaggggagtagcagaatattgaatagggaggagacttagtacgggataggactcagttcctaatactgcatgggctagtggggatttagggcccaggagtgggtgggagtgagagggtggaaaattcctgagtggaagcatcaagggtgagggagattctgggtaaactgacctaatgggattcttgctgcaggcaggctggggtgagcagacatcccaggtgggggtgggaggtgagcggcctgatcaggtatccagggtcgggagttcttgctaaagttggatttgatacggaagcgcacagatggactcaggagaagtccagggagtctggtgaagcaaagaatcttaatcatagcttggcaagcacagagctggccaaggcaggatgccccccagaaggttctgcagctggaggaacctcgagggcctgacacgctggagacacccagagccagcagggaggtgtatgcattgttcccccttgttcccagggaggggactggggcagcccagcatctgccaaggccagcaaggcagtggacaccctcccaccaaggcccaccaggggtctacaccagcccagtcggcagggggaggcttcaatgggactgggctgtagcatgagggtcagggaagctgggagggtctcgatcttgaggaaagactgaccaatgaggcaaggtgtctggactctcgacaacttgacaacttggaataataaaaaagcatgcattggggtctctgtccctagttcctggcacagaactcttaaaacctcttgaatttcctgtcttttatatgttaatgagatgatacttaggggaggcggaggctagatagcttcaggatggcaggggctggtcaccagaaaaaccaaccacatgattctagaggtgcagaaggctcaggaagaggggctggaggttgagctcaattgccattggccaatgattaatcagctgtacctaagtattgaaacctccattaaaactctgggcgcagtggttcacacctgtgattccagcactttgggaggccgaggcgggcggattccttgagatcaggagttcaagaccagcctaagcagcatagtgtgacccccatctctacaaaaaaaaaaaaaaaaaaaaattaaataaataaatttataaaaaacaaccaggcttgggaggttccaagctggtggtacccaagggggtgtggaagctctgcaccccccatttgccccgagcttctcttccctgtgggctgttcagaggtgcagcctccataatcaactggttgccataagtgatgcatgttcccgagtattgtgaatggttctagcaaatatcagacctgagcaagggttatgggagctctgactcgtagtcagccaggcagaagtgtgggtcatctggggagccacttcttggcaactggcctccgaggctggggcagtcttgtgggactgggcccttcgcccgcagggtctgcactgactctgggaggtactgtcagaattgaactgagcagtaggacacccagctggcagggattagagaattggttgatgttggaatgatgtatttggtgtcagaaaaaaatacaacaccagctgtttaatgagcaattaccgtgtgcaggcgccgtacggagggtgtgcgtgaattatcccgtcccagtggccttagggagacggtgctgtcactgagctgctctcaggggagaaaaccaagaccccgaggtgaggaccctcagctctgcagtgggcgctgaggtgggcgccatccaggagagagcgtgcggtggctcggggcctcccagagctgccctgactcccctgcttggccagcccctccctgggagccccaccccagggccagcaaaggctgcagtgagtcaggggccgtgaatgtctctggagcaggagctgcagacaggcaggagctgggagctggtcaggaagacgagactggcacacaaaggagctgattagcaatgcgacgctgcctccggccagccggattaggagctcagacagcgcgagcccagggactgcaggagccacttccatccattctcagacaaaaagagacgcccacggcaggactggggtggtgatcggggaatcagagcgcaacccctcccaggccccagtggcccttgcctgccctggcctgggctcttgccaccggcccatcctcttccaagaggccatcctgtgcccgtgcttggcatgtgagagaagctcccgaggtccaccgccaccccagcaggagacacagcagctggcccatccccagaggccgcagccccacgtggtcccgcgacggtgtccttggtgctcacgtgggctcagaggatgcaatccctgaaggacctgtgggtggggacaccggtgccttgcccaggacagccccggtgacatttgctcctttgtggcatcagaagcctgagggtgggctgaggtctcgcctctgtcgtcgcagtgagactgcggtttcaggtcacagcagcagcaggggcctccccttttgtcgcctaccggatgaaagacctgtgtccctgcagaggtggccaccccgctcctggtcccaagtccatctgctggtccaggccagggagggggtgttgggatgggatggtgtctactgtgacctgagggcggggtggcccctcctgaccctgctgagtgcctctccctgggcagggatttgggccctggtgaaccatacacactgcacggcccacagtgagatccgtcagtcactctcccacgggcagctgctccgggtctcacagggacagacaggggcagtagccttgcccccctccaaaccccaggctaaacaatgacaattgctaacagctggtctggaaggtcctacgcgtggggctccacctttgggggctcattttatcttcacaacagctatgttccccgtagctgctgggactggcccattttccagatgaggacactgaggcacagagtgggcaggccggggctggagaggttctgcggccccaggactctctcctgcatgtggagagtggagatttgaactgggcctgtcatccccagggagaggcacaggatgggaggtcagggttgggttttccaaataggctgtttcctgacttctggaaagttgccttaagaaatgggaacgtgtctgctaacagcctctcgttgaggccaaatttggggggactgtgaggctataggaaaaagcaaactcagtttcttcccactatactctctcaacgcaatccacacagagccctcagtggccagatgagtggggttcccacacacagcaagcaagcaatcggttccctcggacaccagcaggtgcccctaattcaattcagttctgcactgctcacctggagagtgtgttgatcccatagggtgaggctcagtcccacaagatgggccccacgtcctttgcaggtgccaagaacaagccccaggttgtgacctgtgcctctgaccgaccagctatgaatcagggttcccatgatgcccttctctggttcaattaatttgctagagcagctcacagaatggagggaaatacgtttgccggtttcttataaaggatattacaaatggagtgatgtgtggggtgaggtacaggggaaggcgtgcagctttgatgccctgcccaggcacgccacccccaaggaacctccacgtgttcatctattcagaaactcctccaaaccctgtccttttgggggttttatggaagtttcattacacggacatgattgattcaatcattggccattggtgatcgactcaaccttcagcctctctctctcctccctggaggctggagggcagggcggaaaattccaaccctctaatcttgggattggttcttttggtaaccagcccccattctgaagctatctagggacccccagccaccagtcatctcactagcatacaaagacactcagcactctggagggtcctgagattttaggagccatgtgtcagtagaggagaggaaaaccaaatacccatttcacaacgcagactgtgtgtggctcctccgtgcctttctctaacagagcatcctctgatctgaaaggtgcccggccatcaaactgcagttccagttccatgaaaagcacatgcagttaccctggggagctcagccgccaccccacgccaggccggttgagggctctgcctcctcacccagcgcatgccgcccctgcccttctacccgcctgcttgctctgttcaagttctcatttgtgggattggtcagcggtcccgggggggcccccttcctgctgagatctccagatggggggacagtcagcccttgagatactagagaaatcccctgggaacatttcctgcctctcttcatggcagtggggaaactgaggctatggtgcccgggagttaggaggcccattggaaaccccgccagggtacaggcaggaagctgcgtgatcaggttgtcttgtgaaaatgcttctttgggaaccagcttccaggagtagccactcaggcccacatgacttctgagtcgtttgccaaccttcctgggctgttgggtttgtgctccaggaaggacctgatggttagagtggaggtgttggagagagtcccagagccctgcccagtgagggtcaggaggctatggccgtgtcccataagcagggctgagcacagcccacatgcacctccaggggctgtgctgcaaacgacacacatggattttctcacagttcggaggccagaattccaaaatcaaggtgtgggcaaagccatgagccccctctaggctctaggggagggtccttccttgcctcctccagctctggggctcccggtattccttggctgctagccacatggtgccaacctgtgtctctgtcgtcacacagcctcatcctcctctctcttctcatccctcataagggcacccgtcactggattcagggcccacttcagtaaccgaggatgatctcatctcgaaatccttaacttaattatatctacaaagaggctgtttccaaataaggtcacattggcaggtgccaggggttaaaggcatggacatatctttcgagggccaccggtcagctcactatgtagtctgtttttgtaacttctctgcaataactcaaccatgccatgcagcagccactcagcatttgcccaggcactactgggcactcagtggcccgtgcacagaggagtagcgtggatcctgggcagtaaaccccctctagccactgtcacggggtgtgcagaagcttctgagtgaggagctctctggtttgcatgggtcctgctctgtgccagctgccacgagaactgcaggctgccttccaagatggctgccctcagccttagggcagggtcagccccggcattggtggcacctgggactcagcaattctctgttgtgggggactgtcctgtgctttgtaggatgtatagcagcttccttggtctccacccacaagatgccagtagcaacacaagttgttgtcacaaccaaaaatatctcccaacatggctgaatgtgttttgtggggggcaccgtttcccccgcttgaaaaccactgccttaggccataaaccgggctctcagagccaagttggacaccaggctccacgccccacatctgtcagtgcctgctggcctcacccctgcctgcccagaggtctctggtgaggcccacagtcacctacacatctagtcatcactcaccgtgtcctagctggctcgtgcctgccagcccacctgctacctgcagaggtgactggccaggagggcacgccaggaagctgcccagccagcacagccagctgtccattttcttgatgaagccaaggatggttggtggggggccggtggctattcctactgttcccgccaggctgatgagtagggaaggcttagaggtgcagccaggctgacggaaggacaggtgttctcaggtgaaagggccagcttaagtgtccatcaccggtgcaggaggaaggcaaatgtggtgtatcccgatcagggagcatcgttccatcttaggcaggagggaaaaccgacactggctacaaaggcctcctatggaggacccttgaggatattatgccaagtgaaataagccagtcacgggagacaagctcagcactgaaccatcccagtcatacgaagcttctagagtagcgaagtccatggagacagaaagttggagggtgagtgccaggggctggggaaggagatggggagttagtggttcacagggacaggctcagtttgggaagatgagaatgttctggacattgtgtgttcagtgacactgaattctgcgctaacaggttagcgtgctgagttttatatctgagtttttttttttttttttttgagtcttactctttcgcccaggctggagtgcagtggcgtgatttcagctcactgcaacctctgcctcagcctcccgagtggctgggcgttgcaggcgcccgccaccacacccggctaatttttgtatttttagtagagatggggcttcaccatgttgggcaggttggaagttttatgttatatggattttaccgcagtacagttaaaaattaaaactataaagatgcagccctgggtggggctgacggggtgggtttcaaggcctccatggagtcagctcaccccccgtcgctaatcgtgaagctgcggccatgggtatcgtgtgtgtgtcaggctggacatgagactcccaggctcccgcgggcagggaggaggtggtaggatgagaatggtcctcatcactccgactccgcaggagagaggagccccagcctgccttcatcacctcgactccacaggagggaggggccccagcctgcctgggtttctcagacgccgtccccttgacctgcccgtgggcgccccgcttgctggttctgttctccttcttgcagagatgggtgagccctggcccctgctcttggggacactggcctgggggaggcatgtgagatgagacaagcatgcccataactcacggctgtggaatgaatcgtgttcccctggattcttacgttgaagccctaacccccattacctcagagtgaggtcttgcttggaaattgggacattgcgatgtgactggttaagatggggtcacaagggtagggcagcccctgatctactggcccacttccttgtaagaagagggaggtttgggcgcagacaggcacacagtgggaaggccaggcgaagatggaggcagaggggggtgatgctcctccaagccagggacaccaaggcttgccagccaccaccaggggcacaaaaatgcttggaacagaaactgcctcgcagtccccagaggaacccaccctgcccacaccttgatcttggacttcacctccaggactgtaggaacatgaacgtctgtggttaaagcacccaggccctctgctacggcccccccgggagagaagcgcactccctggaaaccccagcctgctgggtcatggctcatcccagctgaacgaggagagggtggacatgggtcagcgcccagattacatcctggtccccacagcagagtctgggcagggagaagctgggtagataagagcgccggagttgccgccagcctgtggtgctgtctgtgattgctcatccactcatgagtgagcgtggtgagtatggtgagtgagcgtggcgagtgagcgtggtgagcgtggcgagtgagcgtggtgagcgtggcgagtgagctttctgtgtgccctaaaccccccagaccgcggtgtcacagcacctttcccccgcagatctgttgggcaccccgactcggagtctggcccccatttgggatggaatgttctaaaatgttcttcatttactctactttctttaaatggagaacatcatttaatgtctccagtccatccaaggctgtcctgccagctgcgtttgggcaccaggtcatgccaggcccgcgtgtggcacagcctgctctctgtggcactggcattcggtgctgttgcatcctggggtcggccgtgcacgctctgccatccggcctctccctctgtgtgcatgggcctgcctctgcagcccttcttccttgtctgatttcctgatcctgatcctctgtgtgccgcagatccagttagccaccctgttagaactctgcataaggtaaaagtaaacccgtacatcggccccgagcgagaggcagagtagttctgcaagcctagtgcctgggtgccaggcttgtggcggccgacggggtaacccaggaggcttcctagcccacgtcctcttctaggctgcatctcagtagccaaggctaatggaggggtggttgatggtgaggctgggggtgcccctgagacagcactcagggctgcccccaacactcagccctccccaccgtctgtgcgtgcctcccgccccacccagtgctttctctgtgtggaatggggctgttccctggaggctctgccccgggggctgttctgccccctggctggtggatcttatctccccctggagcaggcagagccccagggaaccagcacagactccaccactgacggagcaagagtgacagccacctcctcctccatgcatttcctgcagcagacaggttagccccacgttatcctgctccttcctcctgaccagagctttactctgaccaagggccaggacactgcatgggacagtgggagccacctccttagcactggctcaggggaggacgcatccccagaataccatatgagccatgtgccacctgtgattttgccccatccagagcctggcacagaggcctagcgtgcagtccacaagaggcctggcaagcagtgtccactccactgtgcatccttggccaagcccctcgggacaaaggcggtggcctcagatcccctggtccctccgggtcactgtcggctaattctgggggaaggactggcaaggctgtttggaagaggtcagcgcccggggactccgtgtgggctgctggctatgtccacaggcagggctgcaggagcccccgggtggggtgactcagctttctggccttacccaggcctcaggctggggaggtgacagtgaccgcctgaatccccactggtctctgcccctcatctccaccgctcgctactgccccgtgggtgtgctgggcccaggatggtcacgagtgttcaagggtaacgcccctctgcaagtgagtgagctactttgagatcactgttttgtgacactcatggggtctctcgctgccctctcaatgtaaatccagctagggcaggtgactggccagagagttcctcagggcacgtgccccataaaatgcctcctggaagaccccccacgggcctctgtgacctgctgcagggttgacgtcggctacaccaggcctggccccgcacacacggtccctgttgccagcagaatgtcgagggtcccctccgcagagctgactcgtgcctctgcaggactgagccagggcccagccgcctatttcttcactttgttgggtgtgtttgagtggcctgggcttgccacaagtggctacaaacggggcagcttcaagcaaggggaatgtgttcccctacagtcctgggagccagaagtcagacagcagcctcacagggctgcagccaggtgtggcagggccccgtgccatcccaagactccggggaggaggcctcctgccacttctagcttctgggggctcccagcgttccttggcttggctgcatcctgtctctgacttcatctccacatgccctctcccagctgtgtgtctcctcctcttctgtctcttacgagaacacgtgtcattggattttaaaccaccataaatcccgggtcatattctgttgagaaacataattacatttgcaaagactttttccaaataaagtcatattcacaggttccggggactaggacatatcttttgggggctgccatgctggccctgggggcttctttcctaatgagcatcctggggggaggtttccctcctccgcttctcaggcctaaattctggaggggctgttggggacacccctgcaggggactctgagaggggggcgctcagggaacttggcagatcctttcaaactaggatctcagtgtttgggaggccctgagggagcaaaaggagcatgggcagaccgtgcccccacccctccccagcctcatctggggaaccctcttctagctgacgtacgacacaaagcccaacactcaacacggctcagaaaatgctgtttatttcctggagtaagaagggtcctctgctctgtcctcaccccatggttctctccttcaccaagagacactgggctgggatgagctcagaccagccatgtaccacagctcttggagaatgggcacccatgcagtggaacactacttggccataaaaaggaagaaagtgatgagacatgccaccttgtgggtgagcatggaaggggtgacactgagtgaaagaagcagatacaaaaggtggcacggtgcacggttccattttcacgaaatgtccaagacattggctcaagaagtgagagccaagcctgaggtgtctgaccccagctgaaggggagccacaagcctgaagcccaggagctcatgggagacactgagtgtgggaatcgggtccctgggagtgggccctgtgcccaccgcagccatgtgggtgcagacacagcctcaggatcggccggccattctgcctctcgggttcaccagaggccacagctgggcctcatggggacagctcgccagcctgggtggggacagccctggggtgcacagccacactttgctggctgtggagtggcctccagcctacagagccggcccacacactgacgcagctccggttttattttagaccaagcctcatctcagcttggtccaacggagttgaactttaacaaacaacaagcgtgatgagcccgccacaccccgccacttacagctggcccagcccctggcactgtgagctccgctcagaccacacagggcaggctcagcacagagccgggcagtgaggccagggtaaggaggtctcctgggtcggtgcctccagcagacctgggtgggcttcagcccagggtgagggcccccagggggcaggcatggtgctgtcggtggctggggcctgggggtgcaggtgtgtccacgtgccttggcgacagtgtgtgcacctgcagagagttgggccctgtagggctggtctggcttcaggcccagcccccacgcagccccctcagtcaaccagcctcgggtgagccacatgtccattctgggctatgtgcctttcctggggtctccggccagtcactgcttcccccacagcttaccaggccctgacaccttcttctcaggctcccaagcttcccaagtgcctgggcccagctccctgccagcggatggcccacccgaacctctcctgccccgtggagcacagggacttcccacagtgctgctgggtggccctgctgcagggctggcctcggtccccctgggtggccatcctcctgcccaactgtgcagcccttaaaggcggggccaggagttattcattccccagcgtctagcacaacacttgacctcacagaggcaacctgacagacatgagatgcaccagcagacagaaggacggggagatggacgaacagacagatgaatagactgatggatgatggtgaatggatgaatagatggacggacggacggatggatggatggatggatggatggacggacggactgatggttggactgatggatgatggcagatggatggatggatggatgatggataaatggatggactggttagactgatggatgatggcagatggatgatggtagataatgaatggatgaatggaagaacagagggatagagtgatggatggactgaatgatggaggatagaggatggatggaaggacagatggatggatggagtaatggatggatagagcgatggatggactgactcatgtgggaagatggattaggtgagcagatggatggaaaatggataatagagggtgggagggaggaaggtgttcgtgggaaccatccctggtcatgagcactacttcatgtgcctgcctcacctgccccaaagccagtcttccctccaggtcagctctgccctgttcaacatgggtgggaagcagagtgtgagagctgaggaccaccctgaccagggtcctggagccatggctcctttgtcagtgtttccccagccagaggcactatccacatctcctgcccctgcatagctaacgaacttgactatcctcatctctgttgggccgaagcagcttcatggcctgactgcactctcggtgaggcagacagtcaagggaaagaccgtcatgcagatcgtgagtccccacctcgccattgtcctctacatccctcggtctgtgcagtagtgtctgaagcgtcacctgaactgatgaactgtgtcactgtcatttatgggaagaagtgacatgctagagtgaagccaccagtttggactccccagcagtcttaggacactgtcattctttcatccagctggcatttgttgaagccagcctggctcaggggcaagaccacagactgcagaccaggacacctggggccttgtcccagccctgtgtcctgccctgggccctccatggtggcttctgtctgtgaatggggacagcacctgcctcccagggctgagcaaggacttagtgagttactgcctgatatggtttggctgcatctccacccaaatctcatcttgaattgtagttcccataatccccatgtgttgtgggagggaacgagtgggaagtaattgaatcatgggggcggttaccttcatgctgttctcatgatagtgagtgaattttcacaagatctgatggttttataaggggcttttcccccttttactcagcatttctctctcctgccgccatgtgaggaaggacgtgtttgcttccccttctgccatgattgtaagtttcctgaggcctccccagccatgcagaactgtgagtcaattaaacctctttcctttataaattacccagtcttgggtatgtccttaatagcagcaggaaaacagactaatacactgcccctctagggcagcgcctagcagatactggcctttactcctccttcaccaagagacactgggctgggatgagctcagaccagccatgtaccacagctcttggagaatgggcacccatgcagtggaacactacttggccataaagaggaagaaagtgatgagacgtgccaccttgtgggtgagcatggaaggggtgacactgagtaaaagaagcagacacaaaaggagacatggtgcacagttccattttcatgaaatgtccaggacaggccgattggtgcttgcctatggctggggaaggggagagtgaggactgactgctaatgggtagggggtttccttgtagggggatgaactagaggtggtgcttgcacaacactgtgaatgtactaaatgccatggagtcgcacactttaaaagtgtgaattttacattatataagctcatctcaattaaagaaatatgcatgtcccccaaaaagctgatgggagccagtcattggggaacagaggggcacccagcatggctgcggcagagggaacgccaggcaagcagggggaggggccagatgacatgggcccccgggttgtgattggagctaggttggacattctcagcagttctgacactggaataaggatgtagaatttgcacctaggagtctctgtatttgagaccttgaatcgattgtctttttaaaaagaagtccaggcacagtggctcacacctgtaatcccaacactttgggaggccaaggcaggaggatcggtttagcccgggagtttgagaccagcctagacaacacagcaagaccccatctctacaaaaataaaagtctaaaaatgtaaaatgtaaaaatacacataaaattcaccattcaaaagtgtacagtgatattcgacacaatcacagggtgtgcaaccatcaccttcttccggttcctggacatttccatcaccccagaaggaaaccccgtccccaagggccgtccctcccattgcccctccccccagcctccggcaacgtctgctttccgccgctgtgaatttggctactctggacattacatagaaatgcaatcatgcaaagtggggtgcttcgtggcttctttcattcagcatcatgtctctgaggctctccttgttggaacacgtgtcagcatttcattcctttctgtgagtgtcgcactgtatggctcgaccacagagtgttattcatccctctgtccgtagacactgggttgcgtccatcttttggctactgaatggtgctgctgtggacactcatgcgcacgtgtcggtctaagaccctgctctgaattattctggggttataagtaggcatggaattgctgggtcattgggtaattctgtgtttaactctttgaggaaccttcaaactctttcactgcagctgcaccattctgcattcccactaaatgcttttttttttttttccatggacaatggactgtattgggagctggcttcactgtgctgtgcctgcttccctggaagaggggctctgggcctctttctgggttgtgactccattttagagtctggcgaggaccaggggccctccctctaggaaaatgcacgcacacagacccacaattctgcccatagacttgaggcgtttgctgatgggccacctctgtgagcccacaatacctttgtgcaaatgtgagaaggccccccactctaggcaggcatgccagcagctgtgcacagcatggggggcagagcacagagtggacttgaacaccacccccagcagacccccttgtggagtgaacaacctacacagttgtccagggcagtcctgcctgctgacacccggaaacacatttatcttgcacagtatgggggcacctgccttatggaactgacatgttcctgagaacagctgctgccacaggaatttcagctcagcatgcctgaaatttcaactcatgctcagcattgagtttctcaatgacaagcaaaagaatcaaggagatttgtttccttgggcctctctgcccaggtgcagtgatccagagggaagaagcccaggttggaggaaaatgctcagagctccgtacccagcctctgtcctagagaggggcatatatcccagaactgtcactacacaccacggtccaggcagacaaggagagatctggtccctactgtcagctccgggaaggtttggcagagacaagccccagcacccagagctgcgaggcaggaaagaaatgtatggggagaagtggagctgcaaggaccccgtctcatcagtggggggccagccagcaagtgaccaggtgtggagaagccacttccagccccgagtgacatgcaggcccaggacttcccaaggcgctcagtgtctctgcgctcctacccagtccccatgccagccccgaggtgctgcttatccccactcctaggacgcagaggcgcagcaaaatgcctgtggccacacagcaaggcctggggacactgagatgggaccttagccctagacttgtcctcacagccctgctgcatgccacagtcaccctgcctgccctggcatgatcccaggcctccctggggcctcaccctcaaccgtgacctgggaacagtcgtccacccgcgaggcagtcagtctagtgtgggacaaagaaaaccccagctcacctctgccaagcatgcaccccaggctcaggcccccgggcgcgtgggtgcatttgcatttgatcctccaagaccccaaagagtggccccaccaccagcccccagcacagatggatgcaaaggcccagagaggcactcatggggctggcaggtgaggcgcctgggcctgggccatgcctctcccttttaaaaagttattattttaaatcatagtaaaatacatgtaaactctataatcttagcctttttgttttttttttttttttttttttttttgagacagtcgtgctctgttgcccaggctggggtacagtggtgccatcttggctcattgcaacctccacctcagccaccaagtagctgggattacagatgtgcgccaccaagcccgacgaatgttttatttatttatttatttttgtatttttagtagagatggggtttcactatgttgtccagactggtctcaaaggcctggcctcaaacgatccacccgcctcggcctcccaaggtgctgggattacaagcatgagccaccaagcccggacaaaatctcagccatttttaagcatacacttcagtatacttacattgttgtgcaatcgtcaccactatccatctcagaactttccatcttcccaataaacactgtccccagtaaactccgtccccagtaaacactagctcttcattctctcttctcccagccccgggcacccactgttctactttctgtctctgtggatttggctactctagggactgcagataaatggaatcacacagtattagtccttctgtgtctggcttatttcgctgagcatgatgtcctcaaggctcatccacgttgtagtatgtgtcagcacttccttccttttgtgtttttaaatttttttgagacagggtcttgctctgtcacccaggcaggagtgcagtggtatgatcatagctcagtgcagcctcaaattcccgggctcaagcaatcctcccacttcagcctcccgattaactgggattacaggcacgtgtcaccacacccggctagtttttaatttttttgtagaaatggtgtctcactgtgttgcccaggctgatctcgaactcctgggtgcgaggattgtttcagcccggaagtttgagaccagcctgggcaacatagtgcagagattacaggcatgagccacggtgcccggcctcctccttttcacggctgagtaatattccattgcatggatagaccacattttgtttatccactcatccatcaggggacatttgggttgctcccacctcttggttattgcgatgacgctgctgtgaacatggtgagcaaatatctgcttgagtccctgcattcctttctcttcttctgtacccaggagtggaattgctggattatgtggtaactctgttgagtgttgaggaatgccatactgtcttcatagcagccgcaccatcctacatccccacaacccaaaccataaatggtcgtaactggtaagcaaaaaaaccaactgtggtctgtctgtgcaatggaatattattcagccataaagaggaacagaagactgatgcctggtccaacgttgtgaaccctgaaaacatgaggccaggtgaaagacgccaggcatgaaaggccagatagtgtctgattcctttcacatgaaatgcccagaataggcaaatccacagagacagggaggaggtgagcggttaccagtgggagggggaggggagtgactgcttatgagtgcagggtttccttctggggtgacaaaaacattctggaactagatagaggtggtggttgcaaagtgctatgactgtactaaatgttatcaatggtcagtgttaggccacgtgtattttaccacaatgcgaaggtgtatagatcttggaatccctgtcaggagaggaggaccttctaggctattctaaaataacccagaatctgcatccgccgcactgcagcctgcatcccacggcaccttgtggggggttttgggtggtaatggggaacccgtgtgttgaaccccaactgcccggttccactgcaccagccaccattaccagctgtgtggccttggccaagtcacccgccttctctgggcccagcctcccatctggaagatggggatgcagtagtggctgctgacagggctgctgggaggactgggtgagattctgcagtgggtacagaccctgctgttgcaagtagtgggtgccatgatggtttcctagcatgacatgggtcctgagctggtgccacatgagacactggtcctggcctggtgtgccactggctccccaggcacccgtttcttactccctggtcccaaaggggagtaagtgaccagggtgtctgaaccccactgagttccgccccaagccaggctccaggatgccccatgatctgcccccatcatcacattgaggagatcccgtctcctcccctaaggctcccacaaggccaccagtggggggaaatcgtcacgggggcctccccaggaccttttatttcttcaaacaggggagcccctcctgagaggcgggtgtggggaccctggagcaggagtcgccacctgggttcctctgggtgctgtgcttctcccagctcgccggctgccacggaccccccttcacctttcaccctcccccacttggcgtaggtgatctcccccacggatgccgaggacgcttccttccttccatgcccctggggagccggcgagctgacccgcttgtcagggcatagtaaagaatcgcccaggagagacccccttctgccctcagcctcaggctctgccgggcctgcttctgcctgggccttcatcaggatgcaggagcccccctccccatggagctctgctgcccccacgctggctgaccggggcaggctaatggagctctgggcaacttgaacactgcgcagtaaacgggaaagagccccatccagcccctcccatgggtgccataaagggccatgaactggggtgttcttgtgggacctggagcccctttccagggtcccatggccaccaggtggcacctgcattgcgcgtcgaggcactggcaaggagcctcgcgtcagcccaggaggctgcatccctgctgaggacctgccaaaccttcctgcttccaccggatactagggcaccacagcagcccgagagccacgttcgtcccacacatggacaacctgaccctcagacctcagggacgcctggggacggggtctcggcctctcggcctgccagatcctcagctggggctggcagcatcacgccgaggtgcacctgatgctcggttggtttctgcgccgccatcctggttcctaccttctgccttgtcgtctgggtccggatcatctgcagggatgggaggacggtcatgagagtgtggcctgcccatttgctgcagatgctcctggcagctctccaggtccttaacatgcactcaggcccctccctctcaccaccatcccattttgtggctgagacacctgagtccctggcaaggtctgggtcgcccggtgaaggagcatgggcgggagtctggctgcctggctgcctccgcagcctcctctctgccctttgccctggtctgccattgtccctgggtgtcctctgtcctctgtcctagcctcctgaaggagagtcaggcacattcgtagctcagcttatcagaggggccttctccatgacctcggagtctgagtcaccaccacatcccctgagaggccacatgaatggccagagagatttgggggcccggcctcagggcccctgctcctttcaccaccacgggggctccagggaggaggcgcctctcagacccgagctggctgatgacaccatcagtgccatctccaggctgctggaggccatttatagcaactgcccttctgagtgaggagcaaatgagtattttaaacacaccaggaagccatgccactttaggattccccaacttgaatcaggccccacctgagcccacaccattccccagggcccactgggaagcggggaccatgggggtcgttctagaatgagctgcaggtgactgcaagctctgctcaagaggaacaaggtcagggtgagtccagcccggccccagaaggggtcagcacaagtccacagccaggccggcaccacaccctccccaggaggctttaactacaggagtcctgggggtggggacagggacaggacccaggcagaatgttcaggagcatctggtcaataaaggaccaggtctctgggctctccctccccacacagggcccgcccagaccacagctgtggaatcagagccgtttgtgggtcagaacaccagcacgatgtggaggaggcctggaggccaggatcagggaaggggacggtgtgaggagggtctgggatgtggtcgtgtaggaagcgttgaggactgggagcgtctggtcagcagccaaggtgacctgggcggggcggttggcatacctctgagacgaggacagggatgctcccagggtggtggccagatggggccggtacagggaggagagtgggctcagaggggctcccccgggatgtgattccgagggggccaggcctgcagaggtcggcagcacatgatagggggtgttcaggagggagggagggggtccttgcctgagagtaggggagggggaggagtggtgtcaactgaaaagaaatcacaaaatcataaaatttcgaaaggagactttattttgtaaagggttacgcctgcgaggtggcattgtgaccagctgggaagcatagcctctggccaaagccggaagcaggcacttcaggggagtggggctggaatgaggatacgctggctaagcacactcagcaggttatagaagccatgagtattcacacaggggccctgacgcgtgtgcgctgagcacacatgcatggtacacgcctcccatgttcacctcggggtagagacttaacattgaaaggcatggcaatcaggccctgcatgtggaaaggtgaagcagggactcaaaggggctcagtgcagcctctgtgacccagcgagagccagcccacggccagtggtctcttgtcaggagaaagtcactgaaatcagtctcttgtccagtcacagctgtggttatggctggtggaacacaggccagctgtcagtgtctggaggtggatgagctacaattatattaatgttgcttatcccaaggccagcgcttgcttagctgctagagaatcagaaaagccttgtggcggccagaatccaccttattcttaggtttagggtgcaggatcaccttgcctggcatggcctcaggtcttgtttatagtttggtgtcttattgctaccaggagttcattccattactctccggatctctgttttaatgtgagtgctggccagttgtgtctgaattgaaaaggtgggtggggggtgggggcagagtatgccagggcctgtcctcctgagagaggcctgctggctgagaatgatgggcagttgccccccaggccaccaagactaaggtggagaagtccagcagaggagacaggagtcacagagcagggagggggaaggaagcttctgagaacaggactttcccgccatcacctccacaaaactaaaggagccacatccctgggggctaggaggggggttagctggagagcagagatccccttctgagtgtgctgttcagggggcaaagtggtggcttggtcccatccaggacctggtgtgtgtgtttacgggggtgccagggctccgttcccctggcgttgggaggtggggctgcacagtaccaggaccctgttcgctcctgttctgatgctgccaaccctggcatttcaaaagaaagagcctgttttctcccctacctcgaagctcgtttccaaatgcccttttctctcacctctctcttagtctgtctcatgctcctagcagaaggcagaaaaaaaaaaatccaccatcccctgcccatccctgggcctgctggctggggttcacagacccgggatgagctgtcctgggtgttaggggctgctgtccttaactcttggagaggggctgccacccacagagtctgttccttgggtgagcctggggactggtacacaaagctaacagaagtgacctagctgggcaagcctgggcaaggtatacaccgtggcccaggagcaagccagagaggtgtttcccagaagaagagttacctgcggagaagggcctggatgcgctcccaagtcctcgaggcctgcactgggattctgttgctggtgctggccagagcctccacacgcgtccctgtttgccatgggtactgtaagtgtcgctgcagctgccgggctgtcaagccgattggcagcaaggcctgtgctgctgcagctgggacctgcacagagccttatcttactctggtccccactagaagcgggcaggcttgcagaggactttgtagatgggctggagaaaatgttcaaatgtggcctgtgttgcctccacactccacaaagacctgccaagcctcgtgcctgtgtgcgtgtgagcatgtatgtgtccatgtgtgcatgagatggtgagaggcagcggaatgttccccccttggaggggctatctcaacatgttccagagcactgaggacgcagaaccctcactgaactggcaggcccctgcatctctgtgggcttcccccacccttctttgcatagaaggcatccgaagcatttgctacttcctgctcatgatctagttaccgtaatgtcatcagtatcgtggacagcatgatgttttctggaaagctgagctgatgggatctctgagggccccggcatggcagagagcaggaggctcggggtagcctgaggacgggctgtgcatgtggaccactggtgttgtcaggtgaaagcagactcctactagtactccttgcagatcaatgtggagcaaaggaattcacaaggtcttagctgcatccgagtgtctggggttgtaccgatttgctccggtaaagatagcacattgggaacagcaacctcagtgggtgtcaccaccagattaagttgaagatagtccatacctttctccaggctccctgggactctgtgcatccacgctggtaaggcgagcgtggatgtgagcgacacagctgcccctggtgctttcccatctccgatggtggcattcacagctgcactgccccccagggggtgggactgctcttggttactctcctggtagagaggggaggacccagggctccgctgtagcttctgtccctcatctgtaaaatgggatcccgtcgccacctggtccatagggtgctagtgaggactgaatggtgtaactatgtgaagtccttagcccaggggcagccatgtcgtcagtgctcagttgacactggctgttaatattcccttgctagtcacgctgcaaatatggccaggccccctcatgtgccaggtattcagcctgggccctgacccctgacaggggccttgaagccagcatgcagtggccgtgcggagcagcacaggggagggaggacagctgaaggacacagcaggatgaagggtgctgtcagaggaagctaccccagctctccgactctgcctccatatgatgctcttccactgctttgaactgaaattatggatattcttgttgagaacaagatagtggactgagaatcccgtacagcccctgattcgtgcacagcccagccccagcagcgagcgcctcctgacacaggaagcggtgaacactgccctccaggaccggctgctgcacagggtacatgggaaggacagccagggagggggcaggaccatagacaaagcctgcttaggtgggaaagccgggctgcagtacagggcttcggggcagcaccggggatcctccccagcagagcagggcctctgcatccccccttccagtcacacacccgtcctcaggcattctcatggatagactgccagaactgctgctcccctgctgcagatagagctgatgagggccagagccctgctctgaggtcacaaactcacctgacagtggggcagctgagacttgaacccaggcattcctaccctgctgtgttttaccacagtcccaaagagaactgctcaatagtatttatagagcacctgctgctgtgagggctgggaatctgtatttgtaaccagtcgcattgaggtgtgaggccagcctcctcctggtgctctggacagagaggcctcccggtgtgcacacagcagccagctggcccgggcagatgcagaagcacaccctgctgtgccacccgcgtgctttgatgctcggggaggagcaggagacaagcagctgcccctccacacccacaccagcattgcaggtgtgggcctgtgggtttccttgcacccgcaagccctctgccggagacctcgtggcactgtgtgtaaacatttttcaaagagggtgtggattggagctgcgggtctggagggaggcctcagtgaaggtagcctgcccgcggccgcacgttgccggggcaactgtggccgctaagagaggagctgtggcatttaggggcccaaatgcctggctggcttggggcggcttcccttctgcacgagtctcaaatgatgccgcctggttggaggtgggggcagtgcccttctcttccttctttcctctccccctctgatggctgcaataactgagggactgggacacggtccgaatggatgccaaggacagccttgaaaaagcttagacagtgtgagcaggtggccggccagcccgcggagctggagccgggtaaggggcctgggctttcaaagcctgagccagcagggactcggaggccctgggtaggatgagagacgatagagggggtaccaccagagagctttctagtcaaaggaggaaataagatcggggtttgaataagccatggctggagacaagctaagaattaatgagaaccctgcacgtgcagaagtgtggctgccctgggagggcgcccgtgcctggacagccatgctgtggccacccctttggtactttcttgtatctttttcaagaataaatgaatttttagaggtttgattggcaacgtccagcaaaagagggacactgccaatcaatcaaatctagatagaggttaagccgtgcattcagccatgcacgcagcaggataagccatccttaaagaggcagagaccaacaaggacagagcagaaacggcgatggcggctgcacagcaagtggactcaaaggcctcagaaagctggagcggggctgtggtggggaaagctggtacagtcagaatcacgtggcggaactgcaagaggctgtggcctctgcctaggaggtggaggtagcctgggctaagggctgatgggtagtttggataagaaaccgttagagccagcaaccccacagatgtgaacatagcccaaaggtgcactcggaaaattagaacaaggactcacgtggctgttttcagctctgtttggagagcagaacactaagcaccagacccaccagtaggagcctgcagtgtgtgccgcgtaacagccttgcagcgaggacatgtggctgcagtcaggtgcagggagcgtctctgggagctgccgtggcaccgtctccagggggtgttgttacgtgggaaaggcaaggcgagaagaatgtgaccagcgtgctgctgtttacccaaggaaggtggggagggaatgtgcacacacacgtgcacactcacccacacacatgctcacactcacccacacacatgctcacgtgcacacacacatacacatacagaaacacacaggtatctgctcatttctcctttttaatggaaggataatccaccaaaataacttgttttaatttagcattgcctcaagggggagaatacaagaagaggaagtagaagagagagagtagcaggttcaattttggaattgagtaaatatttcacgtaattgtaaaacagtcaaaatttcaaaaatctcaaaatccaaaacaaaataatagaaatgaacataactgctaattaaattaatggcattaacaaattatgtcaagtggcaatttgcatgtcattgcaaactggaaagaaatcataacctcttttcggtaatcctgttatgagtaatgacattggtggtgttagtctgaaagtaatgatagatggatagatgattaataaatgatagagcaaatagatcatgaccttaatggcagtcattaggaacctagattttcagcaaagagaaagagacaccaatataaaagaaaataagtaaaaacagcatcatcctaaatttctgttgaagctatcagtataatcatgaagagggtagaatattttgtcacatccaaaagcaaggaaggtattgaagacacaaagtcacatgtgatgggctcaggagccagtgtgaggaagggctgctcatacagcacagtggaggattcgaaagcacggcaaaaggtagcagcctagagcatcctgtagaaccggaaaggaaggaagtggtcaaaaaacaaaaggctggagcaaatcccagggagctcccagaggccaaggagctcccaaagaccacggccgggacaatttgagctagaaaataaagtcacatttggttatcattcaaagtacaacatgagtattcatgggtccacactgataaataaacaactgaaagataaagggaggaatagacaaatcttccctaacatgtgcaaagatactctgtcctcaaggaggtggtgtgtaactccccaccccttaggtgtgggcagtatgcagtgacttgctttcgagagcactgtgtggaaagtagggaaaggagagtaacttcacagcgggggagcccagtgagccctcccttggccaggcgagcagggccagcaccaacagcgaaaagtcttggtgacagtgtgtgccctcgatactatgtgacaggaatggctctttacctcctgaacacccatatatacctcagtctaataatgaggaaaaaaaatcttaattcaggggtagaacaaaagacctgaccagcagccaaaactgtcaaggtcaacaaaacaaagtctaagaaaccatcccagcaggcagagcctagagcagcaactaaacgtaatgtggtgctctggacagatcctgggacagacaagggacgtcaggtaaaaattagagaaatccgaataaaatgtgggctttagttaatgaaatatatcaatactggtttattaattgtgacaaatgtcccataccagtgtgagatgctaataataggggaaacagtgtggagtgtatgggaactccagatactgagttcacaatgttttttgtaaatctaaaactattctaaaataaaagatttgtttaaaaacaaagactagaccaggcgtggtggcttacgcctgtcatcccaacactttgggaggctgaggcaggcagattgcttgagcccaggagtttgagaccagcctgggcaacatggtgagaccttgcctttaaaaaaaaaaaaaaaaaaaaaaaaattaggcatggtggtgcatgcctgtggtcctgggtcccagctacttgggaggccgagatgagagaatcactcgagcccaggagatcaaggctgcagtgagctgagatcatgccactgcactccagcccaggtaacagaataagaccccgtttcaataaaataaaataaaaacaatagtaattgtagtggattcaaacttttatcagctatgttcttataaacattcttgagttcataatggcactttttgtttttttttgagacggagtttcactcttgttgcccaggctggagtgcaatggtgcgatctcggcttatggcaacctccgcctcctgggttcaagcgattctcctgcctcagcctcccgagtagctgggtttacaggcatgcactaccacgtcgagctaattttatatttttagtagagatagggtttctccatgttggtcaggctggtctcgaactcctgacctcagatggtccacctgcttcccaaagtgctgggattacaggcgtgagccaccatgccccgcccataatgacactttttaaagaactggtcacttgaaagaagtgactcattcacatgaaaactgatgaaaggcgagtatccggcccgtatctgggccttctcacatacactgtgcctcagagtcatccaagtgttgaaaagggaaagtttcttcttaaaaattagtgtggctgggtgcagtgctcatgcctatgatcctagcactttgggaggcccaggtgtatcacttgagcccaggagttcaagaccagcctggccaacacaggaagaccccatctctacaaaaaaatacaaaaattagcccagtgtggtggcacacacctgtggtttcagctgctcaagaggctgaggtgggaggatcgcttgagcccaggaggtcaaggctgcagtgagctaagatcatgccgctgcactccagcctgggtgacagagcaagaccctgtctcaagaagttaaaataaaaattattccaactagtaagtggagaaggagcaacagaagttgaacatcagcgttctgcagctcccaggaggtgaaggatctgggcatggcatttaccagtggctgctaaaaacactaagtggcaagctgacggggagtgggacaggctgagggtgcttgacccaccggtgctgtctcgtcgcagaaagacccaagcagctgtgccggggctcctggcgtgggtatgcccggcaccgcctgcaaagggctcctggatgcaatcccgcctctgaccaccactaatagaagcaatgccgcaggatgcaattgactcggtttcttcagcaaatgaactgcaaagggataaaagaggaatggggaaagcctagagatgtaaaaaggcttcagagacgtgccagccagatgtgacgtgtgcatcttgctcatgagtcaagtaaaccagctgtacactcagggagcctgagccatgacgcggtgcctcatgataccaggaatgcagtcgctttttaggcatgagaatggcattgtggtttttggtttttgttttgtttgagacaggttctctgttgctcaggctggagtacagtggtgtgatcccagctaactgcagctaatctcccaggctcgagcaatcctcccacttcagttgtgtttcttcttaataagagtctctgtcttttcatagaaagcatgctgagccatttccagggaacgcagagggatatgatcgccccaggggctgggtgggtgctctcggagccagcagtggctgacgctggctaaagggacagcactggctcagggtactcatctctctactgtcatgtaacattgggcttcttccataataaaaacttgtagaaatgagcctctttttaattagtagactttatattttgaggagtttatggggaaaaatgagtgaaaagtaccgacttgccacatacccccttatatctctccctgttttccctatttttcaattggcttgtcaattgtagcaaatgtcccacacagttgagaagccaatattgatacaccattattaactaaagcccgtagtctacatgagggttcactcttggtgtacattctgtgggttttgccaaatgtataatatcctgtacctaccattatagtatcaaacagaacagcctcactgcctcaaaaattctctgtgcttctgttccaccttccttccctccccctgagcccttggcaaccactgatctttttaccttctccatagtttgccttttctagaatgtcatgtagttggaatcatacagtgtgcagccttttcagattggcttctttcacttagcaacatgcttgtaagcttcctgcaggccttcccatggcttggtagctcatttctttttagtgctaactaatattccgttttctagatggaccagtgtgtttgtccactcacctctcaaaagacatctgggttgcttccaagtttggcaattattaataaagctgctctaaacctcggcatacaggtttttgtatgaacctgttctcaactcatttgggtaaatacaaaggagcacaattgctggatcatagggtaaaagtgtgttgttttgtaagaaactgccaaactgtcttccaaagtgcctgtgttattttgggttcccaccagcaacgataagcattccggttgctgcacatcctcgccggcatttgctgttgtcggtgtttgagattctggccattccataggtgtgtagtggtgtctcactgttggcttgatttgctaattccacatgatgtggagcatttatttgccatctgtgtatcttctttggtgagttgtctattcagatattttgccctttttttcactctgttgcccaggctggagtgcagtggcaccatctggactcacagcaacctccacctcccaggttcaagcgattctcctgcctcagcctcccaagtagctgggattacagatgtgtgccaccatgcccggctgatttttgtacttttataagagacggggtttcaccatgttggccaggctggtcttgaactcctgacctcactcaggtgatccacccgactcggccccccaaagtgctgggattacaagcatgagccaccatgcccagccccatttttatattcagttgttttcttactgttgagatgtaagagttctttctttttgtatttcaaataccagtcctttatctgataagtgtttgttttgcaaagattttcccccagtctgtggtttatctttttattctcttcagagtgcattttgcagagttaatttaaggaagtccaacatcaattttgacttttatagattatgcttttggtgttgtatctaagaaatcatcaccaaactcaaggtcatctagatcttctcttatcttctagaagtgtcatagttttgctttttacatttaagtccgtgatccactgggggttaatttttgtgaaagatttcaggtctgtctctacattcatttttgcatgtggatgtccagcatggcttgttgaaaagactgtcctttctccatggaactgcctttgctcctttgtcaaagatcagttgactctatttgtgtgggtctatttctgggctttctattctgatcattggtctatttgtctgttctttcaccagtaccccgctgccttgattactgtagctgtatagtaactcttgaagttggggagtgtcagccctgtgactttgtcctccttcgatattgtgttggctattttgggcctcttagctttccatataaactttaggatccatttgtcagtattcacaaaataattggctgtgatcgaacttagtcttttaggagctactctgaaatatgagctgccttccaaggaacatcagacatttgatgaactaatatgaaatacggcccaaaacaaacacactgaaaacaactgaagaaaccagtatgcaggaagagtaagattaagaaatgtattattaatatgctcagtgagatcaaagaaaaaaaaagtaaaatgttctttctgaaatgatcagagaacaaaataagagttcctgaaaattaaaaatattatatagcaggtataaaaaaaatttttttgagacaggtctcgctctgttgcccaggctggagtgcagtggtgtgatcaggacttgctgcagcctcagcctcaagggatcctcccacctcagcctcctgaatagctggaaccacagccacgtgctgccatacttggctaacttttaaatgtttttttttttttttttttttttcaaggaacgaggtctcactatgctgcccagcaggtctcaaactcctggcttcaagcaatcgtcccaccccagcttcccagagtgctgggattatagacatgagccaccgctccgggctggcattaaaaatttgaaagatagattgaaagataaacttgaaaagaatttctcagaaaagaaaaagatatggccttcgaagaagataataaaattagaaggtcagtccagacggtctactgtgtataaaataaggatacctcaaagagaaaataaaagaaatatttaaaaagtcattgaatggccaggcgcagtggttcatgcctgtagtcccagcactttgggaggccaaggtgggcagatcacttgaacccaggagttcaagaccagcctgggcaacatggtgaaaccacatttctacacagaatacaaaatcattaggcatagtgacatgcatctgtggtctcagctacttgggaggctgaggtgggagaatcacctgagcctgggaagtcaaagctgcagtgagtcacgatcacaccactgcactccagcctgggcgacagagcaagaccctgtgtcaaaaatttattttgtctgatattaacagccattctgcccaggaactgtcttttctcatttattaactctcagcctctcagtgtctttgtattgaaagtgtacggacagcataattaggtcttctttttaaaccattttataaggcctgatgtttagttggagttttattctatttaacatttaatagaattgttcatgtggttccatctaggtttacaagtttgtcttctgtttatctcctcagtttttatttttccctttttctgccttattttagattatttaactattcttagaaccttattttaatttttccattggcgttacactgtagctcttcacattcttttagcagtggatcaaggattacagtatacattcttagctttccatagtctacttagagttcaaattgtacactccatgtaaaatataaaaacccagcaaccatatagatgcatcttcttcactcctgcctcactttattctataattgtcatgtgtgttacatctacacacttgtaaaccccaaaatcagtattatttttgcctaaaacagtgatatctgcttttaaaattaagagggagaatcatcttttattttgtatccaggtgttcaccatttgtggcaccctttgtgccatccatagatccagtcccgcttcacttcagcttgaagaacgttctttagtgcaggctttctggcaacaaataacctggttttcatttttttataaaggtctttattttgcctgtattctttaaagaattttcaccagaaatggaattctagttgtgttttttttactttcacctgttaaagatgttgttccgccgtcttctacaagaggttcttctccatggtttctgatgcaaagtctgcaatcattcagtcatttttatttagagtgtgaataatgtaaataatttctctggctgctttaagattctcaccttgtctttggctttgagcagaattgactataatgtccctatataattttttaaatacttatctttttggggattcacaggcttcttgaatctataaatttatgtccttcacctaattggggaattccttgggtaccattttttcaagtattttttatgactcattttctctgtcttctttgactctaattttccccccttctgagactctcgttcacgttatgttagaccttttgatccttaatactctctgttctactttttaaaatctttttttctctcttctttggattggatatgttctcttggcatgtcttcaaattcactaataattagctctgtcatatccatgctgatgttaagcccagctgatgcatttctaacaattccatataattctttttaaaatttccttgggatttcctgtcttttattcattataagcctattttcctttacctagttgggtattgttacagtagctgttttttaaagtccttctctgataattccaacatctgggtcatctctgggtttgctaaataagtttgagttgtatcccaaatttcgtgaatgttatgctttggcaactctggattatattacattcctttgatgggtgttaatgtttttgttttagctgataatgagtttggttaaactcaaattgcaacctttgtctgccctgcagtggcagcagctcaaatttcagccttatcatagcaagcctatttgagtcttccttacacacacagctcagctcagacatcaaccaaagacctatgagaagtttacacacagaatatgaaactacccttctctggctctctcttttctggagttctcccctcactttggctgctatggccactgtgggctgtatcctctgatttctatcagaactgcaggtttgtgcaggatctggatttaaaaaaaaaaaacaaaaaactgcaggtgactcataccataatgcatccattgcacaaagcttctaattttcaactctcatctaaaatctgcctgtctttgttcactcttcagaaccttcagagaatttatttgttggtttgggggtggggattgtactctgtctagattttatagctattacctgcagaagagttagttagtcttaggaatttactttaccttattccccaacctcaaattttatacccagccaaactaccaattaagtgtacagataaagccattttcaaatagtcaatgtctcaaaaaaattatgtcctaactctatttggggagaagatactggaggatgtcctttacaaaaaatgaggtttttgaaccaaataaacaaatacagggattcaggagatccaacacaggaaagaatcagtcaaaggaatcctgaggattagagtaatggggacagctgctagaaaacacttaatcctggttgttcagtgcagatcaaaagtcttcaggaaatatttcttcaggaagacaaacttaaaatggataatgtatttgaagactctgaaaagagatttacataattagggaagcatttggatttgaattactgttaagtacatagaaaaaccgaccaacaaacaaaattattttgctctagggagaacaaaatgtacaggaaaagatgaagtaaccatagtatactatagagtttaagctatgaatagattttacatagtcatgatgtaaatcctgaatggtgatctagttaaaattttgatatcaatacatctagaggatggtggtactgggaaaacagtggggagggaggattttttaaaaagagccaaattagtggttctcaactgatggtgtcttgaccttccataggacatttggcagtatctggaaacattcttgattttcacgcttgggggtggagattattgctggcagctggcaggtagaattcagggacactgctaaacatcctacagtgcacacccacaacaaagaattaattggtccaaaatcaccatagtgccacatttcacaaactctgagccaagtcatccttttccatcacagtgtgtcagcggataatatcgaaaatgtaaatatcaagtagcaaaaataggtgttcagagattgagtgatagatataaaattaaatagctgaaggctcagagtgagaagtaaggctgggttggtggggtttcatcatgacaatccttgtggaactctttgtttctgtaaactctgtgtatgtgtatgtacaacttttgatattttaaataacgatttaagtggaagaagagaattatttacaaaggaaggcaggtatgcccattcttcacagaaattccctggactgtggctgatgataggcttgggttcttgccatctacctggatgtggctgtgattcactcactctgtaaatgtctccatgtctgtatgtaagggtgatgcatggacaggcacattactctttttttggagttatctggatccatgatttctcaacagtttctctctactccaaggcagttatccccaggagctgcagtacttacctgagccttctataaatctggcaagtgatcaagccataccttcccctggtggcagcattccagaattgcaggtccaggttttttgaggggcaccgaaaccccatggaagctcaagatgccaacctgagcatatgaggaaacagcaagcatttcacctattctgcagtttctgtcaccacatgagcaatttctggcatctgttttaaggactgtagctggttccaaagtctcattgcaggttaaactgattttaggtttgtttaaaggctgggaaattctaaagatcctaaagctttttttcctctgtccctgctgaactgggtagggaaatgtaactgaagtatccagtcctgccttgttgcgtgctggtcttgtcaattaatttcacgttgagttgagttgccagccatgtgcctttgccccactcttcccatagaagtgttgatgggcgctggggcacactccgttggcatccttgagccttgttgtcaaagtgctcaccttcacacggggagcaggtgcacaaaaacccaaagccacacgacgcacagctttgtccttggtatgtttcttacttttggggaaggacttcatccaaagcttgtttattttgcagaataggatgagaacttaagaccagcatggtcgacgggaggttggcgcagcctctttggttggggctggctctgaggcagcaaggagtaggtgctgccacttcatgtggctgcgcagcttctgtccggaaaatggagtcacacttcctcttcaccaggaaaggggaaggcagctgggagcatgggctccaccctttgtgtgcccagcctagggaggactccaggaacccctaggactcactgtgctatgactcgcacaaggcagagacacttcctctaaaggtagaagacagtgacatgggcccatcctggaggacaccctcttcctgcagacaggttcccccagctcctggacagaggaggagcagggaaaggagggacaggatctgtatccagaggcctcacagacagctgggtccagtggcagaaacttgggggtggtggcgctggcagaggcaggaaagacaatctcttctcagggacccacattacatgccccagttagccctgctaaaggggacagtttcaataggacctctgtggggtggggaagggcaaaagctctgctacaagcatgagcgcgggagggctgtggcctccagcctgcactgcccactccctcccagggctgcggcagtcattttccaatgacagtgcctctgagttcccactcacaacaccccttcccccaggacctttaagatgccccagccaccaaccttggccccaggtttgctaacagcagcagcatctgggggctgtggcctttgcatgccagagctgcctctgccatctctgcaggtctgggtgaactgcggccccagggtctgctcctccagtccctgcctcccagcttccctttaagaccagtcactcctgggtcacctgctggccaagacacctcctccctccccatctcaagcctggtacaatatatgtaattgcaggggatgggagacggaaacagctgtggccaggctcctgggtaagtaagcacagctatggtttgtcacttgagttcttagtccgtttgggctgccgcgacagaatacacagatcaggtggcttaaacagcacttatttctcccagctcgggagaccagaagtccaagatcatggcactggccggcaaactggtttgcagaaagccatcttctcttcacaggacagaaagggcaaagggttgctccagggtcccttttataagggcactaatcccattcacgaaggctccgcctcatgatgtaatcacttcccagagtccccgcctcccaaccccatcacactggcggtgagggtttcaacacatagactggggggacatagacatgcagccactgcaagtccccagcttcaagtcgtggccagcagggtgggctgagtcagagctgaaagacagggtgagggggcaggggagctgaggaaagctgacccgaaggctacaccaatgctgaagactcagagctacatgccagctggccgtgctctgagctcctgcaaggaagagtgcagagctccatgctgggagccccccctcaatgggataaatgggacttgaggccatttttgctctgagaccaatagccagtgtccccacactgggcccctgggggaggtcgtgggaccaagagccaagactgtggcccaatcagtgtctgctcacattgggcagcgctggagacctgtgccactgcatgggcaacagctggtgctgcaggggcaggtgagcctcagtgggcagcagacagagatgcactgtggctgagggctgcaatagaacagtcctcagggtggtaaccaagaaggccgggcaaggcacaggcctggtgaccaagcactgcaggtgggcagcttcaaccagacagggactgtcccacagctctggagacaagaagtttgagatcaaggtggcagtagcatgggttccctctaaggctgtgagggaaaatcttccaggcctctcccataggagctgacggtttcctggcaacctttagcatctcaaagcatcaccctgatctcacccttcatggcgccttctccctgtgtgcatatctctatatccagactcccccgactctctttcttttgagacagggtctcactctgttgcccagactggagtgcagtagcacaatcatggctcattgcagtctcgacctccagagctcaggtgatcctcctgcctcagcctcccaagtagctgggaccacaggcacacaccagtacacctggctaacttgtattttttgtagaaatggggtctcactatgttgcccaggctggtctgaaacttgtgcttgagcaacccacccacctcaacctcccggagtgctgggattacaagtgtgagctgccacacctggcccaaatttccccttttcataagaacactagtcacctgggttaggctcaccctaatggcccctttttaacttgactgtatctgcaaagtaaggtcatattttgagatactagggattaggactccagcatataaatttgggcaggacacagttcagtccagaacaagtgtctggggacacagagatgatgcaccagtaggcaaagtagggcagggggcagactctgccccgccccaggacttagccctgatggtggccttaggggaagctggagggatgggatgtggggaggggtgctgagcattctgtcgggaaaggtcagtgtgggcggaaggttgggatgggttctctgtgctcagctgagggggacagggcaggtgtgtgcccagcagcacgtgggcaccatccacccccatgagccctggtgccctgtggcgttcccagtaggcaggctctcattgcctgaggtcagagccgggcacaggctgtcagtgcggccaggttctcaccaaggggtcttcctgtcctgggcctgtatgatagaggttcctgtggcacactgtcacggcctgtgccctctcggcagaatctaaaccataccctggaggggtgcaaagcaaatgtgcgttgcaggagttactaccggtctgagttcatttgcagagcctctaaacactccaaaaaatcacaagccccgctcttgcgggttcctcccagccccagctgctttggggaagtcggcatttttagtgtcttgatggtatttagggtctaattacaaacgcgcgtcactgggaccacatgcttggtgctggaactggctcttcattgatggaaacgatgtggtttctatattaagtgcaagattcggggccactttcctggcttttgcaagcccaagtttgagttggggtcccccacaggcccctccagacctcatgtccgtgtctgtccactgggcctgcatctagggttcagggtaatgcggagtggtgacagacgggatggccacctgcctctgccccagcgcccacatgacattcccccattctgcctcctcctcatgctcagaaaggctgttgcaggcccctcacagacatccctctccctctgcaggggaaagattctgggcagaaggtcaatgtgttttgagatctgagctctgacacaggagactggcctgggaagcttatattgatacagggctcaccagtcacctgtggctcccgtaggaaatagaaatcagtttcatgaatgtcacccaggctgattttgagaccagcaatgtgcagagttcaatctgtcccttcccaaaattctaaacgcagatggcatcaaaggcagtgatagcagttttctgtttcactggtggctggcaagagccacaaatccaatgccccctcaagctgagaaggtgacgtcagggcccaggaggctggggcgggcgggcacagcagcagtcacagcctcagctaacagcaggggaggatgccgcatgcaagtgggaggcccaactccccaagtgcgagggttctaatttttcaatgaaaactgaaattctagactttctatgcaaaggtcttatactctttaaattgtgacagctaagttaaaactgactgaggcactgtgtgggtgggatttgacccttggtaatcgctggatggggaccaaagggaacatcctaggatgtgtgtggatggtttgaggccctgttggcaccacctccctgcccccaagtgcttgccagggcaggaagccatgctgtttactgaggacaccccgctagagaggcaggtgtcctgcccacgggcacccagcaagcagcagggcccccacaggctccggacccaataatatgctgattctggaggggtgcaggcccaccaggaccagggctcaccggataccatccctccatgaagcaggagggagggccctccaagtggagctgggactgcagggaagctcgtccaaagcaactttgtttggaagtggctcatgaccccgaaagacctgggcgagacagattctggacgtcagaggggcatcagatgcccaacaactgattccaaacctagctccacccctgcaagccctgtatgcctctttgtcatcagctttcagagaaggccaagtgatgtttccagggcccatgggagcctcatttcctctgagctctcctgagcaggtcctgccatttgctgcagtctgctgagggcagcaggtctacgaggggtacaggggatggaatcaggaactggggagccctgattaggagttgggtgggaacagcagcttctgcagactcagatatgagacatcaaatctgggcagccagcctggccctgtgcaggagcagctctggctggggcagcatgagtgtgtggaggtgccaccagaacgtgcacccaggctgtcggctacagacaaggaaggtgctggggccgccaaggtccttggccccgcagccaagcttcctgagaatcccccatgagtggctcattccccgagaggcctttctttggtcctttgcctcccctgcccagaaaagagtaatgtctgtctctgacacttctgaggaaaagggccctccagccccttgacccttccaaggcacaggaacaaactgcttctcccaaagcggccaagggccagctctggccaagatcacagaaggacagcatccagccaccacaaatgaaccacgggagattctggaggatgaggattctagggagtgagcccaaggccgtgatggttagcaggctgcagtcagaggccacatccccagcccctccctgcctaagtggccaggctgttaaagtccccatcagcccgacgagccctcaggaggccgcaacttgagcttggcttctccagtgactggcagcccatccccgtgccagtctcgtactctccccaagcatcagatccagagaatgccccacagcgggtggcaggagcaagcaggcagtaatatgcactttcttggttggagccccctcaaggcccggcactgggggcccgcccagagcaggaaagctggtcccagcccatctcaaggtggggccgagtcctcccctcgctccccacagccttgcaagggatgacccctggggatctagtggccaggcagctgggggctccctactgccaggtcttctcaccaaggcctcacacattggcctcgcggctcctgagcctgggcagcctgcctcctccatctcagcttgagaccccagtgtctcggtgcccccccacgtgtgtttggcacctcatactcacagctgctcgggtcagatgcctcatctctgcatcgggcctcagcactccctggcccataacttcaccctggcatccaaggccctgctctcaggccttggccttttctgcgcccccctgcctaccgcttccttgcccattcccactccatgactccgcccacactgctctttcctggtgggtccaggcctctgttcagtctccttttacttggttctgccttcttaggtggtactcagccacctgaagttatgtgttcacttctttgtgtgtcggccaaaactccctgatgaggacgcaaacttcccacagatggaggcagagacagctgaactgcctgtgcctcatggcttttagtggtacggggaacagaaacactggaatgagtgaatgaatgaatgaatgagcaacagccactacccgggtgtgctcatgggaggggagagaacccgataacgcgtggctggtgttcggttgcctgtctgtaccagagcagcgagggtcctgcaagctgaggtctgccctccgagaactcccggtgctgtcttcctcgatccggctcctttacttcctaaatccatctgctttcctaattacattctgagaacctcagtgaaaggaacagcccccaggagtcaccttgcaaagaccgctgccgctgtaggtgggcctctctcccaaggccccattaggatagtcctgctcccaagactctatcttcagggcagtgcagggtgaccagctgtccagtggacccaggacactggatactcactgctgaaaccgggtgggtctgagtacatgggaatgagccggtcccacagcagagactgcagagcagctggcacggggactgccctggccccactgagtcctccctgggctcctcgcagccctgcctggaggacctctgcagccgtctcgtaggtgaccaaaactggcacatcctgggcctgtcaacagtatggggagccaggcactgggcctgtcaacagtatggtgagccaggcagtacctgcttctatccagctcttacagggatgttggatttgtgaaaatccaccaagcagcacacaggctttaagttttctgtttgtgggtataccagatgtttagtttttgaagaatctatagcaggaggatatgcgtacagcacagtgtggctggtgaggggcatgacgtcttggctgttgtttacgatcagggtgcttttctttgttcgaaggtggcgtgtgaagcagctgtaaacttcaccttctggggcttccccctccctgctgccacctagagacagctgcctctgggctgcgctcccattcaggagctgctgggatgaaggtgccagaggccccctgtggagctcagttccatgggcaggggtgaggccggggccttttcacagcaacatttgaaaaccactaagtgttactcctgcagtagccagggtgggcagtgtcagcccagacgcccacccagttccagtctccatcactcgggttttcctctgggagtagcgtggggctgggaggcagaggccaaggccatctgctgctgagcattgctcagggaggtgagaatagcagaggggccagggggatggcaccctgagtccgttcctacttccgtgtcaggtgcatttgccatggtgaggacaaatagggcaggaggtaaccggctcctaagagttcctcaactgcagggcagtggccatagcatggcagccttgggggtccccagcctgccactcaccgtcccaggagcactggggcagctagttgtacagaccagcacagggacagggcccccactcttgtaagcaccctgctgggccaggcttttctgccttcccaggcctctggagcgggagagcagggagggagggagtgggaggaaaggggctgcttcagtgtgatgtgcattcccagaatacatgagaagcaattaagcgccacgtttcctcctcctgtgaggatgcaaagcctggcactgcagcccagccctggaactcgcctgtcaggctcttcacatgcagtctcttggtggccctgaaaattgccccaggcctgtaaaagtaagcacctaaggatgctcaggttaaatagaaatcagcccttcctctgcagcagctgtggaggactcagcagagagctgcagtgtcagaggaaggcctcccccaacctcctgagccacagttaagtgacctccacagtcacagcagcattcattctggtttccccaaaagcacctttgcttccaaaaagatgacggtctcactccctttgcttccctgcatttgccccctttttaggagcccacatgtctctgccttgggtgggtgccaactgtcttcctctccgctggctctcactgatgccatcctctccgccttcccacaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaaggtacatgccccacatcgcccagctccagcctggggccctactggggggggggggtgggggcgggcaggacagctggggggcagtgggccctctctccagctgatcccacacttctgagagcccaggcacaggggtgaggctggaatttaccgccagagcccacgacaatgacttggggctcacacgctgccggaatcatccatgtcccaccaggagtgcccttttagtcactagcaggcgtcccttccgcaggcttcccactcagtgccctgtcccctccctccccctgcccaggcccacccatgagggcctgcactgcagttcagggatatggcaagatcctcctgagcacctgtcctttcccatcataagcacacctgcacaatccctgaccaccgcagccaaacagcctgagacccacctgccagccacagggccactgctagccttattcccatatctggaaacatgggctggggtctcacacccatctctcctctgccctccagctcccccgcctccaaagcgggcaccgaccacagccctcaccctgcgctccaagtccatgacctcggagctggaggagctcggtaagtcgcacacccggcccagccctgtacagtcaccatgccggtccctgagctgccctttgcaaagcaccaggctgtgcatgaccccacgcttgctcgctacccccctcctgcccctgtacccagacgtgcatcaggaaatgcccctgcatgccccgcagccccatgtgtgcacctccctcggagcctcgcggggcgttgttgctagtcctgcctttcctcttttctgtttatctaacattgttttgttttgaatttttgggcctctcactagtggataaaggtaagcagccccactgggtccccaaagcagctccccctgctgtctagggcacccccactgacatccacctcagcccaggcctcggaggcctgtgtgagctgctccccacgtggctcagaccagaaggctccatcctccggggatctgtgtgtagatagcgtgggcttggcagagcagtctggtctgcacagcaggcttagggaacgcccggcacctttgtgtaaggtctgcaagcaacagagagaggctctggccctctgactccatcttgtaggcaggggaagggcgactagcagccacgtgggccatgctggccatgcaggatcctgtttgttccggggagtcaccatggagccagggacacctttggaaagagggtggctctgaaacacacagagatggcatgtaggtggaaacgcttgctccactggagcacaaattggagctggtgaaggcagcttacatgggcgcagaaacgagcccccgcccaaggcccacggtccagtccagctggcctggggggttgagagccaagccctggctggtgctctcactcacaggccccgtcctccctgcactctggcacaggcagctttcccgagaggagtctagcaagtgctaagtgctgccacagcagtgatgtcatccttcctcggcccagggcgctgaggccggccaggccgcttctcacgaggttctggggctagagtctgaggatgggcatgaggcctcagtccaaaacagcagccctgcagtggcgctgccccacccacccagaaccagtagtgccccgcgtgccccagcctcacaggcgacggaggaggtgaccagcctccaggccctctccacagaggcctgtcctggggctccccagagggacaagcctagcagctctcatctttgcaaggggtgctcctgagagctcagctcagtcaagaaacaacagaatgaggcaggaaaggccacaggtgcactctaaaggctggccccgccacctctgctcatgtctgctctgagaactcctccctactttggcagggtgctggtgggacaaggggtgctgaggaagaaggaaagcccctttccactgccaggcagtaggttaacgagcagggcagacaggacagagttgtgcgggcagccaaggtttggggaaagccactccatggatagcgcagcctgcgttcgcagcgttccagacagcccctgcctgccgccccattgccggcccagcctgctcctgaggcgccctgagctgacaaggcccgagtgtaggctgcgggcgggcgctgcatcctggtggctcatggcggtcccctttctgtttgcaagcctcggtccggaagaagaagggtaagggaggcccagtgtctgtctcagccccctgcccatcacccccctgtggaacagaaacatcctttgtgatgccgtgaagtctcaaatgtgtcgcaaagccttgttggcttctcctgctgggtcctgcccgaggagccctgccgccctggagcacattcatctgtctgttctttctgcttggcttctgtctgtgattccccagcgtgtcctgtgtttcttccctgacctgtgttcacatcgtcatgaccgtgaagctggccggacccctgtttggtctcagctggggctgcctggatggggggttgcagatgagcagagcctctggctgcattcctgaccctcaggacccctttgtggtgggcaggaactgcctccctttaaggcccggaaatcacccattccccaagaggctgccctgtgccctgtggggcactagaaggagaagggagcagtgtgagccctttggctacacctccccacccagggctggtgtggagtgggagactggcagtcactgtggctgtgggcagccggaccgcaggccccagatagactcaggttccccctttcacagcagcaagcacatcggggggtattgctcgcctgctgctggacacagctcccccaacaattaaaagcagcactcccagcttttaattaatcccttggagttgggaggagcctagcacctggccctaaggcacatcttaactctgtcccaatcatgttagatgagattgggtgaggtgggcacagaaccaccactgtcccgacctgtgtcatcccagcggcctctctgcagcagccccgggcttgcaccagcatcctacagctgcccagaaaactcccagcgggctttctaggccccactgctgcgccgaggatgtggtggacacccggggtacagaatacccttctttctatgtcgtgcaattacgtttgtgtgtgaacaccccttcaatccaaggccaaaccccagctcacgggaatggccctctattcatcacctaactgaggaagatgccccaccatggctgccagggacccagttgccagaacagcgtgggacaacagaagtcccttgtcagggagaacagttcgggactcaggtggctgagccaccgtgggcgcctgtggcctgctgggacctggccccatccacaccaccctcctcccccagggtggcatcagaagatccacctcccgtctgagcaagagaaactggctacaaatttgagcttccagagcctcaaccccagatataacagggggcaagggtgtgggcaggaagaccccaaagggaccagcagccgtggcccagcctggtcacactgggggatccagctggggactgaagacaccgagcgttgctgacagcccctgcctctagggccatgagggcatcccatggcgcacatgcgaagtgcggggcacatagtggatgcacggcaaatgctccaggcccctcgtgctgcctccacctgtctctgggaggactggcctcgcctcggaaaaagcactcgtcacactccagaaaggccatgtggaacaaaagtcaggcctttacagttgtattgggttgaaaagtgacccccaaagttctgtgaatgggaccttatttggaaataggatccttgtagatctaatcaagatgaggtcatgctggactcgggtgggccctaaatccagtggtgtgtccttgtaaagaaggaaggaacaagccaagaaacaccatggatttgatcctctccagacccctgaaggagcctgaccttggacttccagcctccagaactgtgcagggatacgtttccattgttttaagccccccgtgcatggtcatttatcataacatccctggcaaagcacctcaaatcccgggtctgtccccgctggctttaccctgcttagtgatcccaggttttcagttctccatctgtaaaatccttgtttagtctttaagtgttctctgagcacctgccctagtgcccagaccctgtgctgggctcaggaagaagccggctgtcaggcaggatttggggtggggcctctgcccctgggcacatgaaggggactgtggccttcaccctaccaggcacctatggctgtaccttcagactctagcccttggaaggtgtgtgactcagagcctgcaggccaggaccagtccaccagggtccaagcacacccttcccaccctgcactgccgctttggaagattaaaccaagaggccggccaactggcaacagccgctgcttctaacacacgcggcttctgtcctctaacatctggcgctgcagatgtgtgtgttttccttttggaaatggagtgacatttgtactctctcacccagagacaggatgtagtagcactgcaactccagagaagtagacagaccacttcaagcccacataaggggagagagcagtggttgagaactgacagggtccctggaccatgccagaggatgtgaagcagaccatgaatcaggtcccaggaaagctgaagaggtggagcagccccatgcagccctccacaggtctggtctgctgctttcccccagaaggttctgaagagtcaacaggcaaacagctgggcactctgcccctcaatggggctggctcccaggctctgggcctattgtgtggccacaggcaaaggaactcgctggacagtggacctagtgtcacttcagtgcagagcctattttccaggagactcagccaccaggtgcctgggtggtcctgggcctcccagcctcggcatggacgctggggtcgtgtcactcctcgatttggtgactcccttgtgatttgctgaggatgcagagcagtggcaagatttctctagcacagggcacactgcttcctgccccctatcaggggaacctgcactgaagtcagcccgtggtccagagtcagctcatgggctggggggctctggtaacaggcaggtgacaaacctacctcccctcccttttccctgtgcctggtcagcatcacgtatctagtagagagaacacacgtttgctcagagggctgaaatgcgggtgactgctggggcatcttcatcagctcctcactggagtgttttgggatttgacagtttcaaatctgtctgaggcttgtttgttttctgtcaccgaacaattcattctaagactgccaggggccagattcactaatccccttcatccagagtccctgaataaagacctagttctgagcttttataaattaagcataatccttaggagcctagaatgagaagcaggaatctcagtcctgtggcttttctgaaaagtctccatatcccggtaaacaagatctccaagataaggactgagcaagtcaggccagcatgatcccactggccacgtccccaagagacaagggccaggagggacccacacccctgtggggagccaatgcagggttttcctttttcatttgaattacactaactctaacttaaaaacgaatgctagcccctgaccctaccaccccaacacgcccggctgctctcacatgctctagttcaaaagaacatttgttttggggttattaggaagggaaaggtttaaaacagagaccagatgtccacaggcaaggtggccacagtttcagggatgcaccttcaatgacatgaccagccccaccctctgatgtggcgactgtgatgatgggtagggtgcccccacccccgcctcgtggttctcctggacgaggcaaaccatgccaatggtgaccccaaccatttccaaacaaactttctgcagccgttgcccaccagggcccagggctgggcagcccatcacatggcaggcacaaggcttgggggaccccagcgccagccccagctcccgcctggtcccatggtttgcccccatatggccttacgcatctcagacctgaaatgttttcccttcgacatgggaacaatccctttactacagccagcttctcattaggatgagaaacaggatgatcggcccagaacttccaccagattcagggacggctgtcattattgaccaggacacctttccttcaccctgggcacacagttacatgaggtgtatttaacaagatgcctgccgcaggccctgaggtcctaaaatcgcagcctgcagcctgttcattttgggaatgtgagaagtcgaggcggtgccccagggaggccgggcagcagaccctcagtgtgcagtggatggaaatgaatcagcctcatcagctgtggggtttgttaatacataaaaaacagacacatggcttctggaagggcccagttggaaacgggagcttcttgaagatttggctcatttaaattgtaatcccaggaaagctgttatgccctagagtcccaccttccttgatgtgcccagacatggccaacagcacagcagagcctggccacagccttcccacacccacctgcgcccaggccttcccctgcagggcctcggccgtcctgcatcttctgggtctgacacctgtcaatgttcaacgccgatgactttccctcacctccgctattcagccccagctgccaccttagcctctgagcttaccatagcctggaagtcaggcctggagggatgcccaggcgtttctggctcggatgggccttcctgcatctccacaggtgcaggtctgagcacaggcaggtggcagccaggaaggcacccttccctgtctgcacctgtgtacagtatcaggtgggctggattctgcggctgcccccagagctcgccacctggaatgcccccgtgggatgttttgttgggctccagctgctcttcccctaacttggtggcatcccttctgggtcatgttcatggaggtacatgctgctgcaccccgctcaggcctcacgctccactggggtcagaggaggggcccgggccagcactgtcaggaagcaggtcccagggtatccccaccccgcagtgccctggctcaccacagctatgggacataactccctggtgcaggagacacatctcaacccccgtttcattggagaaaaatactctgggggccaccagcggccacatctcacttgaggcaaagaacagccactgcctagcgcccccatttccagggatagaccaagctggagttgcacatcacagccggccagaggagatcacccaagcatcacctggtcccaagtcaagggggagaagcccagctgatcggcgaggccagggaacagaggccggcacagaaaccaattcgaccccagccatccaaggagtcccagcccagccctgggaggggaaaggctccttggaggaagcaaattgctgggaccatggcaggtggacccagcccgtgcagcccagggaggttgacagggaccccagcaaagggaatgtgagatgaggcagccatgcagcacctgctgcagccggaggagctgggatgagggccttgaacgcaggtgaggacagcacggctctggactggggtcacaggtcacagccaggatgtccccactgccaagtgagatgagaatcgggtgtttcctaccgtgcctgaccagttccctgagaagcagatgcttagcatccactgggggaatgacaaggtccccaaggaggcatcaggctcatcgaagagccagcagggcttgtgggtccaggaataacaggagagaatgcatgagcagggacgcagaattggggcccagtgagcctgcaggcctggtcagctggacttggtcatgaagggagagagtgctgtggggggagatttggctgcccggacactatggggcaagggctttcttgctttgcgtgaacacttggcattttgctgacaactggaaacgtggtccaggccaggggtcggcaaacacctccctgaagggccccatggtaagtgtgctgggcgtgacagccatatggcctctgctgcacattctcctgccttttcttccccatccttgtttgaagactaaaagtgtatggctgggtgtggtggctcacacctgtaatcccagcactttgggaggccaaggcgggcacatcacttgaggtcaggagtctgagaccagcctggccaacatggtgaaaccccgtctctactaaaaatacaaaaattagccgggcatggtggtgctcgcctgtaatcccagctactcaggaggctgaggcacgagaattgcttgaacccaggaggtggaggttgcagtgagccaagcagcccaggtgacagtgagagtccatcttaaagaaaagaaaaaaaagtatagactgccctgaggttctggcccggtgggggcaggactggcccaagggtctggaacacaggcctggaaccaggcccctcatgcagactctactgtgagagtgtccataggtgtcagagttgtgtacgtctcagctgctctgcaaggttgaggggccatcacagggcgcctggctcagtgtccccagcacacccccatttcctctccccaaacttcctcttgtggggacctctggtctgggctgcctttgtcaggagcctgatgcctttgtgttggacaaccctgatccgtgccgtggctctgggagctttgcccgtgggtcagctccccgtgagaagctgccatgacaggtaacttccgcctcagcttgaagaacaatttggagatgggggccttcctccctgcactctgctcagctctaacttgcacaatagcctcatggctcaaagtctgggcaaggccctagcatacacttcatgggagccaccagaccccaagagtgggcttagggtggccagaaggcagaatgttccagatggcctgcttctccccagggagtaaggccagtgctgtctcaaaggctcagaatggggtacacccaccagataccacactggctttgtcccaacccagtgacatcttagaagtacagctggggtcaccttttccagaatgcacatcgcgactggaagaccagctctccaggtctcagtggcacagggcccttgcatttaaacagccttagacacacccttatgcctgatcccaaacaccctgagatgaagctaaggcgtcaggagagctctgggatgtgcttcagttttcaagtaaaaaaaaaaaaaaaaatgtgctgcaaatgtcctctttaaaaaacttttgttaattgctaaggatcccttataactaaactttggttttcttttttttttttttttttaaaggaaatgggaaggttctgcattggggaaaataaacagagaccttccctctgcaacacttactaacgcctggggccacgagcaccctggcctctgaaacacccacgctgccttgggtggcagatcctcatgtcttggcaatcacagttacaaaggaaccatatgtctgagtctcttcaaaaaaaaaaacaaaaacaaacaaaaaaaaaaacttcaaaaagtcagtttagttaaccctcacaagaataaatcccattagaaagaatcaagtgattccactaaagaaatggcccaaatggctgtaatcccagcactttgggaggccaaggccggtggatcacttgaggccaggagttcaagatcagcctggccaacatggtgaaactccgtctctactaaaaatacaaaaattagctgggcgtagtggcaggtgcctgtaatcccagctactcttgaggctgacgcaagagaattgcttaaacctgggaggcggaggttgcagtgagccaagattgcaccactgcactccagcctgggcaacagagcaagagactgtctcaaaaaaaaaaaaaaaaaaaaaaaaaacacagaaatgtcccaaaaaacagaaatgtcccaaaaagcttcagagcccttgggggctgggcacttaagaaggtggccgagctgtggagggtcttctatgtccatgcctcgtgcatgcctccgagggcaaggtcctgggaaggagcccatgccccagtgggaatgcatgtggcagaggcacacgcatgctcctcacagcagcaacaaatgccccctgcacagttttggatgttggagtggctgctgcacctgtgcgctttcctatctacacccagcttcccccactggtgttgctgctccaatcctcacggttctattgcagataaacccgaggagatagtcccggcctccaagccctcccgcgctgctgagaacatggctgtggaaccgagggtggcgaccatcaagcagcggcccagcagccggtgcttcccggcgggctcagacatgaacgtgagtggccgtaccttgggaccacgagggcgggggccgacggtgcccaggaagtgggtgggctgtctcagtagctgaggtgcacacgctttcatgtctggttcgtgctgtccagaggtggggcccaaatctaagtggccacaggacaaagagccgggtctgtgcagactcacagtggtgggacagagcaggctgcatccaagccctgcccttaccgctcactcagtgccctgagcctcgaaggtgtcctgtcatacttggctgaggacccgtgagcacatggaagtaaggggccttgacacactcttcagacagaggggctcttgcctcctggtccacccagagcacagaaatgctccggtgtggaagaggccgtctgtcccacatcccatgtggcagtcccccacactctccgagatcctgggcaacacttgtcctcggagccagaagtgccatgaagggcttcagtggctgctgggcgcagtgggtgcctggctcagagcaggctgcccgtgccatggtcaccttccctaggcagtcaggagggcacacagctggaaaagggcctggggcagaggctgctgattcccccaggcacgtcctgaacaaggcgtggcctcctggacccttggattgcttctccattgtgcagaggcagccatctgaacctgatgtcagattctagcactgcctacctgtcctgattgcttaccttagtattctctttgaaccagtatcaaactgcctatgtctagctttttcttgaacaataacacctataaatattataaatttaccacaaggcttttctgtaatgtgcattaaacaactgttaataattacagttacaatatctgccctcacacctcctcccatcacctctgaactccacaaggggacttcccctccaggccctgcctgccggtccttgcctcccactttgttcccagtccttcgtggcacccacatgccccaccaagttgggggggtgtctgagacaaggtgcccttgatctcccaaagggtcccactttgctcctcagcctcagggccatagagtgagacaaacagaggctgtggacacatggaaactgcatctcaaagctggagcaataaaagcttgcacacgaatatttccattgagcgtccgcatctgatattttcccgggttggccttcaacactacaggtttggggccctgagccatctcagttttgcagacaaaacaacagcctggggaagcgaaagagttggcagcaccaggactctgcttccaaggtggaggggaggaggggagctctaggctcctcctgggacaggctgaagagggaggaagctggggacagctcactgctgcagactccaggctgtgcccctgagcagctccagggcttgcttaagctagctggcacatcatgctcacccacacaccaccacaatacctggttggcctttgcacacactgtggggctggtgtcaggagcccattttatgaaagaggagatggtggctcctatgtaaggacttgatggtcacatggcacatggggagtggggtatggacccaggccagaccccactgcccaccacgctgtgccctttcccacaggacatccagcctggcccccctctcagagagacgtatctgtccagctgctctggcaaatggtgttgcagcagaccacatctccatggaacagggcatgctgccatcctaacagggccaaaggccaatagcagctgcagcgaataggaaaggcacctagagagggaccttcctgggtcctcaatgctgtggttctcatcagccccactggagactttaggtggctccagaagcagcttggggaagccacagtgacggaagttcccttgtggtctctgggccctgtgaccgtgggtgggggctggccagggctgcgtctcaccctaggctctctggtttgcagtctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataatgtactgtgtgttgcagaaaactgccttcctttcttcttaatgtcacaattattcctattgaccctgttgcaggcaaaggtacacttgaccttgagacaaggtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggttagtgaaccttacggtttggaatctgtaatctgaatgtaacccagtttactttataaggtgtattcttaaattagtactccttgggaacagaattgccagacagccaactcagagtgactggtcaatggagaacactttgaacgagccatctttgcaatgccaaaatgtcctcccacaaggagtatgttaaatttggaatacccttatcgaatggaagttttcattggaataaattattgtagtttgtcctaggactttttttcatttcaagtaatttattttgctacctctttgaaaacctgcatgctcccaacatgaaatccctgtgccacgcgtctgtcggtgtgtgtgcgtgtctcgcttcccttctccaagtgctcctgttgacgtgtctgtgtcttcagctgttgaacagtctgtaaagtcacacctaggcaacacacccagagaaccctcaggccaccctgctggctgtcgtaggacctcagctgcatccccacacattcaacatccacatattttcattaggtcaactcatactttgtgccaggtcagccacacttggaccctggttagttgcgattatggtggtccactgggctctcagcccctgctccaaagggtcttggcaggaccactttcagggctgccgctgggacccagaaggggctcactgaggcctggctcaggatcctattcctggctcagtccaggactttaaaggaacctgggctccctcccctcaggggcaggctctagagcccacatggcccctcctctgagctgcaattccccagccatccatctctctgaaggtccagagagctcgaggacacatagaacccttagtggggcccagtgaagtcaggcaatgaaaggattcacatgaccctggaagaaaagcacctcctcccagcacgcacagagccaaccgtgggcagatggcttcgctcagggtggcagaggcctccctgtacatctgggcagccgtggggctcaagtgccatctggacggtggactgcacaccatccttgccacataaacacagcaatacctgcaaccctttgctctcatttcagatgcacaggtgacagccttagacccctgccctaaaaacacccccaggagcccttaccatgcctgaaggggcatggtggaaggatacctcctggtctagccaaccccgccccaagcacaatgccacaatgccagcacaagcacacgtaagcgcacacacacacgcacaagcagccccaaggcgagctgcccacttggcctgcagactggcacacggctcagcgtcaggggccctcctgccctggcctcacacagctcccctgctgcagcctgtgcctggaggccccacagcagcagcgtactcacagcatccccagtgcctttctgttcttccctttcttgtcctttggctcacgacgggccatgtgactaaccactcggcatcgtggcttgtgctgtgtttcctgaacatccggttcatcatctgaatttgtgagtttgtggagatgtagcgtatcgcacgttcctaggaacttaggctttgttgctattgtgacttaaagctaaacctgttttctgcttgtaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaaggtaagtccgcggttggtgcacatgcacaccgctctgcgtgcactgtccctgctgaccaggaaaggccctcgggtagcagccccagcggacacgaagaggggaattcgtaaagcctgtgtgggccacgtctgttaatgcagtaacacttctttttctcatgctcctggactccgggatagccgagtaatgatcacagccatcctggtgggacacagcactccttcataaagacttgtaatgaaatgaggttgctggaagccctcctcaccttggcttccaaagagaagctctactctctcttctgtgccctccagatctctgccaggaccacctagaaggccgtttagagcctcgccaaagcccaaaccaagcttcgagttggttgcaggagactagctgccccaagagggcagcgagtgggtgggcggtgggtgcaggtgtctgaatacacgtgtgggttcttcttcccctcccatcactaccaggtttgcgggcttgggaggcacagggtcatggctgtactggtgaactctaagtgcagtacattcttccctgccagcccatcctgtcccaggggcagaagcctctagctgtgtccatgtcagcccttcacagtattgtgcagggtttacattatttccattggaactgaacgtagaataagtcaggagtcatttctagacgcaaccagagggctctatctgaggctgtctggaaggagcctatatttgatcattcttgcactgctataaagaaatagctgagactgggtaatttataaaaaaatgaggtttaattggctcgagttctgcaggctatatgggaagcatgatgttggcttctgcttggcttctggagaagcctcaagaaactttcagtgatcaccaaagggggagcaagagggagtcgggggaggtaccacagtctatttaaacaacctgatctcatgagagctcactatgtacagtagccagggaagatggtgctaaaccgttcatgagaactcccccaccatgatctgatcacctcccaccaggcacctcctccaacactggagactacaatttcacatatgagatttgggtgggaacacagatccaaaccgtatcagggctcagcagtctgtggctttggggagccccattggctcccgtgatggcttatggttcttggttctccttccctgtggtgtgcaccattttgctgttccccaggtggcagcatcttcagtctctcccactgatatttgatcttgggtttcatcattttgactaatgaagcctctctccatacccctgctgggcaggcatttgatttaagccactcagtgcattaatcagtgacatcacatacagctggggctcaagatgcagactgagagccccaattttcccagttatttttcagtgtggatgtaaataaatgacttggatgtcatctattactctaaaggagtatcgataggctggcattggtatagagaagcacagttacactgcagacattcagacagtgcctccagtcaaggagaaagtctaagaattatgtacgtatacacctacaagtacactcaacagcctccaggaattttgagaaagggtgttgctttgccgctcaggctggagtgctgtgacgtgatcacggctcattgcagccttgcagcctagacctcctgggcttaagcaatcctcacacctcacctagcctcctgagtagctaggacaatagacgcatgccaccacacccagctattttttttttttttttttttttttttggtagagatgaggtctcaccatgtgtcccaggctggtctcgaactcctgggctcaaacgaaccactcacctcagcctcccaaagtgctgggattgcaggcatgagtcactgcactgggccaaaaatctgaaaaactgactagtttaacccttccccattacatactaatgtggctcttccgtcattactctatgtggaagcaataattaaagaggccttatcttagtgtttcacatttttacaaaacactttctcatgggtgggtaatttttatgacaactggggagcaggtatgagtcacacccatttttcagaggataagtggcttgtccacatacacagccagcaggaggcagagctgggacacaggctggggtttcctgactctcacttccccttgtaagcaatgtctgcagtaaggaaggagctggaagggaatggctctagggctggaggaaggaatccactgttcaggtcagcagggcatcctgcaccaagctgtgctcccctgagcactccactcggggagtccagggaccccgtccatggagacctctccctgagtggcagctggacagctcatcccctctactcgtcttcaggctgggccagctcctggggtgcccacaggggagtgggaccccaacttgcagcgtctctagggtttctctgccctgcatttctccagggggaccctgagagggggctggctcaaagcagacttcatagggcagaatcctgctgtactctgaaggagagcagctgcataccaccgccgacccacgcgtgagtgccaagaacggccgcctcccagctgtcctgttatttatagcccggctctcttacagtaagaacaggagcccacacctatgacacaaagcattcaccaaacgccaggcactacattccacggcacccctgagccagggcctgtaatttttcccactgtgtgaacaaggaagcagaaggcagggcggtgaagctactgagccgaggctacttcacaggaagacgcggaactagacctccaacccatggagctggctcagggtttgactcctcaccttgtgggagccagggactgccttggaaggaatgaccaactggcaaaccgaacacctgcaaggctgagactgccgcgggcggggctgctctcaggcctctgactgtccttaggccaagctctttggtcagcaagaggctaatagcaggcttagtcactaggaggtcaccctgcggccgataacagcaggcttagtcactaggggttcactggcactgccaagctcccagaggccatgtctgttcccttcttgctcccggccaagggttacactttacactcagagttggactagaaacaggatggcctgaggccagaggacaaagatgaagagcattcactgtaggcactaaactaggctcaatcctctccctcgcccttgcttctcggatctaataacctcaccaggctgagcacttgggacaaagcccccatggaggtgcgccacggccacgggacacactgacaaggacaagtggggggcagtcagaaccaccactgggggggggtccaggacggagttgccagggcaccagagctgtcccccttgccgtgagggctgtctcctctcagccacagacctatctctcagcatgtctcctttgctgggcgtggtcttcactgatgggccctgggcatttgatcatctgaggatcagagggagccttaagaactctcacctgagttcaccgcctgggcgactcaccaccacctttaaatgcatctaaaaattaagagctgtgaatggccctgggcaaaatgaggcacgaaattggatgaagggaattcctaccgaggaaaaagaaatgagtttttctagggaaaattgaaaaccagccatgctttttgaaatgacagataagcagtggtgtaaaaatcccatttccatagaaacaagttttgactgcccaagaaagggacaatttttagagctgttcctcaaatgttcattcatgaaatgggcagaaacctcagctgaacttgacccttttaaagttcctctcatccttggattcttcctttcttttcacttcttgcaagaatccaggatgggatcaaaggaagcagctgaagattaaacaactagatccttgttttccttgggtatgtttgatttaactttagccgtgaatgagtctctgatgctcaaagctcttccctgaaatcaaggatgacatggaatttgcaggcgtcttaattacaaatacgccgacgaaaggaagatgatgaagtagttctctttagtacataatgttaaaagagaaaaaagtacatcatattagaggcatctcccagggtgatctgaaaacaccctgccaagaatggaggcgtcagttctaagaaaagtgttccaggaccacctggcctgattattccaggaggtagtctcatctttgatctcaaactggatcaaagtgaaggaaactggtttggggaaggaagagtgagtgtgtctctgtgaagagtcagtggtccctcctcagcagaatgccaagacaacagctgccagcccagaggcctgacagtgctgcacgctgggggtcccagcacaggagcctggggctgcaaaagctcagagccggaagctcctcaggtgcaggcctaggagactgactggacactcagacttggaatcatggcccagccccactgtctcctgaattcaccagtcaggagttcactgagctactttctataagcctagtgccaggctgaggctagagagtaacgaggaatacaccaacaaggatgcctggaccctcagaatggggcagcaattccgtcactaatcattcactcaacaaagttagggattgcctttatgtgccaggtgccatgctgtgcccaggatttatcactgaacaagaaaacattccagatgcccctccctttggggagctcaaattctcgaggggagaaatggacaacaaataataagacaaacccaaactgtgacaaatgccacaaaggagccacaacatgctaataggttagtgaccagtgcagaaaggggctgtgatgcaccagcaggtaaaaataaccacgtgcagaagagagccacgggacaccagcaggttaaccctgaccacatgcagaaagggcggactaggatgccctagcaggttacagtgagcatgtgcagaaagggactgacactctgcaaggaaatgacatttgaatgaccagaaatttaaaaaggagccaaccttgcagaaaaccaggagtggagcatcccaggcacgggacagagagtacaaggccctgaggccagaaagtgccttctgtgctcatgaaaccatggccagatgaggagggctgggcagggccaggtcacaagaggcttgcaggtaatgggcatgagctgaatggagttccagatatggctgccttcagagggcttcagcaaagtcttggcatgaccagactttgtttcctgaagatggcccaggcagctgtgtgatcaggtgaatgcactggtggcacagggaggctgctgtgggagtgtagggcctgcattctggagacaagcagggagactcaagggctaagtgcctaaggaacccaggagaacacagcagcttgcctgacttatatgctttgacccaaaacaaacttgctatgacccaggagccccaggtgtcatgtgccctccagctttattgagagatactgacacataccaggcgccgatagtaaagccagataaatctgatgttctttaccatcgcttccatggcagaggtcagcttcacatttgctctgtatgtgggggcaacagagcagtgagtgtgtgcttgtgggggtcccccatggcttctgttagggtgcatggcctataagagttccccagagtcccctctaggtcgccagccctttgcagtgggtggggtccagaagggacctcgagattggccttcgcttccccatgggatggatgggcttcagggagatttgtcctgtgaaactccaggtcccagaggcccctgagggagttcaggctacctgggatgtgagctcaggcgagttttcctcccgaggcccctgcgcctgctgcctcacggtacctgcctccccttcccaaggcctccagtccctactgggctctctgcagtattatcctgacagcctcttgattttcaaataactttgggttgttaaaaagttatctctgcccagctggtcccagagcacagactgcttcaaaactgacttggtactagaagctgcctcacggtgttttcagcatctcaggaccactaggtggtttgagggtttccaggccctgatggaaaagtgaatgtgacatcagtgaatgcgactgtgggtggctgggagcactagtcaggatgtgcgtccatcggggctggtacttgcgggcgttgggcaaggatgaatgggagtgcctcgtccttgcccatcaacaggcaaatctcaagtcagaatcttcctccccattttggacatgaggcccttttggcaaaagcatatcacagggttaatctctcttcccaagaggtgggcaccttcttgatcttagctgcgaacctcctggcctgaagacctggattcctggtggaactgccgcggagcctcaggctgcctgccccactcccaggtctggctctgtaactcggtcaagtcacttaactttctgatctgggaaaaggatatattatccatcaacacttcagtcaacaattatttatcgcacccctgttctgggccagacctcaaggactaaaactagaccaggaccccctcatggcactcagagctgggggtgaggcggaggcctggcagctgctgagacacaacataacacatggcacagctgggcaatatgggctccagtccccacatccaggcctcggggaagctaggtaaggacttgctgcctccggttctatcttttcaatgccctgcttatcaggaggctgtaaagatggaaaaaataagaaagcagtttggaaataagtgctattttcatgcaagatgggggctcatcactaaaatgcagaggcgtgcggtgtgctggagagaacatatgttgacaggctccaagtccagcctcagtgctggccaggcccagcaggcccttgacaggcggctcatgggagggacagaaccagcatgcctaatcagcatcactgaccagcccctggcccatgttcagctacagttaaagagcagattactctagctatgccagaggctgatgcaggaggatcacttgaggaggttgaggctgcagtgagctatgattgctgcatgaccccgtctccaaaaaaaaaaaagccaaattgaatttgtaaacagtaaaaaagccacttgcttctttacttacctcaccccaattaacttgtactgactgatgaaataagagcacctctctgagtgtctcaattaccttgattttttttaattctcacatttctacatgaatgtgatttaaaaggcagggtagacagtggtgacctggtggggagttgggtgtgagtgtgtatatgtgtctgtgttctaaatcagggcagcagattcctgtgtgttccgactgggaacccagcggttgcttagcaacgtaaccatctgtgcaaccgggaagatccagtgaatatcatcaatgtgattaaccaagagagtcaagctgctgaggagggcagggcgggcagcccagggtggccttcaccctgcgtctcacactcacaggcggttactttctatagcaatgtggggcaggacactggcaggccccaagcacttgacgcccatgtgattaacggctgggctgtcatctcatgatgtagacttgaagcaaagcacttgtcctgttggggtgccctcccccaccaggaatgttcgtttatcctccctaagccacaggaaagacagttcaggcacctgaggtaggaaattggcaataagctgcttctcagtgggcttcaggcagaggcgaacttcactccaatgctactattttctttcttttttcctggttatttttcttctttacaagtggttacattatcccaagccaaagaaggagaagacaagcttgtgagtttcccacgctccctatgaaagtgatgccatattgatgtttcagctctgggcaggctgtggcaggccgaagggaccaccacggatgggctttcagccagggtctgccccactgccttcatttcatctgtcgaaaagcagcttttttctgtttcttcctttcttgttcattaatttttgcagtgttgtctcaagtcattccatttgtcattttcatttgctcccatgaccggtgttaacagaagagggtcgtgctgaacagaagtaagtgccacctgctgtgctgctgcgtgaccccgtgtgtgccactctcgcgctcccgctgcccaccgaggtgtttgcagagcctcctcttcgcttcctaaccacacacacagctgcctgcagagcctttccttacaaaaaccaaaatcaatcccaactacctgggaacagctgggtattttcccagtgagggcagcactggggcaaccctctgggccagagatacccgtggtgaatactgcccaggcgtgaggtaggtgctctcactctggggctttacttgcctctgcttcacaggcctggtgagcaccaaggccaggcaccagtcatgctgccacggtggagctgcccagagtcagggctgcaggcacagtcaccatgtagtcagctttagcaaaagcacatggagaccagaactttaccccagctacccctcctcctctagtcctctgtgggcatatgtcttcttgtaagatgttttcccattttataggaaacattccctgtgccccaaggtccttggccctaattaacaccccaaatcacctctgaatgcagtggctttcaacttacccattatttgatttcaatcatcttggcttaattgttttatcaacgtggacaaataagccttccccaaaactgtgctcttgtgactctggaataaacacagaagaacaggccacagcacccccagttttaagttggaactggagctggtctttcgaccttctttgagtaccagagaagggggggttgcaggttttttcgtgtatcctatgtccataggccacctctctcttgagagtataaactgagatactagagggtgctggcccctctcccctgctgtgaagccccactgggctctgatttgatttcgggttttttgggggtttttttattgttgttgttgttgtttttgagaagaagtctagctcagtcgcccaggctggagtgcagtggcacgatctcagctcactgcaacctccgcctcctgggttcaagcaattctcctgcctcagcctcccagtagctgggattacaggcgcccaccaccacactcagctaatttttttttttttaatttttagtagagatggggtttcaccatattgaccaggctggtctcgaacccctgacctcaaatgattcacccacctaggcctcccaaagtgctgggattacaggcgtgagccaccgtgtgcagcctctgatttcttgattgtgagtaactgggcccagaaacagtggaggaatcctcagagtctcacctgccttgtgcctgttggtgtgagcagtataaccaatgaccagcaagccaccattgagggtgggggcaggttctagatggggatgcctggtttgtaacatctcccactcaggggcacccagccctctggaaaatagcacgtgaacaccctatgggtggatggggtccctggcccagcagtgcacccaccagcccctgcaaacacttctcacagtaggattgaagcctcagtccacagcacaggcccctttcagatttgcccctcctttctcactatggactagtccacactttaagcaacagtgactaacatcaagtaggaaactgacccacagcttaggggaacctaggtaactgatgggtggtttcacccaaatatacatccatggtaaagaaagagaaaagaaaaaaacggagagagacagactagaccagcagcggggcccgtctccaggtcactccctttgcttttagctcctggagggttctgggccattagctttgtgcataccctggaatgaaaaccaaggcccaaccaaatggcctctaaggttcagggtctctcagtgtctggggagtttgttaattgcagacacctggtccccatgcacagcactcctgcttccacaggtttgagacgagctcaggagtcctcacggcccaccagtgtcccaggtggtttctatgaagggtctgtgggctcctctttgggaagtgctgctctaactggtcagccattgagctccaaagacagccccagtgcaagtcgatgaactggcccccagcagacgggcaggggcttcagtcttgccctccagggagtctccccacacggcagcatctctactgtttgcagctctccccctcttgcccatgaccctttcactgagacactgcagcccaccaccattcacggtcacgatgtcacaccagtgcactcctcatgctctccagagcccctccacccagggtaacccaccacataggagggagaggagcccacttcatgtgggaagatgtggagacaggagaaaagtgcacccaagctggcatctgacagagccagggctccagcagacatctctcaagtccaggtcttgaagagagagccgtggtaggatggatcttttcagaagcggtgggtgggccgttcatatccacgtgaatgggcccaaaaggcaagagacccacacctctcctcccctccccagtggctgtggctttcctagggacaataggatgaatgggctttcagtgtggggacagcaaaacatgcactagggcccagagtggcagttctcttggtgtggagagtgcctgccacaggccttggccagagcccgtgagggagtggtgtgtgaaaggccacctccacgtgggtaagcgtgaggacttggacttctctggcactgagatgggacctcctgcctgtgggagtcatctggccaccaccctggggccagtaaaggttggagctagaagggtcgtcctccctgacttgagctctgagggctttgcctgcccagccagagcggcaaggcacaggggaccctcggggacgcccatggccaccctggggaagacagggctcctcacgcgttctgcttttcagtaaggcccgtgtgtcctaccagtgagcctctcacatgaaaggggctaaaaataacacagggtaccccagctccttctgcaacaaaactgtccactgggtgggcgctggacagtgctgcctcaggaaggtgagcgcagcccacactggccacacaagccacgccctgctgtctgggtttccgggtgatctcaacccctgagtgccctgcgtagctacaggggttccagttactgaaaggggccacctgggaaggatcctgccctgctcttgtccatttacccaaaaagcctaaggctgccaggcggctgaggggcctgtcctccaggtgtgctccttcccacctgctgaagctgaggcgctggagatgttgcctggcacgttctacccaggtgacaggaccccactctgtccctgtctccgtgccctcttcaagggaccccttccaaatgcctcagtggccaccctcccgagggtcccccggccctgccccccagcacaggcaggtcccccagcccctctgtcccagttcaggtgagtgggctgacgtggtgtgctccccccagcacaggcaggtcccccagcccctctgtcccagttcaggtgagtgggctgacgtggtgtgctctggtgtctccaactttgctctggcccctttctccccctcccccaccctggcatggcaaatcattcgttcactgccagtggatctgccactagacactctggcatggtttgggcgtctccctcgccttcctgggtgatctgcagccagctgccctgactcggtgacctgccttgtgatggttttctctgtgttgctgtttcagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 37885 - DNA, 6667 bp, Homo sapiens
agctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagagaatagcgtctcctagcagccagggcgtgcgtacgtgcgtgatgtcgtcagtgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcaggtactctctgcagcaccaggtaggaggggactcaacccccttcttgccttttcagttacatcagttcctactagggattccacatacacacagttggcgtctgttgtgattttgtggtgatgacgagaaaagggttggctaagaaactgggcggcagaaaagaggcaaacattcactgtagccatttatcccgatggaagtggccaggccctgtgggggacattcagcctccatcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaggtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaagggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaagtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcaatgtcggttttggacacagtgccacgggatgtgggccgcagatgtgggaaagaaaggcagggcagagagcagctaggtctggggcaggaacgctgtagctggtgatgccactcacagaggtggaagggaggtggacttggtggtgatggttggggtcctgagtatgtacgggcctgtccacctaaggctgagtctgaaggggggtggcctgcaccacgggattcagagcaggacggtgagcaacgtgggggtcccagaaggagggaaggagtgttcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccgggggcggggccacgggcctgaggggtgagggcagccactatttctgactgttctattaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatgtgtgtggggttgctagttgttctgattatcattcttcttttctcagctcagattgggacaggggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagggtgggactctccctctgtgctggaagagggctaacaccagcccggactctccactctggctaggccaagggggccctctgtcctctgtgttgccctagggctcggtgacctctgtcatagcactgaccacatggtatcctgcctgtgccttcctctagctgtccccgccctactccggaccgccccaaagactccatgggatggacctgagtcagccgaatcccagccccttcccttgggcctgctgtggtgctggacatcagtgacagacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccacgagttctggtaaatcatttctccactctgggcctcagttcctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgccctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatg

SEQ ID NO: 37886 - DNA, 121509 bp, Homo sapiens
atggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtaggtgaacctcggcggccggcgtgggctgagggagccgccactgagggtgcgggcgccgcggccggctctgccagccgttctctggagcagcgaggcggttggttgtgcgagcgagtgccgaggactttggctggaaacttttcgccgcgcccggggcgaggccctggaagggccaggccagcgaatgctgagccggcggcccgctgccctcccccgcggccgcgcgggtcgccgtgcggatggccgagggttggcgatggtgcttcgtgcgccgaactccgggtttgctccggggaccgttacttcctcgctcattctctgggaaccctcgtaggttaaggtgccgggatgcacgtttgccgctttttttcccggtgaaacttgagctgtgagcccagaaaccctagggaccggagcccgatggaatgaagcctccgggtccacttctcatggccttccaccctggagaaggcaccattttagcccacccagccgcagaatcccctacagctagttttcttctgtcttgtgcccactcccccggctctgccctgacagcttctggagctctctagattgaccctcgtccctgccctccagcttgtgggacgtctctcacactgcccgtgcttattttaccaaaccgcaggaacaagatttacgtgttaaatacctgatttcatggactgtgtgccccggctgttctaaccaaaacagtcacgcgcctgtttcccatctcttgaccctcgtgttatgttactgttttcctgtcatatttgggagttagtctctgagttttcttcccaggtatgccagactagaagcctgcttattaaggactgtgctaaaaaaaaaaaaaaaaaaaaagtctgcctcatgcaagagaaatggacttaagtggtaattaatgggaggcagcgatttgggaaaataaggacaccagtctttggtgggaggaggagtatcagaacactgcgagtagttatttatttgagggctcttggtaagaaaagtagaggggcagaacttaagcttggtcaaagattggttttcagtatttcataaaaccgtaaactgaagttttactagtatttattaaaaggagagatgtgtgcacatttcttgaatagtgtgatttagaaggaggagaatcctgttacatggtaggtgagtcagggtagttggttatgagggaagcaaagtttgcatgatgggattgagtgtctcttctgggctgagaatttccactgacagtttaccaccacgtttccagcactgtaatgaaatctgatttacacagagtatagtatggtaaatggaatgttattaattgtacgctgtttctgtatgccgactccgcagatacttggttccaagacaaagttcttaatgctatacctttttaaattgatgccagagtctagattgaatttgtgtgctgttctattccatgaaggagaattggggatgttgcttacagttgagtgagaggacagttggaggggaccttaccagtttactatcctgacttcgtttatgttaaggactgagagaatatttatacctccacagaggcagatctagttaggcaaagctctgtggaagactgaagccaggtaatatgcatagctgatgcaggaattatttacatgataatttcttagtggttgtgaaaatgaattgttgattactttttgaaggaacacattggttttcacatggaagaagaaaacagttttaaaaaatctcaatgtagcattggaaggacttgatttttaattcagagcttaaaaacttaagcagtgtaggcaaatggactgtgttttagagcaggtgtagtgtttagagtcaactcttcttgttgtagaggtagacactggttttgtattcctgtgtgctactcatttaaacagcttccttttttggcttatagtgttataacaccctaatttgtgaacctttatgacgagttttttccatcaacctttattttggaattaagtctttgaatagggcacagatgttgtgacttatggaagcttagtggtatggaagcaaaattttcttcaagtaagctgttagtctaacaagttgttgatttaactactgttttagttaatagagttataatgatgttcatagtactgcttacaaggtttggcatgtaattaatatttgcgtggagccagttttagagttgaaaagatttttaagctttaaaaatatgactgtagctgatgatttgttgatgagaatgctttacttgttttatgacatatagatttttccttttgctgctatttttgatattttgatatgtttgatatatagcgtggccttaactttatcgtgttaatttaactgttaaaaatatccatcaaaactggtggacctgatattctgaaggctataaaaatgtttatatcagacttgctggccgtttgttttgggggtgtgcattatcttatttggagaactgaacttttaaaatgagagttttacaggttgtcaaattgccagattttttttttgtttttaagcctaagagattcctaggtataagtgtcaaggggactgggcttacgtcatcatctgacttgataaacgtcatttaattatgaaattcgaagtttctttatgatggcaataatcaattcatagatgattagatttatctcacttttacttcccaccgtttttttttcaggggacatagagaatattatcatgggtatggtaatgatgaataacaagatagactgacctttgtaaggtcccatttggctctgagattctatgcctctttccattttcagcaaggcttcatcttaagatgaatgtttaaaagagcacagaaaagaagatctgatatgatatggaacttttaaaagcactttgactacttgataggcacttggggacataacacacgcataagacagagtcctggcttcaagatgcttgtaactttgggttcgacctaaaggaaacatgattgtagaacagtttggtgtttgtgaggtattttgatttgcccggaaatgggacacctaacccattaggtaaagacttatgaatgtgcaatgaaaaaaacagtcatttttaaaacatcatttgggtcagatcttattgagatgtcttcttccttccctgtccttccctcccttcctctctttctctttctctctctagctgtaaatcattggcaggttatttaaccttggaaacttgaagtttctcttgttttataaagagataacattactaccttgctgatggagatcttgtgagaattaaatgacagaatagaataaaacaattagaagagtgcatgaaatatagtaacactcaaatgttagcatttattatattgcgcagcataaactaaccaggctggtattagtgattcttaaattctacaccaatgtgctgaataattgagttttcaaattgactttctgtatttgtactttacatctatatattgagtcttagcccagtgatcttcaaatatttgttaaatttactttatataaatatacagatgagtattcagaatattagaatgtagtcaaaatacttcaattgtataattgtatggaaactagttgactattcccttaatgatgtccagtgcattttaagatttggcagttccataaggtcacttagaatgttagtgatcatactgaagataggggttggagaagggactcataatttgcttctgctttaagttactgatggtatcagttggggtctatagtacatattgcctgcatgagtctttctgcatcctaaacagatatttttggaaagtaacccaaatttagaagcaagcagaaagatcaaatcttcctttcttgcagttatctacaacatcagaaataataattggaaaagctgggcaattgtgtttattatatatatttaccttgtttatgtcacttatactttcatctatttacaatttagtaatttggcaattctgatgtatgttttatatgtgtatagttaagggataaaacttatgggttattgttaattacttgaaaattattgaagggaagctggttatgaaaatccttgttaaaagagagcattttgacattctgtaacttaacccttaaaaattagtgagtaaataatacattgctataacatattctgtaatctattaaaatcttcataaaagttgacaagcactacatggtttgcagatgagacagttaataattactattaatatgtaaatgtaggttaaaaatcaaataacagttaagtcaataatgaaactttaaagacagttttgtgtaccatgcacacagatccaaaaatctgagcaccattaatctgtcatatgtttgattacttcatatatttttgtctaaaatggtctttaaattgttgaatctgtattctttactgaattttataaaatttatgctttttatgtattagaataaactctgatatagtttaatcatttatttaaaatctgttgtgaggccaggcacagtggctcacgcctgtaatcccagcactttgggaggctgatagcttcagggcagatcactttgggtcaggagtttgagtccagcctggccaatatggcgaaaccccgtctttaccaaaaatacaaaaattagctgggcatggtggcaggagcctgtaatcccagctgcttggaaggctgaggcaggctaattgcttgaaccccagggggaggaggctgcagtgaactgtgactgcaccattgtactccagcctgggtgacggagcaagactccgtctcaaaaaaaaaaaaaaaaatctgaaactttattaagggtagcttcaaggtttttttctaaaagagttactaattataatgtaacttatcaattacaaattttaatgaggtctgcctcctatgagtctagatatagccatatcgcaggtattatagttattttagaaaggatattatatatttatattttgaattttacttgttttctttagtatggcatccaggagattgtttttcttgcaagactattgactgcccaccattcattctgctaaataagttgagtagggaagacctgttgcattgtgagtagatattcataaactggaatgtgagccatgtgtaaaaaactttggtttcaactttaatggtaaaaaaaaaaaaaaaaaaagatcaaacttgttcttaaataggttggctgttgcacccaatagaggccctttaggctttcagcctaggttttatcacaagaaataaaagaacagaaaaagggagtggggctgtaaatagctattctcaaatagttagagcctgcaaagataggatgtgtgagttaaaatcatagttactagggaatcttttttgaagcaatgtggccgggccccactatggacttactagatcaacaatttttgtaagacgggtgaggtgtggagtccaagggttgggacatttgtattttgaaagacaacatcagataattcttttttctcttgacaagtgctatttattatagcattttcatttatgatttgaccaaatattatcaatcttctgaaagaaatgtgcttcactgttttgttcattatttgtattcccatgtgcttggcatgtagtaggcactcatatttatttcaagagtttgatggcgaaatcaaggttagtccaaaccagcacgttttaatagaactataatgcaagccatgtaatttcaagttttcttgaagccacatttaaaaagtgaagaagaaataggtgaaattaatcttattttatttaacacaatgtaaccaaaatatcatttcagcatgcaattgttattaaaaattgagatattttacattttctttcatagtaatgttttgaaatccagtagatatattatacttatagatcatttcaatttggactagccacatttaatgcactttgtattcaagtgtgatgttcctggtggctaccagtttggatagttcaagtctgaacctttaattgtctctaaagtgggttatgcccttttgtggtctttacccataaggcctagaatgacattgctcttcctacctaatcaaattctgaagggcttggtttaagattgactttctccaggaaggcttccctcaccacttcttgcatacagtgagcatgcaattctgttttcatttttttcatgctttcaggcttaaaacagtctttgttaaagtgtttctgtgaaacactagtctcagaaggtaggtttttggaagaaaaagtaccatgttttaatacatttgggaataggaaaagctaatgatataccccctcatggaaagttaacaatgtgaattagtttattaatggtctaagaaattcttcagtaaaatatcccatttaacaaactaaacaaattctttggtgtaatatatattatgttgcagaagctatgttatgcagaatacactataggaatatattcttaaagagatttgtactcttgatgattagaaaaggttggtagacttaaagatattacttgagatagttctccactgatttttcctttttaaaaaattatttttcctctcttcagttctatttcccattgcctcacccattttgaatttgagatgtttgcagaattgactttctatgagaatagtagtcttctgctttgttatttcaaaatcagctgtatattatttacctgtctagcttaagctgcttctgtgagatgtatcgtacttcatgtatgacacatctgactctggaactgagttttatgaatgaagtgggtaaatttaagatagtctattttgtaatggaagtatgctaatgtgaaactgtgcagggctaggactccaactaagtgtctgagaacattatatataatgtcaggagtgtgcttgactcttctgttgcttcaattcagaagaaaaaaatattaatgaaatgctagtattggtaaactgtagtaaaatcagtttaatatagtaactgtgaattattcatgatagacatgattgctattactgaaaatcttaggccctagttttgaagattattaataaaatttctaatttagttgtagctagattcttaaagtactcagcaattatggtggctattttgaaactgtgcattgtttatcaagcttgtttttcatgtaaaaggatctgggcattgatatattttcattatatttgtagttaatagtaaaaatgtttaaatgtcctttcattatagactcagattccctactaatttgatttagagataatcattcatggctatacatttaatttaatactaagcctgacaataaactgcctagtttttaaaacctgcttagagataccatacctactttattttaaatgcaaaataaaaaagtccttctccattcctttaattttttggaagagaatcaagtggaagaaggcatatagctaacagttctatacttctctttaagggcacaggactaaaacatgatagcagcatttctcacttaatcataagcctgcttatgttaatggctactgcagtcactctaaaactctgcatttctgcttgttaaatttaaaggaagtaaaaaattactgccaacacaatctttgagaaacatgcaaataatacagttgtatttaatgtcaacttatatagtagcttccccattcctataaacacttctgaggttatatgattatcttgatgcagtttttctgcctagttcatattaaaagcagagtgaacttcaatattgaaataacagtaagggaatttctgttctttttcaaggtgttgcattgtttattgttgtatactagtacagtgccaaaggatttataatttttttcttttaaactggtatagaccctacagttgactgattttgaataacaaaaaggcatatcaagtttataattagtaatactaattagcaggaaataagactatctagattattgacattcttttctgtatttaagaaaataaaattaagaaattatgtttgccgttttcaatgaggaaagattttcaacttcgggattcttaaagtactcagcaattatgttggctattttgaaactgcattgtttatcaagcttgtttttcatgtaaaaggatctgggcattgatatattttctttatatttatagttaatagtaaaaatgtttaaatatataagtagctggtgaaatttgtatttggcatgccccaaagccccttttccttcaaaagctttaatcctgacagcatctcttgaaatataaaacaaatttgaagttccctaagaaaaatacatgtttttctttgaggatactactgttgctttgctgccctctacagtcatctaaaatagtcactctagatttttctccattcagatacttagaatactttttccctgacctgtgtatgagctttatatttcaggaatgggttaagtaatatttactgttacagaagtaaagtttagtcacagttaatctatatatgtcatgcaaaaaaaaaaaaaaaggacttagagatttgaacaagggataaattggggactattgagcaacaaccatgtgctagggagtataaaggataccacggtggaatgaggcatgttggccctctaaagcttatgaactcattaatacgattaatggcatgcttatatatcaaatgacatttgtaacaacatgccaagtgatatgatatagtttacagaaatattagtaagggctggaagagttaaaaatgagacttttgagctatgtcttcaagagtttagacagataaaacagggtggttttaaacatatttaaaacacaaagcaggctgggtgcagtggctcacgtctgtaatccctgagaggctaaggcaggaggattgtttgagcccaattctttgagaccagcctgggcaacatagtgagacctcgtctctgccaataaataaataaataaataagccaggcatggtggagtccacctgtagtagcaactactcaggagggtaaggtgggaggattgcttgagcccggaaggctgaggctgtagtgagctaagattttgcctctgcattccatcctggacaacagggcaagactctgtttcaccataaaaacaaaagacaaaacaaaacaacaagaaaaaccacaaccctacaaagcatctgttatgtagaaaggactcttctaggctccttggagtctttgcccttaagaaatgtaaaacttaattgtcaggagattggaatgaaagatgtctttctctgtgtatgtgtgtgtgtgtattaacccagttacttctctccctgtttcctcccctgttaaattggctaaataatactttcttcacagaattgctatgaaattaaattgcaataaagtgctatgtaaatacaacaaacaatacagtgaacaaaaatgacttgtcttatgtgagaaatttaacaaagtattgtcggattatagaaagaggaccaatttaactaggggtggaagaagacttagaggagctaattttctagctgaatcttgaaggaatagcttagatttctgtttgtgagggaaagtcagtgaaaaagagggtgttccaacttaaagaccactgagatgaggactctagaaggaattagtgttctcatgtgactcaagcatgaactttatggagggaagtcgtggatttttaaatactttgctgaggcgattagactgtggtagccactgaggagcttttgaaggcaggcaactgtggagtccatccatgacttgatagattgtatagctctggcagaaatgtaaaaaatatattggagctatgacagacaagtgaaggtgacaaccattgtgatattccatggaaagaggattacagagataaatgacagttttgcaaagggatttgaagggaggcttggatctgagaagtagatgatatggtgtttggatatcattgtgggtaaggaaggaggagttagatatgaaccaacttggaataactaggaaaggatgatgagaggattgattaatcaatccagtaaggtttcacatgcatttgtggtgtacttttgagctgtagctggaaatttgtgagagttggggttagaagggtgaggtacgaggggtaggaggtaggttgtgaaactgggaattatcaggattgaggtatttgcattgaatgagctgtttcagagagaaaagggaacacaggcagaagagagagagtgagaagaaaaaagtggagagagggaagggaatagtggatggggccagaatttttttttagattgaggtattttgattggataagctatcggagggagagagaagaaaaatgttcaaggaaaaatcttagttgataaataaatgaatacatttagtagaggtaagggcattcgtgactcttagtaattttagtaaaagtggttaggagaaaaatgtcacatcttaaagcagaggtctccaacttttttggcaccagggactggttttgtggaagacagttttcccatggcctggggttaggggcagtgaatggttttgggatgattgaagtgcattgcatttattgtgtagtttatttctattgttattagattgtaatatataatgaaataattatacaattcaccataacgtagaatcagtgggagcccagagcttgttttcctgcaactagacagtcccgtctgggggtgatgggagatagtgacagatcatcaggcattagattcttgtaaggagtgcacaacatagatcccccacatgtgcagttctcagtagggttcgtgctcctgtgagaatctaatactgctgctgatctgatagcaggcagagctcaggtggtaatacaagcgatggggagcagttgtaaatacggatgagagatggggagtggctggtgaatacagatgaagcttcacttgcttgcccaccactcactttctgctgtgcggtccagttcctgacaggccacagactcgtacgggggttggagacccctgtcttcaaggattaagaaatcatgggatagtgaaggagagtagggacaactcttgggaaagaaaggaaagagaaaaaagagtaatttgtgagggaacaagactatgtcagttgttatggactgaaagtttgtgttccccttctcccccaaatccatatgttgagctcgcaaccctcaatgtgatggtgttagggggcatagggcctttgggaagtaattaggtttagatgaggtcaggagggtagagcctcatgatgtgattagtgtccttataagaagaggaagacactagagctgtttctctccatcatgcaaggatgtagcagaaaagcaggcatctgcatgccaggaagagggctgtcaccaggaacctgataatgctggcacccttgtctcagactttcatgctccagagctgtaacaaagagtgtaagccagctagtctatggtattttgttaaagcagcccaagccgagacatcagtcaaggttttattcacaaacatcagaaacttgaccccgtggttaaaagacagttttttgaaagatattggatgcttcaggcatggaaaacaagaactgaaagaaggtaggcaactagaactatatccagaaccatagctaagatactatattgaggggcagtttgttaaggtcattacctgctgtctcctggacgctggatgatatagccttgtctctgatactggctttgctgctcatagaaactggatgttgttgttgccatagcccaagaaaatatattgtccacaagtgtccactatagaaagttgaaaaactttttttaaaaaatttaatttatatgatgagacttctgtgtctttgggagagaagcaggagaagctcattgatacggcaaggtccaggaaaagagataagtggaaacattaaaaacacagatgagagatgctagtattagaaatggaagacacttctttctactaaatagggaaaagaaaatgataggtgaagatgttgagacacttccaggtgtgagagagggaagttacaaaaaggtcttgttctttagcgatataagtgataaacttttagaatgagtgtggagtgatgttgggacttaggatagaacctgtggtgaaaaatggaataagacatcaactaagaatgaatgaaatgattcagtattgaaggcatgaattggcataacatggacttgtgaaacgtgaaagatggtgtggaggcagtagtaagtttatgttgtgtggatgttagtatttaattgagcactaggtctactagagactattctaggtactgtgaaagactagccgataaagaacaaaatgtgttctgggaaccacttgtgtttatgtatggaaagaagtagaatagagtcagactgagtgctttttaaatgtgatgtgatagggtgtctgaaagtttgagaacaagggtgatgtaaggaaggtaggatttaagaaataaagatattattgaggcctaaagtagggttgtaatggtagaaatggaagggaaaggtttagaaacgagataattaaatggtaaaataatacctcttaataattctaggatataagaaatggaggaaaattagtggagttttcagacagatgggaaaatattgtaaaagttattgaatggaagattgatgtaggaattagatgttgcatacctggaagggtgggctgccataacaaaatgccacaaactggatggcttaaaacagcataaatttattctctcacagttctggagcctggaagtctgaaatcaaggtgtaagcaaggccatgttccctttgaaactctggatagaatccttccttgcctttttctgcctagtttctggttgtggctgtgtctctttagtgtttcttggcctactgctgcattattacaatctctgatctgttgtcacatgacgttttccctgtatgtctcaataggacaaaagtcatatcggattaagggctaccccactcaggtatgaccacatctgaatttacatcttaaatacatctgtggacactctatttccaaataagttcacattcacagacactagaggtgagggcttcaacacacaattcagcctgtaatacagggatgatgatttttgttttggctgtgtaagctgtgagattttaggcttgattaaagtcaaagtgccagttaaatgcagcatttgaggatgtgaggtatgaggtggtttgaatgaaacttgagagagactcatgaaatattaaaacttttaaaattgacgtatacatcagaaaaatacatacataaatgtgcggttggatgaactgttaaaatgtgaggatattcctgaaaccattttcctggtcaaaaaataaaacattaccaggctccagaagtccttctctcatactcctcagtcacaaatccttttctcttaaccaccattctgacttctagcaccacacattagtttttcctgtttttgaactttgtaatacttctttgcttacactgtgagattcatccatgttgttgcatgtagcagtattttttttttttttaccactgtacggtattttgttccatgactgttccataatttatcagttttaatgttggacagacatttgggttattttcactttgaggcttttatgaatggtactgctgtgaacatcatcgtgcctgtttttggtggtggtattgctggttcatattatgcatatttttgttggaataattttccaaagtgcttataacaattcatactcccaccaataatgtttgagagtttcaattgctctacattctcactagtcctttgtaatatcagtatttttcttttaaccattctggtcagcatgtagtggtgattgtgattttaatttgtaattccttaatgattgagatttaagattatgggccatttgaatatcctcttttgtgaagtgcctgttcattctttttcctttttattcagttaggttgtctttcatctttttatgggttcctaggaattgtttatatttgctaaatatgaaccctttgttaattatatgtattgcaaatatcttctactctggccatttcactctgtgaatggtttctgttgataaaaagcagttcctgaatatctgtctgtgtagtcaaaaccagtctttttctttacaattaatttgttgtgtttttgtttaggaaatctttctctagtacaccatcatgaaattttttcccgctagaatctttattatttgcctttactgtagtacatctaaaatttatttttgtgattatataagatagggttcatattttttcctccatttactatttagtcagccatcaccatttatggaaaagactctctgctgtgcaatgctggctttataataaatcaagtagccatatatgcctggagttttttggactctgttccagtggtccatttttctatctctgtacaagtatcataatgtctcattagagctttataatagatcctcatattgggtggagtaagctcgcctattcaggtttattgtacttagtcttgttcctttttcctttccacataaattttagtggcagtttattaattttcataaaaagcctgcaggatttttagtggcagttcattaaatttatatggattaatgtggggctagatttggcatctttctaatgctgagtcttccaatccatgagcctgttttatctatttattgaggttttccttaaataaaatcttctggtttgttctgtgtgtagacatcttatataactgtaaattttagattaaacttaatctaattttaattatagatttatttcaagttatttggctttttgatgttattataaataatatttataaaatgttttctcattgtttgtggcatgtaaaatgcaatccattttggtactgtgaccttatgtaaagagaccttgcttaatttcacttatttctaatactttgtggaatcttttgaattttccatctatataagcatgccatctatgatgaaggcctgtttctcttcaatgattgtattgtttttcttttcctttaccttattgcactggctaggacatccagtgtgatattaaagtggtgactacaagcattgttacatgtgtaatctcagaggtaaaagtgttcagcatttcaaaattaagtataatttttttgtagcatttaaaaaaaatagaagatgccaggccgggtgctgtgcctcacgcctgtaatcccagcactttgggagaccaaggctggcgtatcactggaggtcaggagttcaagaccagcctggccaacatggcaaaatcctgtctctattaaaaatacaaaaattagcctggtgtggtggtgcacacctgtaatcccagctgcttgggaggctgaggcaggataatcacttgaacccaggaggtggaggttgcagtgagtggagattgtgccactgcactccagcctgagcaacagagcgagactctgtctcaaaaaaaataaagaaagaaaacagccttttaaaaatttaatttttttttttttaattttattttgagaccgagtcttgttctgttgcccaggctggagtgcaatggcatgatcccagctcactgcatcttctgcctccaggttcaagttattctcttgcctcagtctcctgagtagctgggattacaggcgcccgctaccacgcctggcaaatttttgtatttttagtagagatggcatttcaccatgttgggcaggcttgtcttgaactcctgacctcaagcaatctaccctcctcagcctcccaaagtgttgggattataggtgtgagccactgtgcctggcagaagaagcctttttctcagcttagggaggtaatatagttggatgtttgattctgccaagcctcatgttgaaatttgatcctcagggttggaggtggggtctgttggaaggtgtttgtgttgcagggcagatcccctcatgaatagagtaatgccctccctggggtggtagagggagaagagtgagttctcactcttattaattcctgcaagagttgtttgttaaaaagagtctggcacctcctctctagctttgttgcttcccattgccatgtgatctctgtacaacccagctgtcctttgccttctgccatgccaaaagtgtcctaaggctctcttcagatacccagacctaaactttttcaggtatcagaattgtgagctaaataaaccttttttctttataaattacccagtctcaggtattccttcattgcaacacaaaatgggctaaagcaggaagtttctttctgttctcattttttctaagaatttttatcgtgactaggtacttaattttatcaaatgttttatcttaaagttgaggatatgattttttcccccatttttttaataatgtggtaaattacatttctatgggcccaacatgcttctgctatacaactctactgatggtgaattacatttataaaaacattaaaccattattgtgtttctggagtaatctcagtttggttttgatgaatatatcctttattatatcactggattctatttgctattttattttctttccacatatgtttatgaattgcattggcccaaaatttttctttcttaaaatgcttttgccaccttttggtgtcaaggctgtgctggactcattaaaaacttgggaagtgttcatcttttttttggtcttgtgtaagagtttaagattgataattttttctttgttttgcagaattcatctgggcatgtagttttctttttaagggaaggatttttaattacagatttaatatcttaataattatagtactagtcagattgattgtgtcattttggcacttagcatttttgtgggaatttgtcaacttcatgctttcaaatcttttgacaaaaaaattgttcataatattttcttatcgtctttttaatgcttggaggataagtagtgatgccctatgttttcatttcttatgttagtattttgtgccttttctcattttctggatcagtctttccaagagattttcaattttattatacttttcaaagaacccacttttggttcattgttgattctattttatgtttgtttctatttcattattttcttttctatcttattttcttctacttatttttatttggagaggggcttatttcttattctttttctcattcttcagatggatagttagattactgattttcagcctttctcgtgtgtgtgtgtgtgtgtgtgtgtatgtatataaacatatacatacacacacatatatgtaattttttttcctttagatatgactttgactgcatcccatgtgtattcagttcagaacattttgaaatttccgtgtcgtctttttgactcatggattattttgagatttttgcttaagtaaatgggattttaaagttatctttcttactgatttttgttttaacattgtgtcaaggaattttctctgtaggatttcagtctttgggcccaatatgcagtcagttttggcaattttgtgtgcacttgaaaaaattgcctttgttgggtgaagtgttctctctccatgtatgtatgtgtatatgagttagatcgagttggttgcattgttcaaattttcttaaccctttctgatttttttttgcttctgttaattaatgagcagtttattaaaattgtatgccatgatgtagatttgtctattttttcttttgattctgtgaatttttgccccgtgcatattaggttatgaggtgcaatcaaatttcgaatggtattttcctgggacgtggctcttttatcattattaaatggccctgtatctctagcattacttcttgccttaacatttactttgtctagttttcatatagctacataagtttatttcaattagcgtttgcattttatcttttttgcaacctttactctcaatctttctgtgtccttaaatttaagacgtatcttttgtaagcagcagatatattttagaaagtcagtctactagggtttgtcttttgtttggcctatttagttattagagtttctttacatatttgagtttagctctaccatcttacattttgctttctacttgtccatacgtcctttgttttattcatttattcatttattgctttcctttgtataattcttcataattccattttcctattgttagattgctggtgttatattctttaatattaacttcatgaactaccctactgttaactaccctagagattacaagatgcatccttgacttattaaagtcatattaattagtacatatattattacttcccaggcaatacaggaaccatcaaatatttaactatcttatcctcattctgccgttagtgctagtgtgtgtttgcttgtttgtgtgtgtgtgtgtgtgtgtgtgtgtgtgtctcataaggcattttgcatctttatttttttatacagtaaatatttctttttcatatgtgtttaccctttctgtagttcgttttttcatggcatcttaaagttttccatctggaattctttttcttactctgaagatcatcctttgtattttctttagtgcaagtctgctgattaaaattctctttttgccttaaacttctttattttacctttttaaataggttggtgaaaagtgattgtggtttttgtcattaaaaccacaatcacttttgcaccagcctatttaaaaccatttgtttaactttatcctcattccgccattagtgctagtgtgtgtgtgtgtgtatctcataagcatttttattgttttatgcagtaaatacagaagctttattgatataattcacatactttacagtttactgatttaaagtgtgtatagataattggttgttagtatatttatagagttatgcagctatcactgtagtcaatgttactatttcctccacaaaaataagtcagttcccattttacctcactgctcctaacactatacaacactaatttacttctttgtctttaaacatgtactattctatatatttcattaaatgctaccataaaatgtgtagtctttttcttttcttttatttgtttatttattttttttgagacggagtcttgctttgtcgcccaggctggagtgcagtggtgcgatctcagctcactgcaagctccgcctcccaggttcacgccatctcctgcctcagcctcccgagtagctgggactacaggcgcccactatgcccggctaattttttgtattttttagtagagacggggtttcactgtgttagcctggatggtctcaatctcctgacctcatgattcacccgcctcggcctccagagtgttgggattataacaggcgtgagccactgcacccggccaatgtgtagtcttttgtatctgtattatttcatttagtgtaatgttatcaaagttcatcaatgttgttgtatatgtcagtatttcattcttttttattgtaactaatattctgttatgtagatatcacatttgtctgtctagtcattagttgatagacatttgggttatttctgctttggggttattataaataatgctgctgtaaatgttcatatataggtttttgtgtggacatatatttttatttcacttgggtatttacctgcaagtgaaattgctggaggtgttgctaattatattttaccttttgaagaactaccaaactgttttccaaaggggctataccattttatgttcccaccagcattggaaaagtcttccccacattcttacaaaaacttgttatctgcctttttaattgtaaccatcacaagtgggtatgaggtggtgtatggttgttttaatttgcattaccgtgatggctgatgatgttgagcaaattttcatttgcttattggccatttatatatgttctctgaaggcatgtcagttcagaccctttgctcatgtttcaattgggttatttatatttttataattgacctgtaagaggttccccccaccccaagatatattctagagacaagtattttaggtatgtgttctgcaaatgatttcttttggtctgtaggttgtgttttctttcaccctattgatgtccattttaacagaaaagcttttcattttgataaaatacactatctgttttttatcctttaattgcttatgcttgtgccatatctagaaggctttgactaacacaagttcatgaagatgtactacagtattttcttctaggagttttttagttgtacctcttatattcagctctatgatccattttgatataatttttgtgtatggtacaaggaaagagtctaacatcatttttttaatatggatatctagttgttgcaggaccatttgttgaaaagattattcttttcccattgaattgacttggtactcttgttgaaaataaattgataaatgtgatggtttatctggactcagtactgttctgttgattcatatgtcttcttattctagtgtcacacagttttgattagtttcagtcacacagttttagtcactgtagttttgaagaaagtcttgaaattgggcagtgttagtcctccaattttattttatttttcaagtttggttattactagaccctttagtttccatataaatttcagatttaatttgtcaatttcagcaattgtgccaggtaggatttggataagagagtaggttgaatctctagattagtttggagattattgccattttaacagtattaactgttgatacatgaacatgggataagtttacatttatttaggctttctttaatttcttttaacattgttttgtaattttcagtgtaagctttacacttcattgttaaattttttcatattttgttggtattgtcagtggcactgctttcttaatttcatttttggattatttattcctagtctatagaaatgcagttgaattttgtgtattgagcttgtatccttcaaacctgatgaactgttttattagttctaacagcctcttcctcctgcaatatcttttcagtcccctctcccaagacaatgcagcactgttcacattaaaggagaaatacttaaaggaattccattttatcacagagcatatatagaaggatgcatttggagctgagaggcaatatattgataatgtgcacatttccatagtgtgaccatattttaaaggtgttcatgcacaagattagaagctaagtattaatgtgtgtggtttttttattttgttgggtttttttttttttttgagacagagtttcgctcttgttgcccaatgttgcccaagctggagtgcaatggcgtgatcttggctccctgcaacctccacctcctgggttcaagtgattctcctaccccagcctcctgagtaactaggattacaggcacgtgccaccacgcctggataattttttgtatttttagtagaaacggggttttaccatgttagccaggctggcctcgaactcctaacctcaggtgatccgcctgcctgagcctcccaaagtgctgggattacaggcatgagccaccgtgcctggctttatgtatctcttaaaccaaatgaaatgaaaaaatgtttatattattgcctttctagaaacttaagtttatacatattaatttgtgtaactaaaacatttaaatatttagatagtggatggaatgtaaaaacaacgtaaacaattgttttaaaacctctattagtctgcttttagtgtgtcataacttgcattgccttgtcacttatgtgaaacacttactctgtagatgctgatctactgctttagaatatcaaattgtgacagttactttatttcattggatataaattgtcattgattaaaagatattatgattttattaaggaaaggaaaagacaaaaacaaactgtggcaatacttttgtatcacttataatttttattttatatatattgacttattttatatttactatacttttatttcatacaaggaaggaaaagacaaaacaaaaaaaaactgtgacaatacttttatatcacttgtaatttttattttatgtctattgacttattttatatttactatactcttatacttctcaatatttcacccataggcatagttttaaaaatcatcataatttgtgtgcatacatgaaaatggaaatataagtggataatgtttaaggtactcctatttttaatattcagtcttactttttcatattgctttttgcctttctgtgctttttcatcagtgctgtgaggagttatttgatgctgtctttcataaaagatacgttaaaagattaccaagactaccctcagattcagtaattctctggggccttacaggactcagaagagtcatactcaaggctatgatttatgacatataaaggataccaagcacaatcagcagtggggcctgaggcgaagtcttggaaaaaccaggaacaggattccacagtcctttttcagagtctcacaagatggattcagttccctcaggaacaagttgtgacatttatgaaatgttaccagccacagaagctcattagagactagtgacccagtgcacagggttttcatttggggctgatcatgagagtactccctgcctagtgtatacccaaattccagactcctagaaggaaagtagttattcagcataaaccatatttgcacaaagagtgaactatcatcagttaatggtagaacccctccccaaatctaagttcaccaatgccagttaagggctaattttgcaggaagtcttttttttcaaggatagcagttatgattgctatgttaactcattagtacacaaaagataatagtcactgagatttttcttacaaggctctaagagccattctgtaagttttcattctggtgctattctcatcataccagaagaaattagtggaacatagggttctcattaacttaaaagtcataggtcatagtgttgcatactgtcagtcatgccactaggaataataaccaagtttgcgtatacacagaccacctatatctattttagagacttgagggaaaaatcttcatcttggagtcactgaaaaaaaggaacctaaatttgcttttcagaaaaggttccatgttatattgagttttatattcaagaacttaaagagattcaaaggctaatgaatatttgctgttgagatacttaatggaaattatggtggaagaaaagagtgtggttggattatagtattatagtgtgcatttctggggtctacctttgatcagcttctgttcagaaggcagaagaaagaacaaattgctaaatagtgcagaaaaagactccagacatctaatctggttatattcagcctccttcctgttcccctgccccttacttttttcaacagctttacatattaatatggtttggtggtgtcctcacccaaatctcatcttgaattcccatgtgttgtgggagggaccctatgggaggtaattgaatcatgggggcaggtctttcctgtgatctccttgtgatagtaagtctcatgagatctgatggttttacaaaggggagtttccttgcacaagccctctatgcctgtagccatccatgtaagatgtgacttgctccttgttgccttccactgtgattgtgaggcttccccagtcagctggaactgtgagttcttcattaatcctcttccctttgtaaattgctcagtctcgggtatgtctttatcagcaccatgaaaatgggctaaaatagtaaattggtgtcagtggagtggggcattactgaaaagatgcctgaacatgtggaagtgactttggaactgggtaacaggcagaggttggaacagtttggagggctcagaagaagacagaaaaatgtgggaaagtttgaaacttcctagagacttgttgaatggctttgcccaaaatgctgataatatggacagtaaaatccaggctgaggtggtctcagatggcgatgaggaacctgttggaaactggagcaaaggtgactcttgtcatgtttctgcaaagagtctggtggcattttgcccctaccctagagatatgtagaactttgaagctgagagagttgatttagagtatctggtgggagaaatttctaagcagcaaagcattcaagaggtgacttgggtgctattaaaggcattcagttttaaaaggaaaatagaccatgcaagtttggaaaatttgcagcttgacaatgtgatagaaaagaaaatcccattttctgaggagaaattcaagctggctgcagacatttgcataagtaatgaggagccaaatgttaatcatcaagacaatggggaaaacgtctccatgccatgtcagagacctctgcagcagcccctccctcccatcacaggcctggaggtttaggaggaaaaatggtttcttgggctgggcccagggtccctctgctgtatgcagtctaggacttagtatactgcgtcccagccgctccagccgtgactgaaagtggccaaggtacagctcgggctgttgcttcagaaggtggaagccccaagccttggcagcttccacgtgttgttgagcctgcgggtgcacagaggtcaagaatttgggtttaggaacctccacctagatttcagaagatgtatggaaaggcctggatgcccaggcaaatgtttgttgcagggttggggccctcatggagaatctctgttaaggcagtgcagaagggaaatgtggggtgggatctaccccacagagtccccactgggataccacctagtggagctgtgagaagagggccactgtcctccagaccccagaattgtagatccactgacagcttgcactgttcacctggaaaagctgcagacactcaatgccagcccgtgaaagccgggagggaggctgtaccctgcaaagccacaggggcagagcttcccaagaccatgggaacccatctgttgtatcagcgtgacctggatgtgagacatgtagtcaaaggagatcaaaggagatcattttggagctttaagttttgcctgccccactggacttcagcccctttgttttggccagtgtctttcatttggaatggctgtatttatccaatacctgtacccccattgtatctaggaagtaactaacttgcttttgactttacaggctcataggcagaagggacttgccttgtctcgaatgagactttgaactgtggacttttgagttaatgctgaaatgagttaaggctttgggggactcttgggaaggcatgattgtttttgaaatgtgaggacatgagatttgggaggggccagagatggaatgatatggtttggctgtgtccccacccaaatctcatcttcaattcccacatgttgtgggagggacctggtgggaggtaattgaatcatgggggcagatctttcctgtgctgttcttgtgttagtgaataagtctcacaagatctgatggttttaaaaagaggagattccttgcacaagctctctatgcctgctaccatccatgtaagatgtgacttttctccttgccttcctccctgattgtgaggcttctccagccctgtggaactgtgagttctccattaaacctcttccctccattaaacctcttccctttgtaaattgtccactctcgggtgtatctttatcagcagcatgaaaatggacgaatacacatatataaaaattttacatgtataaaaatgaagctgctctgacagaagctgttagccttgtgctttgaaattctcttgtgtagtacttttccccacctcttccttgagttacattactagaattgaacatggagatcaatttgaaaaccactttctagtctagattcttccttttctagatgaggaagctgaaacctattgagtttataattatccttttctttggttttaatctgtaaagttatctggatttagaacagagaagaaaaaaatacatctaaactaacactgattctaggacctttgagcagtgtgcaagtctgaacgtcttccctgtttttgttcatgttatcactactgttgttctgggtatcatgccaaatttagtgcaatactctcttatattagtttcctagggcttctataacacattatcataaactagtgacttaaatatattctcacacagttctggagcgcagaagtctgtaatttgtgctgtgcatcctatttcaaaatcaagccgtgttccctccagtggctctaagggagattttgttccatgcttctttcagctttggtggctacaggcattccttgtcttgtggctgcataactccagttttttcctgtgtctttacatggccttctcatctctctgacctcactctgtgtattttctgtaaggacacttgtcattggatttgggatctacctggataatccagtgtcatctcatcctgagacctttaacttaattacatcttcagagactcatttttccaaataagataacaggttcatttcacctaattactctttctgcatctgtgctctcttttttccagtacaatatgtgaactgttagaccagttttcctatttactcttgttaattttttgacttcctgtattttcaacctgcaatattctgtttctcctcctgactacactttaagtttcccaaggtaaggagcatgcttcatctcctttgtccttcctcagcataaatgcctggcccatacaggtaggttgttaaataaacgttagtttaaaaaaaaaaaaaaaagatgagcaaacaaacttaattaagaacttgcctttctggccttatctcctgtcattttgttaccaatacttgggtttttctgagttttataaactttccttgtgttttctgttgctgtgagcctgtttgcttttgtttttcctttagtgcctttaccctgcctggaaaatcccacctcacctaacatccatcataaatgctactgatctcctacagcttacagacaaaattagtcactagtttagttgtagctgaaagaaaatgttactttctagatgtagcttttcttactctacacacttctctcattggttttcctaagtatctttttaagtttgtactcttacctaggaggctctcataaggataatatgtccctgtttgccttggaatatctaggtttacaagtattgtggtaaaattattaataatgtttctctaaacaaaattttcgcttggttaacaaattacgtggtcactgtagccataacgttcattgccttgtatgtcttattttcttttctagattatcagttcttggaatttgtagctatacaatcttctgtgttgtagaacatagtattaatactttatattccatgagtgaaaatcaataaatatttgaacacttaatatgtgctatgcatcctatattttgcctgtattagcaccctttttttcttaaccttcagttgtcttagagtatctacgtgtctcaaacaaaaatttgcagtcacaccagcctcgcaaagtctaactatggatcagtctggctctatacattctctgtgcttacctcttagctgctagtgatgctggggttaggggagtggggaagaaatcatatagccttgtacattagtgccactacagaatcaggctttagttttaactggacctcaaacaattttagtgcttcttcctttggtgcttagttagtacctatttccatgtttgagtgcttccttttaaattttattgagaccttgttaattaggtgataatagtcttgttttataggtgataaaacagctcaaggacccagagtcacactgttcttgaatctaggttagtccaactccaaagttcttgcttttttttattccattttgttactcgtctacagttttaagtctcattcttagaccttagaagtacgtgtgttactgaatcataagccctatgtaattgtttagaggtgcttcctttgaaacagcaagtttgagatttttggattattaatgaatgttgacatgtgggtatacaaatttttacctggaccgttatagaaggctatatgagaattggtagatttttgtctttaaagcgccagttccttacattgtcaacttctaagaagatatttacaagttcacaaaatttgaaatgctccaaaatttgaaactttccatagctgacaactttgttctctgatggttcagtgcacacaaacttgctttcatgcacaaaattttaaaaaatactgtgtaaaattactttcaagctatatgtataaggtgtgtatgaaacataaatgaattttgtgtttaggctttagtcctattcccaagatatctcatcatgtatatgcaaatatttcaaaataagaaaaaaacagccaaaatttgaaacacatcttgtcctaagcatttcaaataagggctactcaacctgtaatataatttttgtgatatttttgggaatacattttattaggattaaaactcatttaaatatttaaatagtaatttaaactaactttaagacttttttaaaaactaattttgaaattattttaaaaataattcattagtattttaaaattgcaacagtttcacaggttgaagtgggaatggaaagagtagaatctgaataattgttatgaaaactctgtctctgcattttgcttgcatagtgcttagtttaagaactgcaatacctctctaactttgtaatttgaaaatcattgagattttgaacgtcctgactagtagctcttatagattttctttctataaaacattcaattttactcattttgtgctcaacatgagggagttgggaagataactgttgaaagccaggaggctgcttcttatctgtgttttgccattaactagtcatgtaataacagcagatcactacctctataaaatgaggttatatcagataccccctaaggtctcttcctgttctaaagttttgtgcttctcttctgaaaatatgaagaaattgtgctttcacccacacagtaaattcaactaaagagaacccttacttaatattggttggttaaatcaagatactgtccttatttgaaattaaaacatagcaattgtttgagaatagatgatgaaaaccccattttagaaagaacattttataaaagcctgaaattgctacttaaagattattaaaaatatcatgatacagtaggattaactttatagttagtgttaatgtgtagaaaatatttttgtagaaatttgctattttctatgcctgttattcactatattggttacgtgtaagttattatagaaacgtaaacttttaaaaattatttgaagctgaattttttagcttcatagaaacctgtaaacctttatttagaaaggaagttgacttttattgaacttctattctagaattgtgttatctagaactttctgcagtgatgcaaatataatgtagctatactgttcagtatgattgtcactagctaattgtggaaattgagtacttgaaatatggcttgtaactgaaaacctaatttaatttaaatttaaatagccacatgtggctagtgactgagacagtactgttttagaaaatgctaagcaatgtgccagagaataattacaagactttagttctagttctttgtgccatttcagattactgtcctttcccattttgtattcagccttcgtttccagccttatttgtacttatgtattttggcttcatactgaatctttgcttagcatggaatggtcttctcagcttatgaaaagatgagccttcaaggtatagcttaaatgtcacatctagcagagtcttccttgatcctctggactatggcaaatgatactgtcccttataatttatatggcccagggtaagtcttgacctttttcattcttggtccatcatatggaaaataaattacctgcacctaacagggtgattttttaggagcaagggttgggatgtggagatcaatagaaatggtgtatataaaagctttttggcagttttcaagaatgtacaattttaaggtgatgaaacattttataaacgttaagactgaatcccagagaaattaactttcccactatccacccatcatctcccattttccacctcaccccacttagtacctcagttgcaatagttctttagctatattggtttctataatcctttcatcctacttcctcctcccccacttcttgaccaacttaaaattcataatccatcaaaaccacatcaactcccttgcctgtttctcttttaaattgtgcatgcctggtaaaatgtccaacccaggttaaatcttgttctgtgccttcttcacgcctccactcaggcagctgaaagctggttgatgctgctgtaattcaagatcagtaactttaagcatggcttgtctttttattctctttatagtgtgtttttcagagcagaaatttttaatttaaatgaagcctagcttatcaagagtttcttttatggatcatgcctttggtgtttcatctaaaacattattgtcgtatctaaggtcatctagattttttttgctgtgttgtcttctagggtttttgtagttttgcattttatacttaggttgattatctatttcaagttaatttttgtgaaagatataaaatctgtgtctagaattatttatttgtatgtggatgtctggttgttccagcatcatttgttgaaaagatcttttctttattacattgcctttgctcttttgttaaagatcaaagttaacgtatagttaaagactatatgagtctgtttttgggctctattctgttccactgacctgtctattctttagccaataccacgtggtcttgatcacagtaactttatgttaagtcttgaagtcagataatgtaagtcctctgactttgttcttcttcaacattgtgttgactcttctgggtcttttgtttctccgtatacatttgagaatcagtttgttgctagccacaaaataacttgctgagattttgattggaatgttgttgaatctatagatctagcatcttgacaatattgagtcttcctattcaagaacatgaaatatctccccatttacttagttatttgattttctcagaattgtatagttttctgcatatagatcttgtacatattttgttagatttatacctaagcattttattgttgtgggtgctatgtaaatttgtgtttttaacttcaaattccacttgatcattactgatacgtaagaaagtgattgacttttttttttttttaaattaactttgtattctgtaaccttgctgtaattgattattagctccaggagttttttcatcacccacaatgactaaatttttgattagaaaggaagttttatttcttaataaataaagaaataaagaaaggaagaaataaaacttcctttctaatcagtatacatttattgccttttctggtcttattactttagtaaggacttctggtatgctgttgaaaaaggagtagtgagaggggaaatccttgcctatttctgatcttaactggaaagattctagtttcttgacattaagtatgatgttggctgtgggtgttttgttttgtagatgttctttatcaagctggggaagttgcagctattgctagttggatgcccctttgtattgctgactaatatttcattgtatgggtttaccacaatttgtatattcattcgtctcttgatggacatttggattgtttctacttcttgggtgtacaaataaagccactatgaacatgggtatgcaagtgtacaagtctttgtgtggacacatgccttcttttctgatgagcaaagacacaggaatgatatggctggatcatatggtatgtttaactttaagagactgctaagtgtattccagtgtggttttaccattttacagtttaaccagcaatgtaggagagttctaattcatccatattttcttcaaaacttgttattgtcagcccatttgattttgtccactcttatggctatgtagcagtaccttattttagttttagtttacatttccttaaaatgttgatcatcttttcatgtgcttgttaatgtatctttggtgatgtctgttcagatctttttttttttttttttttttttgagggagaggatcttgatctgtctacaaggctggagtgcagtggcatgactggagtttactgcagccttgaccttctaggctcaagcgattcttccatctcagactcctgaatagctgggactacaggcgtacaccaacacgtctggctaattttttatttttcgtagagatgggttctcactatgttggccagggtggtctcaaactcctgagctcaaacggtcctcctgctatagcttcccaaagttgctaggattacagtcatgagccactgcacccgacctcttttgctcatgttttattggtttgtctttttattgtggagttttgggagttctttatgtgttttggttcttatcagatataaatcctttaccagatgcatgttttacaaggattttctcctcattagtggttttaagtgtcgaagagcagaattttttttattttgatgaagacaactcattgtgcttttaatgacatatgtaagaaatacctgcctaacttaaggtcacaaatatttgcatttctagataaattttagaacaacttgtcagtttcgaataaagatgggaatttgattgtgttaaatctgtagatcaatttagagagaattaatgtgttaataatgttgtgtcttctgatccatgaataaagtatgtctctccatttctttagataattctttaatttctctcagcaaattttacagttctaactgtacagttttttcacacctttggtcagatttatctgtatttcatctttttttcttttttgttttcttttcttttttttcttttttcttttttcttttttttttgagacagggtcttgctctgtcacccaggctggagtgcagtggcacgatcttggctcattgcaacctctgcctctcagactcaagcgatactcccacctcagcctcctgaatagctggggtgagccaccatgcctggctaacttactattttttgtagagatggggtttggccatattgcccaggctggtcttaaattcctgacctcaagcaatttacctgcctcggcctcccaaagtgtttaaattacagatgtgagccactgcacccagcccttattttctacttttgatgctattctacgtagcaatgttttacattttttattttctaattttctgctgctaatgcatagaaatacaatcgatatgtatatattggtcttaggtcctgcataaggtctgctactaaacacccttttcatagtagctttattgtagattccatcatattttctctaaagacaattgtgttttctgtgaataaagacatttcatttgttcctttctgatttggaatttatttctttttcttgcttgattgtactggctagaaccttcagtacaattttggatataactcaaagactgcctagctctatttagtttctctgtccttgtgcttcacttcgtctactgcctctgagggatcagaactttgttgcctgttgactgttaacttgaaatggttgtttcaggcaaaaggataaatcttattactccttcatgtctgtaaggtgtcgtctctattctgtttcaaatcaagcttttattctcaccactccaccaaaacagttgctaaattcagtggttacttaccagtgcttttttttttttttttttcccacttcttggcagcatttggaataattgacccctctgtaggtactttcttcacttaatgtataggataccctcttggttcccttcttgcttccctggccagctttattgatgctactgaatttaaatgttagaatgcactatggatccttgacatttacacctctgttctctatatttttagttccttgctaattgtctgtttcctcattaaaatgcaaactgtctaatggctcagcacctagagcagtgcctggcacaaattgttcacccaacgcattctgatgaatgaatgaagaaatggttggttttctcaaccagtttttggcatgtgacccaggtttctccttagaatatagaaacctttaattccagaattatcatttctaattatgacatgagatgaagttagagattctttgataatatttgtttgcagtttatagtgttatttatttgcagtttatatgttatttaattcacctggctttattcttacatggttatttctgtttgagtattgtttggagattttattgaaaaacctttttgttatattttcagagttgacatgacttacctatcagtttaaaacaaatcaggttaattactgaatgtgctggtgataaatttgattcttccaaaatgtgttttgttgaagtatgatgaaatttttgaggacaactatatgctattaccttgctagtttgttaatgtatattttattagttgcctctaaattattctaaattttgaggagtctgaaaggattcatatcttagagattttcaaaggtggtgtttagttgaacacagactaaaataaatgtttcttttatagcatatttgcatacccattgtgtagatcttaacatttgaaagatcctgggaactgaaatgtccaatatgcatgccattactgtaggctgagaagtgaaatgtggtaaaagatagtatcagagttttaaaaagtgtagtgtcaaaagtttgtgatggtttctgtttcttcttggttcatttctgagagtcagggaggaaagaaagggaatggttgcaattttattcatattttaatttcaaacacttttagtgtgtgtgatctgtaatatggatctcccttcatttttttttaaaaaacccatagtagttatatacgtcattacattttcttttctgtcacaagcatcttcttgaatgtgtgtatttccaaatgttttgtatctcccaggcactctgtaaatattgactgaatgactattcaaagacacatgaagactccaaagagttgtgttttcatggttgtagtgtttttgtggagctacagataggggaataaatgctgtctctttctctgaaagaataataaattcaatttaattaattagctaatgatacaaaactaaacttttaaatcaggaagacagagtagaaacagagtagtatcctgttttattatggttttcctacgtgtctagagtgtgcagtagccaggaccaccttatgacaaggttagagtcttgctagatgtggaagattcaattatttgctattcctttgcctctttatattctagacttacattaccaatagtgatgaacttaaactttaaataatttagctctttaataataaacgtttacatttcttcaggacctttctgctctccagttaaactcagcttcatgtgggaaagtagagggaggaagtagtagtaggcttaaagattggtagtctctgagtagtgaggcattctaatttggagtttggtttaagaactacaacagaaaatctgtttctgcacagttttaagattccatgggggaaaatcttattcagaagtggtttttaacatttggatttcgtccaggaatggaaatgtattagattcttttatttgcaacaacagaactctggctaattaaaacataaaaaagcagatatgtaattagaggcttatggaatctaagggagggccaaatttattaatactagaagagtagtacaacgctttggtgaaaggtttaagggttgaatcaaacaaaaaacacagcaaaacttacttttgtaacaagcagtaaaactcagaatacagaaaaattagaaagtaaaaatcacttattagttcctagaaattaaaataaaagatgaaaaataaatcttgatagttacattagtatttgtttactagtaaagccaaacaccttaaaatatagccacttctaaattttttttttttttttgtaaatatcaactttgttcattaggggtaactccttctggttaagtctctcagccttttttattgggtgatttttctgtctctgctgtcatgctgagagagaggctttcctaacctaaatgttgtagaatttttaaaatacaattttgaaccaatgggtcagttccctccaccccacaacagtatctcccaatactccttttggtaatggtggcccactaggctgtggtttttctggattgtaaggagatataattaggttattccaatactacctgtcttagtcaacttggggtgtgtattatagtccatttgtgttgctataaaggaatacctgatacttggtaattttaaaggaaacaggcttattttggctcaccattcttcaggctgcacaggaaacatggtgctggcatctgtttctggtgagggcctcaggaagcttagaatcatgggagaaagtgaaggggagccaacatgttacataaagcaaaagaaagcggggaagtgcgagcctcttttaaacagccagatctcctctcctgtgaactcagagtggaaactcactcattaccacagggacagcaccaagctattaatgagggctccactcccatgacccaaatacctctcattaggtccacctccaatatgggaggtcacatttcaacatgaaatttgtaggggacaaaacatccaaaccattgcaggctgctataacaaaatactgtaaactgggcagcttaaacagcagacatttatttctcacatttggggaggttgggaagtccaagatccatgtgccagcagatccagttcttgatgaggatcttcttcctggattgtagacaatcactttctcactgtttcctcacatggcctagaaaaagtgagggagtgagctctcctttctttgttttaaggacaccagtccaatcatggggagcccacctgtatgactttatttaaacctaattatcatgcagaggcctaccagatactacctttgaggtcagagcttcagaatgaattttagggaggacacaaacattcactccataaaacttctcttactccctttgttgttgttgtggttttacctccatttgaaggggataaaataaaaactagaaattctttctttggtcctcagtaatgttaaatttgcctttctagggtaattagtgttatttgacaaaatatacagaaagttttgtctatatacatatgtacaggcaataattttttacttttaggtcttcagtccatctagggtttttttttctttttctttcagtgtttagtataaaagagggatctgtatttttccaagtattttgctcatgctctttcagcatttcttgactaatatattattttcccactcaaaatcttagttttgttgtatagcacatcctattatatataggtctgtttgtgtactttcaattattttatgttcctaataccaaacttttattatttttactttaatattttccctcttcagtagtctgttagtgttttgaaatatttttggcagttatttctaccctgtttttaaaaaaattttatcagggttttcactataattgcattgcatttgtgtattaatatggggagaattgacatgtaaataagttttcctacctaggaatatggcatagcttctattttttcaagtcaggtttataagttttttacagttttattcatgagtgttttaaatattaatgtttacaaattaaacccttttctgcaataaatctgtaaagatatcaccctttgtaacatactgattatatagttcatatacattttgcatatgtttataagcaactacattattggttctaatagcccttcatttcatcttcttggattttgcaggtaatagatttttcaaataataattatttcttttccttcctaatatttatcctttcctttttcatattacactggattgaatttccagtctcagttgaacaatgatagtgcaccatcttgtcttggtctttttttaatacccatgcctctttctgtttagtgttgataatggccactgatttgagaagaatctactttattaagaatccttttcttagttagattttctttttaaatcagatagtaaatggtaagttttattaaatacctttttaacatcgaataagaaagtcatgtgagcttttaatgtgatgagcagtctaaaaatatccttttgttcttagaatagtcctacttggctgtgtagttttcttaaatacagagctattatttcataataaatgaaattttttgttgatattcatgagactacttttttatttgtttataaagtaccaagcttgtgataggttgctaaaatacattagaatactttcacatttcatatatcttggagtaattttaaaagcttagtaattatctgtactctaggattatagaacatgagagtaaattttcagggcctgatacttttttgaagcaatggttaaaaaactgaaacttaaattcgtagctgttaagtgtagtcagtgtgaattgtcagtcccttattgtgagatcctcagtcatctcttaggtgataaaatttgccttctaatttacttttttgtttttgtttattcctctaaaaaagattcagggaaataatattgcataaagtttttttttaccatatttggatgtgtttgaacatgtttaaatgcatttttcttgattatgtggtgatgcccttctgcatttctgtattcatttaaaaatattaattagatgtaacttttaaaggtattgtttatacgatttccatttttgagtgcttattttggtttacttcttggtttgtgtatttgttcatttattttgttagagaacatatgtgagttgtagacctccaaggacttgttatacatattctgatatacttgtcaatgagcagcatcgtgcttgactatagtagtcatgaatgttagctttatatccctcaaaacattgtaagttttgctctattgcttttaggaaggaaaaacgtattatattgaagaagtttgatgtcattttaacttttgcttgtgaaattttttttcttaaccctgaaatggaaaaacaaaattattttacatttatataagcatttcttcattaacattttctgacaattgatctgtctttaatgacttttcagtagagatacttgacatagggaccctccaaaagaagatacttcagtattatatttggtttgggagatcctacatgcataagttatctattgccatgtaaaaaatttaccccaaaacataatggctttaaaacaatatccatttattatctctcagtttctgtgtgccaggaatccaggcatgatgtaactgaatcttctacctcagtctttctcacaaggctgcagtcaaagtgtcagccagagctgggaactcatgtgaaggcttgattgaggaaggattgtacttccaagtcaacttggtcctaatctagtgcttttttcactgcaacacatattggcgtattgttaatttatttgacagtcacatttggatctcatatcaagcccagaaaacacctagttcatttctttttgttactcagttgtacgttttgtgtgtggtgcgtgtgagtgcatgtgtgtgtgtgtgcatgtgtgtgtgtgtgtgtgtgtgtgtgtgtgtgtgtagctagagatagttacacagggggtcaggaagggaggagagtgttgaccacttttttctattttaaaaattgtagtacttttttttcctccataggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttaggtaggtatgcttgaattatgtattttggtgatagtggtgaagattataataaaaatatttttaagaaattaaaatggttgaaatttgatttaactttaggtttaaagtaaaataattcaaatacgatttttcaagatccttcttaaaatttatgattctaggttccctgtaaataaaatcttgtctatatatacctacttatctatgtaatgctacatagttttatctagtttctttatgaaagatagtgatgagttttaattatatactaagttctgagtttctgtgacatctttattttcattacctcccctcaaattttcagcctttaatcaaattaccatcttaaattttttcatttttaaaaaattgagttttgcatctaggagccattgacacctcatgttttactatttcatatcacattttattcctgctattttagatttgcatagctatctgaatatggtgcttttgctcataatagtgatattccactatttcctatgatacctgttaaagtttatggtaaaatgttgaaaaagctcgttaactttaagctactttcagtgaaatgtaaaccaatttggaaatgctgataagtacttttgaaatgatagaaatgaagattgaggagcaatagcaactggtggctgctcacatgaagatctactgcctagattcttactcaaacagctactggcagtgtgggtagctgacagcgtccagctgttaggtcctttaagattacttcagttttcagggctattctttttgtgagtgacctcaggccagtgactaagtgaggcagtggtagccaggggtaagctcttcttggggccagtgattgaacaagatagtggtgtgaagagttttacccaaagtggactcctttaatggaatatgaccattggcctgaatggagactttgtcagggtactgatagctccccttactcaattcattcttccttctcccttttctcccagttatcactccctggtaaaccttttatacttctcacatcacagtgtctgcttcctggagaaccaaacaagttaatagctcctaatgtttaaggacataatagtaatgtctctgaagtataggacagcaattttgtccaaatttattatatattttttcatgttgagagatattcttttaattagatatttgaggcttagtatatttaagacactgccctaagagctatggggaaatataacttacatttaagagattgatgtttttgagaaattttctgattagaaggcaaggcatgaatatctgaaaactcacatggaggacatcagtaaaaaaggtaacacaaagtactgtatggctcactcctgtaatcccagcactttgggaggctgaggcagatggatcacttgaggccaggagtacaagaccagcctggccagcatggcaaaaccccatctctactaaaaatacaaaaattagccaggcatggtagtgcatgcctgtaatcccagctactcgggtggctgggtcttgagaatcacctgtacctggaggcggaagttgcagtgagccgagattataccactgcactccagcctgggcaacagaatgagactgtgtctctaaataaataaataaataaataaataacaagtactttgcatatgaaagagcaagctcatggggataaaatcactttttattttgctttaaagtttagtagttccctctcaattaatacaatacttattggcttaaaatccaggctgtttgttacaagattagtcattatgttgtccacacctacttttctcgcttcatctattctccttgcttctcttttttcaaaaacccaagtcttatcatcatcataaactatttgcagttcttttaacctatgcttttatgggtgtttctctttctgcctggattgcctttttttctggcctttctttcttccgtgtaactattattcatcaaatcacatccttttagtagccattcttgacccgtttccccaaatctgatacttttttggctgtcattgttatgttgaacatatctttattgtagcagttaccacactattatgttttctccactataaacatgtagtggagagtaactgtgcatttaaaaatgtaattttatgtccctaaagccagtaagagtttccagtatatagcagtcatacagtgttatttgagtaggatataggaatggattagtgaacttggtagtcaagaaatatttcgtaggagaaatagttgagtcagtcctcagtggtgtgagtaggttttgggcaggcaaaaatgaaagaatatgaaaatggtattctaggattgtgatagtatgtgaacgaaggcagggaaaacagaaaatgatatgcagttcacccttgaacatcatgggttagagctgtgtgggtccctttatacatggatttttttttcaactaactgcaaatagagaatagagtatttgtaggatgtgaaacctgcatatatgaagggccaacttttcctgtacacaggttccatagggctaacggcaggacttaagtatgcacggatttgggtatactcagggacactggaaccaaccctcaccccaccgcagaatactacgggaccactatacattaagggaaagttttcttaaccccagtattgttgaaatttgggggcagaattctttgttgtagtgagctgtactattcattgtagacagcatccgtggcctctaaacactatgccagtaaatgccaatagcattcctcagttgttaaactcataatgtctccagacactgccaagtgtcctcaagaggggagcaggagttagtggggaatcaccccctgttgagagccctgcattagtggaacactgaataagtaatttattgattgttcaaaggatttatatgaagtacaagaattaaagtttagaattatagagtaggaccacgttaaagtaacttaaatgctaggatagggaatttgagctctatattactggaaattcatatttgtattcagtagttgtgctgcctctcacctgtcttctattctcagccccttgctgtttaaaatatagttcttggaccagcagcattggcatcacttgggaacttgttagaaatacagaatttcagatccctcttaggcttattgaatgatagtctgcattttagcaagattcccaagtgacttatgtacacagtaaagtttgagaaacactgctttgatcacatcacatagaggaatgcctaactcacggctgacctgatttagagagtactgtgatgacacttgtgattaggaagatgggtctggtgtttttgatcaattgaaatgaagaggtccttaaatcataatgtctcagccatgaggccatgaagacttgcaattaattttgtaatttctgccacatgaatgaagacaagaactattacagaggaataattagcagaattttgtaactgattggatataagaagtaaggaaagtttgaacagtaatagcttttgaaagtttgtgattaaattctgttactgctagttaaatgggcacatctgaataaaaacaggtgttggtgattgggaggataaaataattttggtgttaggtttattgagtttgaggatctgtaggtggaaataaccaggtgtaggtagttagaagctgaagcatcaagccttgtattaaaattggggaaagttcagaatcatctgggtagtagtgtttatcagataaaagtttttaagtgagatacaaaagtaattgcaggcccagggctgattatttatttaaaggaaggggttagaaaaaataggaagagctctcagagagagttataagaagaactcaggcagagtaatatcatatcaagaaaagatatgaaagtttttaagaaaatgttattctagcagccatttccacagtaagaagtaagccctacagaaaatgttttgactattttttagtttctcctaaggacagcacttagctagtatcattctaaatccatagcctaggaattaattcattacttacaacaaatactgtaacacattaggacttaattcttttcaactgattggaaagagctgtgctgaagtatcaaattctacaaagttaaagagactagacataaaagtgttgagttttagattaggggtctttgatgacattagagtttcaatggagtggtagtagcagaaccaaatttaaggaatgtagtatttgcaccacgtataatcacaaatgactgttttcccaaatttatgtagaacttttactcaccagtaagaaaaaaatagacacctggctatgataggcattttgcagaagaaaggttccaaatgattcataaacatatgaaaagatcttcaaccttattcataatctgagatattaaaaataaaatctcagtggtataccattacatacctatcagattgcaaacattgagaagtctgtgataatatcagctgggtgacaatatcagctggtgagtatatggaccagcaggagctctaagattgggagtaaattggtactgtggaaaggtttttgaaattatctgataaagttgaaaataagtagtagcaattctagggatatacttgtgcacaaatatgctaagatacatgaatggaaatgtttcttgtaaaattgttcagatgaaacaggaactccattgtccattagtaaactataaagcaattaaaactaataatatatacaattgtatgtaaatccaaatgatctaaaaataaaaaagtaaaaaaatgaattccaaaaacaataagctaaagctaaatgttccaatatgaatgaatctccagaacacaaagttgagtcaaagaaaaagtacaaaaatacgtatggtccaattccattcttagaaagttcagaaacaggctaaactgtgttgtttagatttgcatgtgttggttgtagaactataatgaaaaacaaaccattgatctccaaagtcaatataatagtttcacattgaggtaggcaggtttttaagatgtagtagaggaatatgagggacttgtgaggttccagtaataatgtttgttaagatgtgtggtggttatatggatgtttgctgtaaaattgttcattgcgtgtgttgcatgtactttttcatttgttattttacagtaatgcatcttatgaaaggaactacataaggaaaataatcatatccatgagagtaaaatgtgaaataaaaataggtttcaaagtaaaatatgaaacaaaaattggttctttcaataccatcaagaacagatggtattaaaagaaccaacttgaagtcctggaaatgaaaaaaaaaatcattgaaataaaaactcaatgcacagagtaaactaaagactgaacacaaaatttatgaagtcagtactgaggaattacacagaagcacctaacaattgctggaaaatgtgaaaagatagctaagagatattgggggcagagtagattgagaggttctaacattgttactttaccctgctgaggaactttcttatattggaagaaaataggtggtatgtacattccagtaaacttaactattagtgatggtacgttaggatgagcttaaagtatattttgtaaataaaagtaattgaacacattcagcagccctaattggttcttttgggtatatgagtagttaaaggttgaaagttcaaaaggcagtgttttaaatgaaattattgagtcacttactgggccaagaaaaacatttcatctccaataggtatgctcagaagaactttttttatttcttaacattttaacagtaagtcataatcataacttatttttaaaagtatttgctttaaaatttttttactgtaaaatgaagctatatatatatatatatatatatatatatatatattatacatatataaaacttatcttccagagaagtaatacctttaatctcataaagggaattgtgatctcgttcacagaaattttttttatatattaagttggaaggaattcatcgttccctaaaggaatgtatatctttatcaggtagagccatctttgtagtggtggtatgaattcctggtctcatttgtcctagtttatgatcttttgtttttccaagaatgtaattgacgatggcattacctaaaaagtgtgtgtagatttttatatgcagttgtccttaagcttgtgaaatatgtttagatgtgacttggaaagatataaacatattcttgtttgaatgtaactaattattaaaaaaatatttaaacagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtgtaagtaaatggtaacatttactttttaaatatttgtcagcatgtttatcaaactatttttagtttgaatatttaatagcttttccttgtttttgtttttcttttaattttgtttgttttcatggaaatttcatttaaccagaacatttttaatcacttttgtaaagatggacagatgactttaaagttgctctccaacttaaaattatataaccatttccttttaagatcttaaaagtaggctggacttagggagttatggcaacttgtccctcaaaatgtacaatgctaaagggcaaacaacttctacattctaattaattgagctgttattcagtttcaccaatgctcaccatcttgtttccttgttgttggtgtttttgagatggaatcttgctctgccgccaggctggactgccgccaggctggagtgtagtggcgtcatctctgctcactgcaacttccgcctcccgggttcaagtgattctcctgcctcagcctcccaagtagctgggattacaagcgtgcaccaccacgccctgctaatttttgtatttttagtacagatggggtttcaccatgttggccaggatggtctccatctcctgaccttgtgatcctcccgccttggtctcccaaagtgctgggattacaggcatgagccactgcatgtggccttattttctttgtctttcctatatgcatattaattagtttgaaaagtttcttagtgtttaatacattctttgtgatttgtataccatttaaaaatttcaggtagtaaaaaaggtgatggctgcagatagcttatagcaaagataatgaaaattaggaacattagaaaagtaggttctgcttttacttctatccatgtgcaaattataaatctaggtgtttttgagggagttctattctttgttgttgctacttacttgctttttgatatgacatgcatggagttttaaattacacatattcattacacttggtgtaatcatttttaaagctaattcccaggatctttttcaacctttatagggttaacttgaaaagctatagtttaaaaaatgttactaccattgcattcttaaatgctaataccatcttttctcaattctctggagaatcgtgttaaaatttttctttttccttttcctaccttgcttttacagagtgttaacttttttctttttctcataaaattcagatcccaattggaagttaatgtattttgcatatccatatatgtttacctttccagtgtctaataatgactgatattttcaatttgtttttttttgtttgcttgaatgaaatcttagatatatttcttctaatgtaagtgtttataatatggtattgatttgttggcttactcctaaaatgttcttagaatagtcatgacatttttccttttgtaaattggagacctataagacatgtaaacaaacttaaatattgtcttatagcacaaatttatacctcaatatttagagatatcctcttgggatacttttatgcctaaactcacaggtatctggactgttctttcagcaacattttttagtaccacttttaagttacaaaaatatttgttaatctttgtttttttttaatttctgagataatagtaccttatcaaaagttcaattttttaccactattttgtaaattttgctttccagtaggacagtcttccctggcagaggtaaagactgatctggtctctctctctagtttctcatcagatcatgtgctgctaacttagttttctatgtagctcacagaaagctagagagtctctgcatcatacataactagcacttcattggggaagccttttatcacctccagccccatgcccaacttaaattaggcctttctttttatattctctcagcatcctactctttttcttcttggccctcataaggagttttagttaagtatttttaaatgtcatcttccctattactattagaatataaattttatgtatataaagtctgtgtgtataccaaacacctaaaacagtgtattatttctttctttttttttttttttttttgagatggagtctcactctgtcgcccaggctggagtgcagtggcgcgaactaggctcactgcaagctccgcctcccgggttcgtgccattctcctgcctcagcctcccgagtggctgggactacaggcacccgccatcacgcctggctaattttttttttttttttgtattttttagtagagatggggtttcactgtgttagccaggatggtctcaatctcctgacctcatgatcctcccgcctcagcttcccaaagtgctgggattacaggcgtgagcccccgcgctgggccaaaacagtgtattatttctaagtgccatgcctggcacttattaggagctaaacagagtgatggttgaatgaatgatagttattggacttagtagtttggaagtatatatttatattgctggtagatatggataattgctcattcaactagttgtgttgcacatatgctaaaagacttttgggtacatggaatggatgaaaattcatgttttagtacatttgaagccctagctaatttacttcagttttaagtatgtagtcatggaaagcctgtgtcacatctctacatgcccccaatatattaattaattgtaacatagggaatctagtcactgtaattgacctgatacctcttagaagatatttccttttagattaaatatctcattaaagactgttttatatggtgacttggtactacatggtacttaaataccatgtcttatttaattaaatactataatgtatttgctttgttcctgtatctctacatctcgcataataggattcttacattttgcttttggtgattataggtttatgaatattccttaacattcagcatttctaattactcaaactgtatgtagtagaattgcctgtttggggggtactcattctccattttattctttcagtcagccaatacttgtggagtagtgtcttctgtattgattatacatgttgagactaaggaaaaatggttcctgttattctaaggctttgtctattatcttaatattttatcatgtatattgcatttatcattaacaaaaggtaatctgtcctgtcatgcatttattttatagatgctcctgaagtttcggtaacaggatatgatggaaattggtttgtaggaagaaaaggtgttaatctcaaatgtaatgctgatgcaaatccaccacccttcaaatctgtgtggagcaggtaatgttatatacttcgaaagagaaattatctaaaagtgaaaccttcttaaatccccattctaaattgtttttatctgtataatacatgattatagtaatagcagaaaattttaattaaattttctgtcttatccttccccacctgtccccaccttcctaccccctcagttctgatctttagaggctactttagcaattttagcagtttcttacggttagttacagtcagaggtcttaagctgctactacttaatagtttttaacattgtcaattgacttcttagataaataattataattttatgtctactccttcatttacaaacacacccatatacacacattcctacctttcatagtccaaacgaaattttagctattttaaattaaactcagtaatcactgtttgcttctctaggacaggtaaatgttactaagagctaagtagtagtataccagacttctgttttctcttgtctatagccatttgttttcctaatggctaatatttgcctctttttacttgtgtagttactacgtgcataattttctttctctgaaatttcaaactgttataccaaggtttttattcatattttgtcagtatttagggcctattttgatctccagatgtatctatcaacttgaataattttcttattttttggtcatttccctcttttttattcctgttcactctttttggaactcctgtttattgtataataaatatcctttcttttatattttcagatggtcttattcttcctagaagattttcttgatttttttttaaattttccattgacttaatgatataaattttttttggcctgttttcagtttttaagagcgtcttctcataagacggagcatcttctcattgaatattcattagagaatgagaagatgctcttataaactgaaaataggccaacaataaaaatatgttattttcatagcacgcttttcttattttatgagtgtagtatctttcttgtttcttcccagggatactagaattatttcttccccagatagtttttttctgctttctacatactatctcttttccctccaagttcttttattttttggtttggtctttcattatgtagatatttcttaatcttgttggttgtttagtctttcacagtgaagcattaaataaaatgcttagtggatgctttctctgcagtggggattgctcattagattccacttagagtaatcaggtagagatgtgattattttcctggagaggctccagataccactaatagaagagtggaagtctttatttcgtggccagtttatttctagaattaacctgcatttttttgccccagagatgaatgtctggtatttgtacagagttgggaggaatctgttgttctgttgtgtatcttttaacttgctcttggcctccttctagttttctgaggtacagtgagttgaactccaaatttttttttggattctttggaccaaattggctgctttctcatccatgtgtttttcataagcaacccttcaccctgaagtacaacttttcaactttggcactattgatattttaggccgataattagtttttgtagtgtgcagtcctgtgaattgtaagatgttttgaagcatccctgggttgagaaacactgacctaaggcatatattgttttttaaatctattttctgtcttctaaaagtgtgttgaaacatcttgtctgttgaattctgcctcctgttttctcctctagggtttttaataactttttaatttctgtactcttcctggtgggattttatgggagttaggaagcactatatctggtcaatcagttgtctttaagcctggatactattttaaaggtagagaaaacctttttcatttacattttttttaaatgggaagcagtcattagttaagatttttatttgatagagtgtttctaaaagccatacaactctggattctcatcccaatgtctaaacttctatatgtcttttttgagtaaatcatttaacccctctaatcctaaatttccttgccagtaacagtacttcatagagtttttgtgaggtacagacaatgaatataagtcatgtaacatagacacaagggcatagaagatgcttttgttgtaggtttaatgtgatatttagatatttctaagtcattttacaatttctcagagaattaaagggattaaaactttgagcccaaagtacaaaggtaattgttaagacatatatagtttattttcattgttatccttgtagaaagtttatcttttgaaagccgatacttgcaaaaattttctttccaaagccttctaaagaaaaaggttaggtgcttttgttttcgttttttaaaccatgtaagcatattatctttatccttcagtgctgaattgaagtactaccaactctaaaagattttacagattattttaccactcactacacttgagatcgcaaaacaaaattattctatctgttcttcagtgttgatttgcttctttccacctttttattattgtttgttcttattccctgtgtaatcatttgtcaatcttctatgtacttacataattgaaaatagagactacattttatttacttctgtatctcagcaccaccagcaaagcagagtatggcaaatagtgggctcctagtaattgaatgaaggaataagtgaataaactttttgaaaatctacttagcctaaactgtagtagttgagcacctaggtttacttgactttttaatcttcttttctttcttttttttttttttttttttttttgagacagagtctcaccctgtcacccaggctagagtgcagtagtgccatctcgtctcactgcaacctccccttcctgggttcaagtgattctcctgcctcagcatcccaagtagctgggattacaggcacccgccaccatgcccaactaatttttgtatttttagtagagacagggtttctccatggtggccaggctggtctctgactcctgacctcaagtgatgtgcccgcctcggcctcccaaagtgctgggattacaggtgtgagccactgtgcccggccttatcctctttaaaaaaaccaaaaacaaacaaacaaaaacctttaagctttaaaaacacttatttgttgttttttttgttaccctcaggttagaaaagtgatttttagcagtgtgcctagttccgttacagtgaatgactttagaattctcatagtgggactctacatggtttagagtaatatggatactaggtataggacctcttagccaaattagtgtaaatactgttttaaagagttattattgataccaagtggtgtcttggtttttattgtcacagatgcccaccttacaagtgaaattattttataggaagacccattttgctgttttagaaactatctttggatagagcacagtgtctatttgcattagcattaaatgatgctctataaatatgttatagagggtgctaaaacattacatatttaagtgagatgactttgcatgaagaaaattgtagatatgtcatgaatggatctctgattcaatgagaattttatttgatattgtatgtatgtcttcaaataatatatttttctaacttccagttttctgaataaaatttttttaattatattttttctctgcttttctcccgttttattatgttggcagagccactcttacatggactgctattttggaagaatgggtgttcttaatggcctttattcattcatctttattaaaatgaaaatttgttactttttttttatactttcagtgaattttgtctgagatgcttttttattttgactaacatctcaaacatataatgcctcattttaactagctgtcaataaatatagtctgaagatatttaaaataattttatgcattttaaaatctaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcaggtaagttactatctgcttgcaaaatgagttatttaaaatatttctgaataatcatagtaacaatatgatcctaagcaataatttgtacttgtaaagatacagattcctcagtgtgaagtttttccaaataatctaaaaggaatatgataaaataatcctatcctgagataggtatgtaatgtggcatcctttattgaaatgtcaaagtgtctgtgcaacaagtttatttactttttgatgcctgtacatatagttaatttttcagttcaacagtactatttctttaatacatagtatgactttctagattcttttatctttacactaagaacaaatagtgatttttttcttttgctttgatggccactttgtacacagttgtctggtaaataaaatggaatattaaatttgatggcttgttaaatagcgttgtttcccacttaatatgggactataccatattgtgttactgagaggtgaaataggaatgctactgaaaatgtgttaatgaaataaaatttgtgatgttttttattgtctttaaactactaatagcttagatttttcacattctgtttcactttgaatatttttgttaatttggctgagtataaattttggcattcgtaaaatagagagctaaaaatacatcttttcctggttgtggctgcaagtaataaattatcaatagaatgcttatttataaaaattcaataaaatattttgagcatctccttactgattacaagaatgtagcaatcttcctgtctaacaaatggaaaattaagaggtaaaaggaagagaacctaagaaactcaggtttgtatggtaattatggaataaatagttaagggttttatctttgttcagatctaaaactagataaattagaggttttggtgaaattttgtgcttgcttaagtgttatattctcagtccttgtgtgatcagtccaagaaaagtaccacgtattatattgtcttagagcactcaccacagtttttagttgtatgctcatttctttgcttattatttatcttcacaattcagcaatttgtgcttgctttattcacgactgtatactcagcagtgagcattgtgcctggcacatgatagaggtgcaaactttctttttttttttttttttttgcatgagtctagaaagaagcttagagctgtatacatccctagccctttctgccagtatcagtactttggtggaaatctgtatttttttttcttttgagacgtggtctcgctgtgtcacccaggctggagtgagtgcagtggtgtgatttcagctcactgcaacctctgcctcccgggctcaagcaatcctcccacctcagccttcagtagctgagactacaggtatgcaccaccatgcccagctaatttttgtattttttgtagagacaggggtggtctctctatgttgtccaggctggtcgtgaacttctgagctcaagtgatctgcccacctcaacctcctaaagtgctgggattacaagcgtgagctactgtgcctggctggaaatctgaatgaggttacatattagtatattactctctctttagttagagaataagccagggaaatgcatagttaaaatatacttaaggactgtttattttgtttctgttgtacaatttggtgtgggatattacttgtagaccttagactcaatatgtctatgtaatcatttaaatatcaaggcttgactgggcgtggtggctcacacctgtaatcccagcactttgggaggccgaggtaggtggatcacctgaggtcaggagcttgagatcagcctggccactatggtgaaaacctgtctctactaaaaatacaaaaattagccggcatggtggtatgcgcctgtgatcccagccactcaggagtctaaggcaggagaatcgcttgaatccgggaggcagagattgcagtgagcccagatcgtgccatggatgacagagcgaaactctgtctcaaaaaaaaaaaaaaaattaaaaaataaatatcaaggctcattttggacactcttgtatgtactgatttaattgataatatcctaaatttatactcttttatcattctgagtgcagtgttcagtactcttgacttgtgtgtccaattgcctattaatgatcattaactctatgtagtagtctaataggtatttacaacttaacatattcaaaaccaaggtcttgatctttctattgctccttgataccaaacatatttctgtactcatcttccttctttcagttactggtacttctttccttacatttgttcaggatacaacccttgatagttattcttgattttgctttttctctcacaccctagttaattcattaacaaatcaataccagctcttccattatgttaaatatagaatcttaacagttcttcaactcttctactactactacactagtctaagccataagccactcttatttcactattacaataaccatttaatctccctactttgcctgtgtcccccttcagtttgtcagcaaatgagcagctagggtagttcttttaaaggacatgtcagctcatgtcactcctctcctcaaaaccttccatgggcttcccattttacccacaatgaaaaccaaatccttacaatgacttacagagcccttcttccagatgatctctctaatttcatttcttatatgttttgctcattggctgagtcactactggactccttgctgttcttcaaacatagcaggcacattcctacctcagagtcttttgcatttgctgttttcactgcctggaatgcttttaccaggtatcatcagagttctttacctcacttcttaaggccttcaccttcacctttttcaatgaggtcttccttcatggttatatttgaaataaaataccctcccttctcacccctttgctactattggtccccttctttttctctttagcacgtattgccatgtaaccccatgtattgccatgtaaatatgtaaaatatttacatattttcttgtttttatatgcttgtctgtttttaccctcagaacgtaagtctaaacataaagcctgctttaattactgctatatttccattatctacaatgatgtttagcatatgatagacgttcaatacagttttgttgcatgaatgaataaatttgagaataaaacaatcaggaatcaatttacaaatccagaatctgcttttgtgtaacttaactctttaaaaagggaaatcaaattttgagtaaatatgaacaaaatcagtttcagcactttcgaagaagtggcgttatatgagataattttttttttttttggagacagtctcgctctgtcgcccaggctggagtacagtggcactatcttggctcactgcaacctctgcctcccggattcaagcagttctcctgcctcagcctcccaagtagctgagactacaggcacacgctgccatgctcagctaatttttttgtattttagaagagacagggtttcaccgtgttgcccaggctggtcttgaactcctgagctcaggcaatccacccacctcaggctcctagtgtgctaggattacaggtgtgagccactgcgcccagcagagaatttttttttttttttttttgagacagagtcttgctctgtcgcccaggcttgagtgcagtggagcgatcttggctcactgcaggctccgcctcccgggttcacggccactctcctgcctcagcctcccaagcagctgggactacaggtggccgccactacgcccagctaattttttgtatttttagtagagatgtggtttcaccatattagccaggatggtctcgatctcctgacctcatgatccaccagcctcggccttccagagtgctgggattacaggcatgagccaccgcacctagccgagaatgtttttttttttttggtaatcagtagttagactttacttttctatccagagtctgtaacacagcatactatcctgagattagttaactcatctaacaactgcttggagtatgtcaggtatcctaggtataatgctgcctttccagaatgactatttagtaaaacctagtaggcttttacaagagtgagaagccataattcacaaaataaatgaccagttaatctttttcattgttacatgtactcattttcctctaggaaaaaaatgttacctcagtattaaaatagatatttaaaaatttgagaaattatttttaatatatgtaaaataaatgcatcttaggactagagatgaaaagttctgctcagaacagaataagcaactctgagggaaattgttcttaattttgttacacattttcccacattgataaatgtaagattttggataacaggtttttgatttaggattgcaatattcaacctcagttattaaattgtactctattatataatagtaatactctcaagaggtatagtagctctttgactagtacttactgactactggaaattgtgtttttctggtttgcttttgatgtatatttttcccttaactaatacctgtttcttatctttaaatttagaaaagcaaattttgatatgtcaaataagtgcccctatgtctaaaactcttattcctgtgcacagcttgaatttcaggtcatattgattttaggatccaagtgtagtttcaaacttaagaatctgcttacttagcaatccttaaacattaaaatgcattatttcatatatttaaacacctatatgaagtctaaaagaaaaataagccaattaatttttatgacactaaaaatataccttagaagactaaaatatgccttttacggggcattacatgactattttatggtttggcagaactcattagaaaaggaaacttaaagttcttcatttgggtgagaagaactataaaagtcattatatccattatatactcatttatcacacagtcagcaaagagtatgaaaaataatatctaactgaaaaatgaggaatacttttgggaaggatttaaaatcatgatatggtgatgaaaaatagtcctaccttataataattgtgactgtcattgtaaattagaaaacagagaaaatattttgcacgcattgtcatatttccattgcttaaaatgcaaaataatgaagtattaaatggcctctctttcatggaatgatattactagtgaggctcagttatttttaacactgattaaggagtgggatggtaggttgaaacatttctagaaccatcaacaaaaataagattttaaagtaacccttttggttagatttttctcaaagccatattttgttaaatctgagtgaaatggacaatagatgaccatttgtgttcatataaagaaatttgcaaatagaagtaataaatgtcagggtttcattatttaggatacttggtaaaaatgtgtcttatttggtgagagctcaaatatagtcactgttctgaaaaaaactagcatataaagaaccatgaaaaactttaaaactctactggcagaaaagtatttaaattataaataattagatgatttttactttaatttaaatatgctgatgccagtttattatatttttttctttgcaaatcattgtaaggatgacattcaatacattaaagttgactttcccagtacttctgcttcctcagaaaatacatgaatcgtcttatttaatttttagtctatatttttaatgttctaatgctgtgaagttgcattacgtgagactttactacttctatattagacatgatccttcaattctacacttgttttcttggggttgaattagttccattagtgaatgttttcataaattaaaacttctttgattcacttaaatatactctgataactaatattcatctcaaagtacttgacagggttacctgttataaatttaaactcaaaattagttatattgtacttattaaattttatactgtacttgctaaatttttaccacattctatacatatggcattccgtgatgaaacctgttcagtaagtatttttctttagcttgtaatattagaataacttaccccatgtagatttagtatttttctaacaatcattttttaaagctctatcagtaccactcatttaaaaattaattataggagattaccatttgggtcatttatttctttcactgtgaaggaaacaatatttttaaacttaccctttcttcaaactctacagttttgtgttacatgacctataaatactacttaattgataattaaccagtctttaatttttgctatttatgtttagttgctttttaatattactggctatttactctgttatctaatgtcaatacacagattcctttgcatctaatatttaagtattattagaatgttctctctaaaatattagctgttctttttgagactccatcctaaagtagtgacattaaattttgcagatatagttgaagtttttaaatttctgaatgtttagataacttgcccatagggtgttagacatggtgatgacatttttattactttataacatatttttactttgtctattagtttcctttggtaatagcctatcaggctaacataagtttaaacatatgcttttttatttttttaaattactaaataatagtgtttactatatatctccttccaaaaattttgagcttttttatttaaagaaaatatttttgagagaattattaaaccaacagcttatactatgcccacttaacaagagtctatagtttttcattcttttaaagatacgctcagctcttataaaaataaaccatattattaataggtaaaatggatattaagaaaaactttaatttttttattctttttattttcttgagctactggctaagaaaatgtacatttgaattacttgatttacttttttgttatagtaattattaagcttgctatgtaataggacacttaagtaatactcttcattaaaaaaataaggacctcttttctggagtacaatatcactcataaacttggaatggaagaattacaacataggtttacaccataggttttattcctttctctttattggtgactgactaaatgtcagtgttgttttctttttaaatagatgagtaccactacattctaatcttaatcaaattaagaatgaaaaactattgttactatgaatatatattcattaactgtgctgtcttgtcaacttgctgctgaatcagcctgcattgacattctttgcctttctgtgtcttctctatctttactgtttccattagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacagaaattgagagaaatgtagtcattttatatgtgaaaacatctgatttgagtttttgataaatactgctaaaacacagtatatgaacaagtaagaagtttatgtatgaaagtaatcaatgtaaaatataagaaaggaataaatggtacccattttgaatttttaattctaataggagagtagattgtagattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccccaatagccatgcatgaaatctttaaataaaagttaaaaaagttctttagaggcatatttctgtaataagttcattgctctatgttaccatctttgtcctcgtatttactaaagtgtgtgtgtatgtgcgtgtgtaacctagtttattttaattatcaaaatgtaattaatgatttgtgggaatcagaaacctgttttcctaaaacaagactgtaatatcagattgaggatagttggcatgttggccactgtaaaattttttccttttttttttttttttttttggtggttgggtttttttcttccacttttaagttcaggggtgcatgtacaggtttgttacacaggtaatgtgccatggtggtttactacacaaacccatcacctaggtattaagcccagcatgcattaactataatattttatttttgattaaccatttaattcccaatcatgaattaacattctccatagttataaattatcttatctctgtagccctagctgttaaaacccattttatatgtttttgctattactttggcataagccaaattttatatattggctttcaatttggaattaacacatttcataaggtatttcttaagttgacatttagtgttttttacttactactttttgtgagctactttgattagaaatgccattgctttgaattgtttataatcaccttgtgatgcatcactttgtttcctatttctggctttttaaattgtattttttaaactatttttgaccagggtttttctttgataatacacagttagactgggttgttttgttcccttcttggtatcccaataaaaaaaattcatgcatgaaacagtctttgaggggtttgcacagtaaaccaactttcatctgtttttaaaaatgcttttctgtttatatatttctgggttttttttctgttatagtccagtcatctgcttttttgtaaagtacatatatactttgacttgacactttgacttgagtagtgttaggtttttatcaagagcttgaaaccaaaattgtttacaaaagttttgccttgtattcccttaggtatcatttattttcttgaaccttcgtgacagttatgtttatttcaatttagaaggataaaacatgattcagttttgggatatatcttgtttcatttgccttttaatagctgctgttttttctggctggttgctaatgaagctgattgaaagtgaccttttagagcaatgaccttttagagcaataactttaaaatgtaatcttcaaaacacgattaatagttttagagcctcatttccttatgtgcataatattgctacatagacatgatatgcaagttgtacagtctcaattaagagaaatatcccagggaaaacctaattgtaaagtgacagttctatctaaaagccaaaggtaggatctaggtgactgggcctttcttaaaaaacaacaacaacaaaaagcttcttattatggaaaattatacaaaaaataggacagaataatgaaatggacctccatgtactagcttcagttatcatcagttcctggtcagtcttattcaatttagacccctacctacataatccttcttgatattatttcatctgtaaataaatcagtatatagctttgaaaaataaaagacctttttagaaagtaaccacagtatcattattacaccaaaattaataataattccctaacattctgtcaagtgagcattcaaatttctaattgtatgtattttgcagttttaatcaggctttccaaatatgatccattcatgtgattgctagaaatagcttttactctgtttacccccaccccattttcccttgcaatttatttcttaaagaaactgcttcatttgttctaaatttttccagtttaaattctgccatttgcatcccacacacatgcctctgtattttctgtaaattgatagtgagatctagagccttggttagattgaggtttaatttgagggcaagattacatcacacataagtggtgctatgtctttccatcagaaagtacatgcctacttttttgtgtgtgatattagctgccatttggtgctcgatgcctagatctattaaccctgttcttttaccatatcatatacctagatgtctgaataattgtcatgctgcttcctatcaactttatctatcataacctcacatcttcttctggtttttatttctcttctccagatcagtaaaaactcctttaagtgtacctcccagttcaaaattagtctgtactcctattatacatgtgctactacagcagtttgctaacatgcattataaaatattcaaaaatggaaattttagctatctgataatatatttaacatgttaattttttctcactaaaactaagacttggggaaacaatatgattgcatttcattttaaaagttaacttttttattactaaaacatttttggtaaaactacatgattaaatgttcttcatgcattttttattttcaattttatactttctgattcagtgattgaaaggtctgatatcatggtcagtgcatgttgatatttggtttttagatgtgataactaaaatgccacctctcaaaaacaaatagattcaaatggaagaagtagattgtttggatgttaacagttttcatcccaaccactatttttagagtttatctttatgttctagatatttggttgttcaatgtcttgctaatcaataacttctccttcacattagctactgtttcagcacattataggtttagtgtgaggtttattgttaatgagtaaatgtaaatatattttaactggtctgctgatgcatttgatctttttttttttggttgacttgttatatctggttagattgccatgcaaattttacttcatactgtagctaactgataaaatttgtgtattaagagtaagatatttgtattgccagttattagtaccagtattattagtcttatgtggggtttttttgccaattatttgcaggaatgatactatgaataaactcttattagtatataacatgtagattagcactgatatctccacagagtccatgtgtcttagttatttacctgttacatgggacactcatacaattcttcctttacatttttgactactggttaaatctagataagttattagttcactcagctgagctctcataaatcgtgtcacaagatgtgaaggaacaaccaagtgaagggctgtctacttaattttcttctggaactgtcccatttcactctccccgtagatacagtgggtgctctgtgtggcaggaaaacacctgatacttggacaaggggagtaaccagtgccaatccatgtattatatactagtaaacagttattttcatgaaatgtcttttttaaagataagtggtaatatttctatacttcctggatgacatatatttcatggattctttcactctactttgggggattttgctattaccacgtaaaattcatccctgcattcctggcacttagcacaaggcctgacacatactaggtgcttggggtaattttttggatgaggggctgaggagactgacctgatccaaatagagcatcttaataaaaaagtagtgagacataaatgttcatgtggatataaaagctaataagtcatattgagaaaataaacattaaaggggctattacaaatgaagaatgggattatttatgggggaaaattggtaatacaataatatatagtatgggagcaaatcaaaggtgggaagataactttgtaggccaacacataaacctgtgatgtcatcactaaagttttgtcaaagggcctgaagagaaaaaaatagggcatgtctcagttttagatgtgaattaggtgtacacatatgtttcaatagctttactttaaaaattatttgtttttgaatgataaaaatacttcaatttattatttataatatttttgtacttttttccaaaaagtaatgaaagtcatttcttatattcattttttattagttgataactagttgatttttaaacatcttccccataagacatgtgcatgctatcttttaattaggtgtgtcagtatactcttgttgtgttggagaatgctctttttctatttttggaggtaagtttccagtgaatatgagttaccattactactgtgataacagcaagctggtctttttttagaaatgcatgcaccactcttttagtggtaattattttataagttttgtcttgttttctgcctcttgtaagcatatattgctcttaatagaacatctccttaggtcgatggtaatgtttcatgtcattcactcagtaaactaccttagtgtttaaaaatgccatgtttatacatttggtcacttaatttttttcctctgtagtggttttattgggatatagagtctatgaagtatgtatatgtttatttgggttgggaaaagggggaaacagtgttgaggctaaattctcaattttcatcaaaatacttgtctatttgggctgagatatgtgcgaaacagtgttggggctaaattaccaattttcatcaaaatacttgaatgcaaaagattcgagctcctcctttgctttcatactggttttcatcaactgttaatacccttaaattattaacaccttaagtacttaccttttttctcaattagaatcagaaaagaaaacatgaaatatatcccatatgcttatttagcataatcatttgacctacataaagtagattatctagtggggaaatagattcatagctagtttttcctccatttgctcatttcagcagctaccagcctattctaatactacaaagaggtatgggagaaagaggatacatatgataaagaatgactggaaccaggtgaaatgaagatgtccaaattaagatagaaggaagtgttgtgatatagtcaactctcatagaatcctagagctagaaattataagactagtgtgacaaaattggatagattgtaattaaaatgtttaagaatatatatttagacaagcattacttcaagatattaaaaatagtgtctatttaaagttggaaattaagagattaaaagtctacattatgtggttttattacagagcactaccaaacctcagattattgttgaagttaaaggctttcttagaggaaatgtatagtttgataaaaaatttataatgatctctagattgagaatcttaatttagccccactcaaagagtaacatgaacttttcaaaagtatttttgaaaaaaaacctttacggtattaacattgtcatcaaaataagaacaaaaatttaaattctgtacagttgggcaaacatgataggtcttctttagcaaaagaaaaatttccaagagaggaagacctttagaataattggtgtggagtaaataacgtacttgacaattagtattttttatttgtgccactgactagagatgtatgaccttggtcaaattgcataaccttaatagtttcaactggcctactattaaggattgagtaggaccatctactttatggctgtgttcagtggtcaaagttataatctatatggtggggaaaaggataatatagattatccgtaagtcatcccaaatctctctcacatttacaagtgcagaatgatatttggctgtactgggtttcaatattttttttaatctagtacatattcaaatggagatagattagaaaattgagcaacaatagataaaccaggctggtattagaaaatgaaggtcaccatgaatgacagagttataatgtttcagaatctattcattggaaacgttattgaaatgagtgacttggacttactggttgtaagatttttatttcaaaatgagctaaacaaaatgagccattaataaacttaggattgttagtattctaaagacatttttataatttgaaagaaagtaaaacattctttttggcaatctaaactatgttacccacatttaaacaaaaacaattggaaaatacttataaatatgtatttatatgggaatactatcatggtaagtagatgaaacatatttcaaaaccaatagtgctagttctgtaactttgccgtgtctgggtcccaacaattattgcagttatttaagagtatatgtgaagattatgtcaatttaagtaaaactgagacctcttcattagtcggcgttatatatgttaacaaaaacattcttctcttccaacaaggggtaatagtggaggcttctaccctgctccaacctaactttatttctctctgtgttctctactattcattgattgaatggtcttggcagattatttaacttcagagctgcaatatctttatttatagaatattatctcagtatctttttttattggtaagaaagacaaaaacaaaatcagatgtgtgaaggaactttgtaattcacaaattccacaaaatgtagttactggatttaatatagcgaaattgtcaaagtaatacttacacgtaaagattgttttgttacattccttaatacttaacatttgaaaatatgtagtacttgtaatagttttagtacattcccttatttgggagttcataaaattgtaattcaattttttggaaaaatgtgaaatgctaacagccaaatatgttttttaaatcctttcttaaaaaattgtggtgcagtgtgggaaagagaagttggtattcagaaatgacatatgtctatggccaggagataggaagaatttctatttaaatgttgtagtagagaagctatttttagtgcactttgtattaaatgtgcatgaattaagggaaattttgtgcaagtcctgttttaatattaatatttaaaaatatttttcaaattttacagtgtccaatgtcaattttttttgatctgggatattttctgttttgcacttgaagtttttcaattttgttaataaatttttttattttaatagaataaaagtgctaaatgtctgtattactggtcgtttatattagagaatattgatttttaaaattaccttttagagtacaaacttaaaattactttcatctttttctctctcttcttctccaggtactctttacatatcgagaatatattctcttggtgatgtttggggatatttacataatttttaaaaagttaagctgaggtattaaagtaatataagaaagaaggaagggttttagcataatgccactaaacctaatgaatgaaatttggggtcctctaacctggctcttggataacatacttcagtcaaatagtttgcacattgtagaaaaggtatgcaatttcaagaattatttttaagattatttgaaaagcctaatttttgttactttacagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgtaggtaacttttttgcctttgttcaactatgaatatcagtatgtgtccaatctttatgtttacctttacagctcctcataaagaacttaagggatagaagtaaggataatgttaggcctttgttagatgaccgtggtttcatcagaatatctcaaactatatcttgctaaatgaacattttcaaggggctgctagaggtatagaacagctttacatttttcacctagagcatattagacatctttataaagggtaacatagtaatactttatattgtcctgccttctgaatagaaatgtaagcctttcatgaagtggtaaccgaaggacatataaaaatatctttgaagttttaatggcttcttcatattgtatatgcatgtcttatgtatagatataactgaactatcaagttattaaatacattgagttttaaaaattttttcttaagaaaaatactctttttggtgacttataaaatatacatcttcttatttaaagaataagcaatatttttgacctagtcattgagatagagttgtaaggcagaaattgcaccttgctgtagaatcagatgaccagtgtctcagttctcttaattctatcaacagctttgttgcttcatctgagaaatatgaataatgctcttcctacttacctcacatggttgagatgatagtagaataagataatattttataaactgtgaagctctttacaaacggcattatttcttatgtggtttattaatgtttttatgttgggacataaggttgactttcaaagaatatagttctgtcttcataaatgctttgtatatgtctttgcttctctaatttggcacaattatagcactagtctttgcatcaaagacatttgtgtgtcagttacagctctgtcatgatcaaattagtactatgaccatgaacaagtactttatctcaatgagcctcatttttttcacctaaatggcctatggcaccttggagctagaaatttgctgtgattttcgttggattagaaaaaacaattattttaaataaaagatgataaaatgctctttcagtataatacttgtgggactggagtgcttcagtctttcaagagtgactagcggccgagcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagcggagatcccgccactgcactccagcctgggcgacagagcgagactccgtctcaaaaaaaaaaaaaaaaaaagagtgactagcatgtggttaacttaattcccagattatcttggtttttctataatttcaaaaacaatttactggtaggttaacaaattaatgtaaccattttatttatcacttaagttttaatcatttaaaatactagtttatgctcattgagacattattagaccacagagaatttattacttcaggatctatagctttcattccctttatcctttaatacagataactttttgattttctaagcacaagtactgaaaatgttatctgtgatcttcaaaagcatgagactatatttataaaattttgtaaaatgcagagagctataaggtatattaaaactatctttgttataagtaaactatatttaaaatatatgaaaatgttgattttctgatagctcatgtaactttggaaaaaataaatgtgttccctaaaaatgtaatggttattttgtttatttcagatggcaagatttataatggtctgtacgttgaaaatataattggtgaatattgtaatagtgactagagcttttgaaaatcaattttggaagtatttctaaaatacagtgtaaacatttctcatgacactttggaggaaagtgtattgagactctaaaatgttgatagacatagtcaaatattaaaacatgcactaaagtaaagtcatatactggattacttaatttcaattcttctattttaattccttctttaaatgtgattggttctccatatggcaacctttaacaccaatgtttacttttatttttgatctttgatagattaatggcaatgtaagaactgaattaagcaggtaggctagagtaaatattatctatataatatgaggaaaatattctcaaaacttatgagaaccttgattttcttttgctttttttttttttcctaaatgtgacaatcacatattttaacctttgcaatgcaggattgaccttccacccacacataaaccacctcctctgtatgaagaacgatccccacctttgcctcagaaagacctatttcaggtatgtgttcatgagtacacttaagataatgtaagatacaatttaaaaaatactaagccatttgtattatttctttcaaaatgttgtttagtcattatgcattaagtgttgtttagtcattatgcattaaatgttgtttagtcattatgcattaaagattacatagcaatacctaagttttaacatgctcagtcatttctctgaaacatttaagagatcaaattttgtcaacaaacaagaagttatggccagtatagataagacaaatcaacattatattaggctttttactaaatacttgttgaagacttactgttaatacagttttattgacatacagatttattgtaaaataaaaagtagaaaatgaatatctgttgagtagcatgaagggcttcttttccttggagtgtactatattttattctattttggaatcagttcacgttaattcatgtgaaagtattgattcagtgcttctatcttgtattctatacctggattaatgtgctgtatttggtatttgggaaagttgtaaactatcagaatatttgaattctttgattctcaagtttagtggttgtgtttgtatgtttgttttgtctttttctctatcacccatacaacatgttggatctctaagctgtactggggttgtataacctctgggggcatagtctataatactttcctcctaaaatatgtcctgtatcttcagcctgaataaggcaaatcattagcccatcaattcattgatttaatttggtggaaaaattctaaaggaatgtttctgccaagatgttctcagcttttgttcttcagctgaccatatagtcagtttactgtccaagaatggggcaggaaggagcattccctggcacatgggcccactgtcagtgggcactagctttgtcatcttacacagttaggtgtcctgatggtgaagatgtgccatgttttcagaccttttgttctcacataaagagtgtagtctcatctcttggcaaataaatgaaattgacaagtggtgtgaaatgtcataaaattcttagctggagctgttgttgtattttgttttgttttggttttggtctggatttgttttttttgcctgttagataactgaaaaagtagctcattaaaatgttttgtagattcctggatgaagttgatctgcttttcatgatcgattggttataggtattaatagttctgtaaattatctttttgtatcatttttcagatttttggtttctttttgaactttgcttcttagttttttaggaactctttgatgtggatagtaatcttttgtattatattcatctcttattttttaaccttatagtatcatatagaaaattgtacgtttttatgtagtaaaaatctgtttgtctctttgcttgtatttgttggaagttctgtattgtctgaaatggcttccttacatttccttctctctccttgaactagaatgtagaaaaaagtcttagaaaactaatagttttatggtttatatttcattttaatctgaaactttattaaacttgataaagaggtagagacccatttttcccaatgggataaccagttgtccaaatacttctgaattacctatacttttgcatggtttgagagcacttttatcctaaaataaattctcatacatattaggtctgtttctgaactcttaattctgttgtattgctatgtctttctcttcctaaaccaagatactgctgtttcaattactattgctttataatatgatttgatattcagtaaattcccttatctctgttcttctttcaaaatttttcttgacttttcttttctctgtctacttcagaattaccttcccagattccataaaaattctattgaactcctgaattaatttagtaagaattgacaactttacaataatgtcatttcttcccatctagaaaccagataagcctctattctggtaggatgtgtgtgtgtgtgtgtgtgtgtgtgtgtgtgtgtgtgtgtgtgtgtgtagaatctcttttctggtacgtattttccacattcctgttaggtttactttaggcattttgatagtcactgggatttctctccaccctcctcccatggactttttaaattggctattagcatatagaaatgcctgtttaaaaatatgaatcttatatgcagcctcttttatcaaattttttattcattctaatgctttctcattttatttttttttttacatttcttaggaatataatctatttgctgcaaatgacagttctcctttttatcccttgcatattgtgatttttcaggggaatacatgtgaggggcttccttatgtcattcagttttaaatctgatatgaaataattgaagactagtatagaatttccttgcattaaaatttttgaaaacactgcattctatgaataatgctattttttagccttgatttggaagaattaaaaacattgtgaaaactattttccaaaccaattaaaatgatctagggaacttttttaggaaaacatatatagtattttgaatatagttggatttccgatatggaaaaatctgaaagaaaatgtaagtcttttagaatattctgtgtttcagctaaaatagtatttaatcttagaaatcatgatcaggagattccgtgaaatggatatttatttgactctactgagaatgataatagtaatttcagtctagcagcaatattatggggaatgaggcttttgaagttatttttacagtgctgacatatcatgttaataaaagcttttcaatcgcttgaactatcaagagattttctctcctgatacctattttcacagtagttatctgtcagatgatttttggtaaatttttaatttttaacaatcctaaaaccgttttatgaacagtatttcatgtataagaacacatgtcagttttcatgacttaagacatttggtttatatatacacaaatatgtatatttgtgtatgtgtgtgtaatttttctatgtgatgaaatgtaatatatgcataaagtacttgtatgaatgacacagaatataaaaagcttattggtgtgtttttaggttccacatagcagctaaccttaagaaactaccacttgtaacattttagtttagtattgcagaagtatttttctaattatctgaagactattcaaatagtctcccttttccaactaatgtatttgcgtgaagcttttttttttctttatatacttcaactaaacaacatattacggtagactgaatgctgtagcagacatgaaaatcaaactttcctcttttgacccagatattaaaaggtttataaaatttaggagatactgtttatattaacctgtaataggtttcctattctttttaaatgaattaaattttttaaaactcttagtttaaatgaataacatgataaatatagatagctgttattcctgtaagtgaaagtgcttggggtcctcaagatgtaaaagatcataaaggggtcgtggggccaaaaatttgagaactgctgttgtaaactgtaagcagtatgaaggcaggggtcatgtcactattgtttagtaccatattcttagtgcataacacagtgcttggcacatataagtacctgataatttttttaatttgacagatcaaaattgtatatttttatgatatacagcatgcagcgtgatgttttaatatatgtggaataactaaatcaagcaaataaacatatgcattaccttatgtattccgataaacaggttttgaatgagtaggtaaaggaatcaagcccttttttatattctcttcagtttataatctgttaaaatttctgcatcatttataatatccatatcacagatactatatttcagtatatttaatgtcagtgtctataatatcactgtatcaagtatgagatatcaatatataatgtatgaaaaagaacagagaaaaagagactatagaaatatttttaaatgttagcagttatctttgtaatagacttctcagtgaatattatttttgttatattttctgtagtttctgttttttctgcagtgcctttccccacctctgtaagtagccttttagcataagaaaatagagatctattgaacacctgagtcactggcctggaatgttaagctggtcatactggttatgcagtgtgtcagcactgttaactatctgagaaaactgaatttctttccaataatttactatagtatattgcattctttagtaaatgtttgtaaatattcatgacagtgttagtagagaaagaatgtttttacatttttttagtgtatggataatacatacaaaacaatataaagaggtgttttctaaggtctcattcctatacctatttaccctacccccatctacagataaccacttttattaatttatgtcttggcactgtttctttaagcatagacaagaaaacacacacacacacacactcaggtgcattttaatttatttcccccctgtataaaagtaatatatacatataccttgttacatatcttgccattttctcctaaaatatactggagatcttttattattgagatgcagagagcattctcaatcttttttatgtctacgtagtattgtaatgcgtgtatattacatagtttgtaatgtcaaaagattttaataaaccaataatgctgtaatgaattgcctggtatatatgctcttttgtatgtatgcaagtataatctgcagggtaaatttttaaattttatcttgctacatcaaacagtaaatgtatttatagttttgatagatattgccaaataatcctctgtaagaattgtactattttgcacttctaccaataatatataaaaatacctgtttctccacaacctcaccaatagtatgtatatgtataccacttgattattgctaatctgataggaatggcatgtacatatgattgtaattttgcaatcttttggtgggtttctccatcttttcaagtgtttaaaaagccattttttcctgcaaattgttattcttttgtctttttatttattggacaaaattgtgatgaacctctaaacgttttataagtagatgtgaaaatattttgttttgattccagcatgaattttatgtgcattgctccatggtatccaaatctgtggccaaaacagtttagtaagatgaatcatgtatctccactggtttatgttataagaagatttagaaaagcaaaacaattatgattggagctcaaatgttgctaaactttgtggttttaaggatataagttcaagagaaaagtctctccaggtattcagttacaatcaggccatatttcatttaaacctttcttgaacccatcattatatctttttaaaagtcatttttgtaatacatcattgccatcttccaataataatttttaggtaggctgcttttgttagtaatcattgatggtcttattttctcccaggatctgaatattttaacatgtttccagacactacgagtagttatgatctttgggattagggaagggagagaggaatatgatagaagagttaacatttttttccaaattatagagaagtatatgactgagtggattattcaaataaggattgagtatttctagcatggttctccccttgagtagaaaaatgttttcgtcttttatattgccttcagttagtaagtagtggcaattattgagacaagtagtgaaagaattgtggggctttattctgctctgaggtggaaaaaaaattttgtgatcaacaaagcttggataaaataatgatttataaactaattttagttggggagggcccttcaaagcaaaaagaaatattaaaaatctaaatatctaaaaatatttgtcaagaatcataaaattaaaggagatacagatgtaacatgtgaagtataaaagtttgatgtcttcatcatatcaaagcttttgctatctgtcttataaatgagaaaaagataagcttgttttataatgttttatagggattaatcaactaatatatgctacatccttagaatagtgcctgacacagtaattactgtgcatttgctgttattgttatttaaaaagctgtataattcctgataaaaatattaaagatgctaagcagtgaaattatttcagtagaaaaacaaagctgatgctactttgatttatttaaacttagcatatatttcttttagaagtatccatacctttattataagcttagtagtgcttgaaatgaaactagaatatatggagtctacactgtttgattcatagtagtgtttagttttttttctttgtcattcatttatcaaataactatttcttgaatatttaatatgtgctagcactgagaatatgtagttaataaaagatgaaaaaaattgtctgtggagcttacattttagtgatgaatgggcagtacctgtgatgacagctttcttccttttttaagaagagctttattaaagtattaattagcacacagtaaactgcacatattaagaatgtaaatttgatatgttttacatgtactgcgcacacacacaaatatacttggcaaatatcaccacgatcaaaatattgtacatatccgtcatttccaaaagtcctagtgtccctttgtaatctcccccctctagtcctttaccagcttctctttcatatccttgggaaactaaccactgatctgctttctgtcatgtattagtttacatattctcaaattttacacaaattttatacaatatgttctctctcttggtctttcttctttcactctacatagtgattttgagattcattcatgttgtgttgatcagtagttcattccctttacgtagctataatatactgcattttgtttatatatttatctgttgatgcacatttttgtttccagtttgggactattacaaacaaagttgctatgaacatttatatacaagtctctgtgtaaatatatgctttcatttttcttgggtaaacacctaggagtagaatgaatggatcatatggtaagtatgtgtttaactttctaagaaaatgccaaactgtgatcctaaatggttttaccatttatgttcctatgagccaagtgagttgcttcatacccttaccaacacttatggtcagacattaaaaattttagatattctaatagttgtgtggttgtgttttatttaggtttaaatctgcagttttcctagttactaatatgtagaacattttttcatttgctggtttgtcatcagtttatattctttggtgaaatatctgttcagatttttcattttttattggatcgttttcttattgaagagttttgagagttctttatatattttagatacaagtcctttgtcagctatataattagatattttctcccattcttttgcttgtcattctctttaacagtgacttttttttgaaacaagtcttgctctgttgccagactggagtgcagtgggtgcaatcttggctcactgcaacctcctactcccaggttcaagcgattctcctgcctcagcctcccaagtagctgggactacaggtgcgcaccaccaggcccagctaatttttgtatttttaggagagacggggtttcaccatgttggccaggatagtcttgatctcttgacttcttgatccgcctgcctcggcctcccaaaagtgctgggattacaggcgtgagccgccacgcccagccaacagtgacttttgagaaaatcttaattttgatgatgttcagattatatgataacaatgtagtgccatgcttttatctctggaatgggggcgtggaggatctatttttcttagttgtcattttatttaatcaagacttgattgattcatgagtaaacagaaataaggaaccattgaagtttaatgtggtaagccaagcacaatgaaattgcctcgcaatttcagagcacctggtagctttctatataaaagcacgatgtttatgtgttgggagcaattcctttgtaaatacaaaaaagtctggacagagagctgaactattataaatgtttagaacaaagcaactaaattgttgtcagagaatggacatattatttgtgaattaaattttaaatagccagtatcaatctaatttaactttgaatttggccatttagtgttgattttattctgcatagatggttttgttgaagttcttttgatatgttaaaaatagaaaattggtctatatatggacttttgagagaataaaaattaggctaaattaaggctgccctaaatggagagttacccaaggtaggtatcttcatattgtgacatgagcaatgccagtgagacctcagtccctgccttacttcccaggattacagattaataatatctgttactacctatttacatgaaaatactagtggggagacttatctcaggctattgataccctccttatatattagcacagtaatcttatatcctagaatgtccaggattgtcctgatttcacatatttatgtccttgtgccagtatgtatttaagcccatgtagcctgacgttgagttgctgaataatcatggtgttatattaactcctgtgatagtgtttccactgaaaacatgactttcttttagacttttatctcaaatcaccagccttcactggtgcttaaagctctctaagatacttctctagtactctggaagtgtcttagaacaaatttgttgaatacttagcacacttttgtttttgaatctattcagatgccttaaataaaatgaaattagaattaaaattttttgttaaagtaaaattttcatttagaaacatcttaagtttgaagacatgttagaatgaattaatttaaatgtttttaaagaggccattggttaaaaaaagaccataactctttaaaatgctacagttttcaaataagttagaaatactagattaaattcaacatacattttggtttagaaagatttaaaatgccaaaaattaagaaattttttaaaataattgaataaatggaaaaacattcaaaaggatttgtttcgggcaaagtagtcatgaccacggtttattcttgattgagttgaccttatctgaagccaccaaattattccattttctcttatgagaatgggtatctttaacccagtttgccttggcaacctgtcagataactttccacagttaccaagctaccatagttcaaattcctgttcctaggcatgataatagacacagttacctctctctttccccacagacatgttttcaccactggctaactctggttgtggcatgattccaaatttattttgctgatttcttagaacatattttcaaaccaagatgttcatccacttaggtttttgtataataacatcccattatttgatttattggtatatgttaattgggaatgtgttcggggcaagcagttagccagttggtaactccatctttttaaatacatatatcacttgctacttgggaatcttattctgagaaataagccccacaatgacatatgtttattcttgggcatgtaaattaaaatgttaatcttcaaattcagactaaacagcattttattattgaaaaattagtaagacccactgttttaggtgaggggacctatctggagtggtactttagtttcagtcattgatactgctttacaaatatttttcaaaacgcattaggcctgttaaaatcattttcgtatttactaatgtgtcacaacttactttccttacctttgattaatagcaaaatacatatgttacacattcatattcaggatcattctttatgatgagtttccatgacaaccaaacaaaaaacttagaacttaaaatacattaagttcttttaggtctacttctggtttttcaagagatccagcttgagttcatttaacatttctatgactacatagttggtctgtttttttccacagagccaaactccatgatgatttcttattgttccattgattggggaatgtagtttttctttgtaattttaaaaaacagaatttgaactgcaagatgaaggtcacaagaagatagactagaatactcagtgtaaagatgatgtttccaataattaggtttgtctcatagtggggctgataccttgcaaagtaatactgacattgtgtattggacttagctgttgtctgttcttgtaggttataggaagcatttctgcattgggaataaagttaagttttaaggcctcttccagttctacatcttgactcctttttttcccctgggaaaataatatagatagtaaattgaaaagtaacattggtattacttgagaccaatgttctacatagatatcttcatgtgattcttagtgtaacatttaactatacagttgattaattagctaatgggttattataaaagcacacacagtagagtaaccaacactattctgtagatgtttttgaatttcattttaagaactgttgccaatccacataacattgaatttaaaaaacagtaaacaaaaattacttcaaattttttttgctttaagaacaagattttcttcttgaaaatgtgaattaaacattgtcttatggttgctttacaattatgactgtttgacagctcacatagatactagaagcttaaaatgcactttgaatgatatctttacagtagctttaaccacaatgaatattagatgagatataaaacttgctattggtggaatatttcttatatataagtaactttagaagaatgagattcgttaaaggcctttaaaaggaaatgcttagctttatgacgattcctagtttaaattcattggcactttacggaaggtaataatctcaatttcagatgtttggtgggcagtaattctttagactatcaatcctgtttatgaaaagaaatggcatgtaaatgtatttgtttgaaacctttcaaatgccttattattgatatatatgttcccatggaaaccacaaatacctttttagaaaaatgatgtaaaatagtagctttacttttaagtagaacctgagaaattgcagacgatatttaagaaaaggtagttacaaagttgaataattttactatggttatttcccattgagatatgaactgcatgtatgattgttaaaccatgtgtgcatgttcacacacaaacacacacacacaaattaattgtaccagaacataaaagcataaaacataaagtgataagtcagacttcattaaaaacaataggtctttgaaagacaccattaagaaagcaaaggcaaaccacagacgcaaacaaaatttgcaacagctgtatcagacaaaagacttgcttccagaatatatgaagaagtcttacaactcaataggaagacaacccagttttttaaaatgagcatatttatttagactttttgtcaaaatgtactaatggccaataagcacatgaaaagatactcaacattactagtcaacaggtaaatacaagttaaaccacaatgaattgccactgcacatccattagatttgctgacattaagactgactgaattaattattgatattacaattaatagcttccagtttatcttttgtaagtctatttttatatttgcttagtttacataacaatttatacttaattttattattttctatttttgctctagtagatttatattttattgttttctattcttatgtcccaaaatactgcatgtaattataagtccaaacaccaatattgtcctgagggaatattcctttacttccactcccattatagttcttgtatacagagatttataatgaatatggtttttggctcacaaaaagtgactcaagtttgtagttttattttaaagtcctctgcaactgagtaatcctatccttaatggtaattttccgtaatgaactaactggaattaattaagtaatccactatatagttttttttgtttgttttttattttattttatttttttaagtgaggaatgtgatattatgagttacctaacttgacaagggagagagttgtcagggcagcacatggcaagtgtgagtcattgacctggagttgaaaacaccatttgaggtctcaaagctcagtcttctactcaaggcgaaatttcctccaacatcattcctaaaatgtcatcatctagctttcagcttaaaacacttcgattaacaattttactacctcacaagacattatatttcttttttggtaagccaaattgctagcaaattagaaatctaccttcctttcaacttaattagccctgattatgatctctgtaatttttaaaaatctcttaagcattttaagctacatttattaagaacataaattttttaacccattttttatacataccttaaatgcttgcaacaatccttcaggaattgtttgatagcctttcaaatatttaaagttctctgacttgctctcactgttttctttaaaccagcttgagtactcccattgtttttaaccattccttatataatgtagtttatctccgctcactggtccctctatttcattgaactctaatattccttatgaaatatgttgtttggaacaaaacagaatactccatggtggtaagtgccaaatgaatttataaccttctcttttctaatccctgtacttctgttaaaattgtctgcttccatttctgcatgtacgtatatatatttcacagctagctaccttcttaatatcttaaaatccctgtcaattcagacatcttccatacagatatattcattttgttaacccaattgtgtttctctcccttaaatttaacctttcttttagattaatgttcctttattgccagtttttttttacagtcaagattcataaattttgatgtttctagtgccctgaactgatgtgaaaaatgggaaaccaaagtgataagactcaaaacaatagtaaaaggaaatagccaaacccagttggattggattatcaaaatcagttataagacagtatcttgctatttttaccgatatttcatatcaactcttttttacatgattttttttaactttatgtatttttcacactgtatagattttttttctttttgcaaccaaagtgatgatcatatattttccaattttaaaaattatttctgatggaaaaattggaactaatgggagaataaaatagaatggagtttaggggctgggcgcagtggctaacgcctgtaatcccagcactttgggaggctgaggcaggcggatcacgaggtcgggagatcgagaccatcgtggctaacacggtgaaaccctgtatctactaaaaatacaaaaacttagccgggtgtgttggtgggcagctgtagtcccagctacttgggaggctgaggcaggagaatggcgtgaacccaggaggcagagcttgcagtgagccgaggttgcgccactgcactccagcctggacgacagaacgagactccgtctcaaaaaaaatggatcgagtttagggaagataagttttggaaacagaattagagaatgaatatatctctagtaatcttgaaagtaagaataagtgtgaggatatggagtaaaagtagagtagggagaaatgttagatatatgtgagcttctgaagcttttcaaacacaacctggagacataaggcatattatactaatgaggtaattagagtttcaaacagaaattgctctctcagggttagtctggcaccacatccaccttgtttctggtggttaaatgctgccacttggcctttgtcaccacaaagtaccatttatttaatttagcccactgccatggttgggcctacagagaatagccaccagtgagttctcaaggatgccagatctcccctcatgaatatatttcacacagaattggtaaagggaaggttctcaagaccttctggagcaggggtccccaacccccacgtcacagaccagtattggtctgtggcttgttaggaaccaggccacacagcagcaggtgagcagcaggggagtcagcattaccgcctaagctccacctcctgtcagatcagcagtggcattagattctcataggagcacaaactctgctgtgaactgcgcatgcaagggatctaggttgcatgctccttgtggaacagtttcatcccaaaaccatcccctgtaccctgctccatggaaaaaatcgtcttccatgaaagccatccctcgttccaaaaagattggtgactactgttctgggggacaaagttaacaggtgattaaacagatcttacataagagaaatccaccttagcattttatctccttaagcatttggattgtttcttctacagtatatcaaggaagttctagaatttcaccttcatttagtgtagtccacctttgggcctggatttccgtcagccagccaacctgttacagccactaccagccactctaatacattgaatcgagaatcgcaacttagcagatctgtatacacacattttaagtcaacattatgatccttccattctgatcccaaccccttaggatccctttccttgtagattcttaaggtttatatctctaatttggcaatatctttgcagggttttcttggggggtgggtcacgctttgtgatttaacctctgggttacatagaccttgaaaattaaacactgcctttaaaaaaaaatctcagtcatagttaaaaggaaatagttggcacttatatcattgatatggtttggcagtgtccccacccaaatctcatcttgagttgtagttcccataatccccacatcatgggaaggacctggtgggaggtaactgaatcatgggggcaggtttccccatgctgctgttcttgtggtagtaagttctcatgagacctgatggtgttataaggggcttttcccccttttgctaatgtgaagaaggatgtgtttgcttccctttctgccatgattataagtttctcgagacctcaccagccatgtggaactgtgagtcaattaaacctctttcctttataaattacgcagtctcaggcagtcctttatagcagtgtgagaatggactaatgcaatcaaactgcctagaagtctcagataaattcaccaattcattatatatataattttgtatacagaaccacagccaacagtgttgttaaactttcccctaccatataataaggattccctttctctcagcttccattaatattttcctgatcttcctttaagcttttaccaacagcctccttgaaagccatcaagcttcttctgttagctgtctcttcaaggcccttccaacatctgcccgtagcctggccttaaagctattgccacatgttttaggttttgttataacagcactctacttccaggtgtaaaaatcttttggctttctattgctgtatagcaacctaaatttagtggctttaatgaacagcagccattctattactctctcttatgattctgaagttgacagggtactttatgagaagccctgggcagcttagggtttctcacaaagttacagtcagatggtggctggggctgtagtcatctgaatgctcactcacttgtttggttcctgggataacaaaacacaaacagatgggggctggaacagtttacactaccactgcccaaggatctctttcttcatagtgtttctacatggtctctccagcatggtagcttcctactagctagacttcttacatggtagctcaggactcctgaggtgcatgttcccagagagagaggcaagtgaaagctgtgttaccataagatcacttccaccatacttcaatagttgaagcaactacaaaggcccactcataaggcaaggttatgtaaactccagttcttaatgggggagtggcagtattctggaaagtctgtgtgactagaaataatgctgtagcagtttttggaaaatacaatctttgctctctgtgtgttgtcatatatccagaatgttttgaaacatgaaaataaaaaactaaaatgctgggtaaatatcaatagaggtcagcaaatctttgcaaggtttgtaatgtcactttataattcatttaccttatatttgcattggattgttatatgtcattggatggtcataacatctgctgaccaatgaaagactgaaagtaaaattttaatgctaataggaaagaattaattaaggaaggctatgagagggaagattcattttataggtggttaatacattaatatttttatgtcacaatgattttttttctttatgcattgtcatgactgcagttacttggataaataatatttggagaaagaggatttcctaatttttatatatggatagatcagatctataaagtaaatgcagaattcagaatcaagaaaagatttcccagtgacaaggtgaaacaagtaacagctgggaatactgtcaaagtaaatctgaaaaaaaaaaaaaaagtcaaataagaaacaagaattactatttgtgataccaaaaggaaacttaagtacaaaagaaaagtaccaaatgtgcgaagtatttgtatttcataattgatatattgacaatcaaatgtttgtgaaatttttaactagaattaagatttgaaagttagcaaaatgccatagttttaagagccagtttttgtaaatctttaccttgtatccatttgtcatcttttaaaagtctggttaccaagatatatcatttatatcaaatttaaatgtttaatttactcaaatataattatatttgttaaatatttagaggcttcacgttgaagctgtctcccatgtggaatctttcaactttatttctctcaactgtagactatcatgtcctgccctggttttgcatagtcagccttcaaagggggtttctttcctcatattactaccattagcaaatactgtgactgaaatatattaccatatgttatatatttccacactgccttaacaaagtaccaaaaactgggtgacttaaaacaacagaaatttattgtctcacaattctggaggcagaaatcccaaatcaaggtgttggcaaggtgtccaaggtcctggggggaaatcttttccatgcctctcttctagcttccgttggttgctgggaatccttggcattccctggcttataatctttacatggtgttcttcctctctataactacattttctttttcttacaagaacaccaatcgttggactagggtccacccaaatcagcatgacctcattttaacttgatgacattggcaaaaattccctgtttctaaataaggccacattcacaggtacccaggattagaatttagacataacttttttgaggacacagttcaacacacaccaccatgtaactcaggcactagacttaacgccaaaggcaagttgaaatgacaagacatttcatgcctgtttcatcttttattgtcaaaattttactattgaatacagctaagcttaactttaatcagaatgcagatgttttttatttttttattttttatttatttatttattttttgagacagagtctcgctctgtcgcccaggctggagtgccactcagtctcagctcactgcaagctccgcctcccaggttcacaccattctcctgcctcagcctcccgagtagctgggactacaggtgcccgccaccatgcccagctaattttttgtatttttagtagatacagggtttcactgtgttagccaggatggtctcgatctcctgacctcgtgatccgcccacctcggcctcccaaagtgctgggattacaggcatgagccaccgtgcccggccagatttttttttaaagcattctttttgctgtccacattatggtacctgaactgatgaaattcttcagccaaaagttgttcacatgacatgttagatctttactacttagagaatgagatggatttcttcaaaatgactttcctgaaagaaccagaatatgtatgagtagagaaaatcttttaaggaaatgtaaggagaagattgaaactgccccatactgccggagtacggtatggaattgacagactagccattgacaaagcacaaaggaagtctttttagttctgattttcccagagggcaaacttggatgttcaccctgcctgtaaaacttaaaaagccgtcacagataagtaacttggctactttgcatgagcatcactattccataagcttatattagttgcacaatgggaggctatagttatagaataatgaattagtaattattaagatactctacttcaagaataatatttgggaaattgcctggtctgaattgtagccaaatatgaataaaataagtaaaagagagatagctgaattccagctgtaattcagaaaccagtaacctaaactcattcttcaaaaaagttttcctgagctgctaaatgtggcaaaattaggtgcttcttgtatcagtcaggataggcttggttatgctgcaagaaaccaacaatcctcaaatttcagggatttaaaacaacaagttgattgctacatgcccgaggtctgctgcaagttttggtgatgctcctgggtagcttctctccatttgccaatttagagttgcagtttcatgtcaacacatgcttccacagtcaccagaatgggcaaaggaaggctggagaattgacccccagcaattaaatacttgaagcttcaagtgctatcttgctttctcccattctattagctcaagcacgtcacataacttcaagggggatgggttatataatcctcccaagtacctagaaagaggggaacaacataccagtgaacaatgttatgtccaccatgctccttttctgatccctgtccactttcttgtgacatgatacacaaccgaagaaaacaatgagcagcaaggaaattgaataatgcccaaactaaactcataattatctacctaattcctttgtagaacctgcagaagtctcagataggaccctgagtttagggaaatagttaagactaggaaatcagcccaagataaatgactttcttatattatcctgttttctgtgcctacttgatgtttatctaatttgagatctgggatcaatctagattaaggtctgccattaagagacagaactcctgggtgcagcatgaatatggattcttagatgtgtataaatattggctttgatagtcttgagtgaaatgatattcgcttgacagtaatgatcgaaagctttgggtccattctctttggctatatcacaagccttagtaatctttctgtttagaatttttatcactaaaactatatactatgtatatgtgaatacatgtaatgtaggaataatatataagtagtaaatagtgtttataatatttaataaagataggtaggtaggtaggtaggtagatagatttgaacccataagtgactgaaccagatgtaaatgtaggtgattcacccatttgagctaagtgatttttgcattttgtagccacattcactttgtaaaattgaatgtcagttagaagtgaatttttgcacacgtaggtgattcacccatttgagctaagtgacttttgcattttgtagccacattcactttgtaaaattgaacatcaattagaagtgaatttttgcaatgagtcaaaagatatttaaagagataactctacatctggagatatttctgcagctgggaaatagttcaagaataaagactagcagactagttggttagtactattttaagaaaggcattagaatcagcatttttagctggaagggacctcagaaagcacattatctaaccccttttcctcttttaagtacataattactatctgaaacaacatgcaatttattctaatattgagagttgtaataaaacactagctgttcctgagtaaaaaggcctatgctagccataaatagaaggatgaagtgagttcctcttaaaaactgacctattctttatatttgttgttataatcacaaaaagaaacaataaaagctcaattttttatattgagtataaaagctggtgcattgtagatacgacttagagtaggttgatgaagatggtgaaaataattctgtgagttatgggaaataatgagagactatgctggggattggtaggtaaatgggtattagaacctttggaggtgagtggtctcctttgctggtggtattttgtgtctccctatgtataaactttatatacacatctgctccagggtgagcagagaggccacagacatcagtgtacgtaacttgtcattgggaaaaatcccccttttcacaacaaaaagattaggacagcattataatcttaggcaactcactttttttttcttttttggacattatgtaccagcttctgtgttaggcactccatacaggtaacacttgggactagaagtgttttggatttcagatttttttatttcagacttcagaatatttgtgttgtgcttaaccagttgagcatccctaatctgaaaatctgaaacgctccaaaaagcattttctttgagtgtcacatcagtgcttgaaaagtttagaattttggagcatttcagatattcagattagtgatactcaacttgtagtaaccttggatgaacagccagataaggggaaaaaataacatacaaagagctatggtaatacagaggagaagatagagtcattaattctagttaggaatctgcgaaggctttgcaaagagagagagtaatttgaagtaggtttttaaaataggaagaattttagtaggcagagaagaagcagaagatattcccatgaagagcaaataggtgatcagagacaggaagacaagaataagctagatatgttcatacacacatacatacacagactttctacccccgtttcccttttatatcttattactaacatatatgtgtgtgcatatatatatatctgtatacacacatatatatataaatgtttttctatcctattagaatacagtaggacagggatttttttgtcagcactgccctgtcttaagcatctacaaaagtgtctggcaaatggttggtgctcaaatatttattgagtggattaatcaatcaaaggtgtttgagaagggcagtgacatcatcttatactttgggaggacaattcacaagctgctatgaggataatttgcagaagcagattctgggcaaaggaaagttcagagactaccgaaagaatacaggttttcaaagctaatcacaatcgaggataggagcatgccttaattatttgaatcctctactgctgccttttagcatatgtctggcacacattaggcattcagtacattgatggatagatcgttagatctgcatttattaaaaatctatatcatttagctctaaattctatagtcctccctatattaccttgtactggggttttggattactagaataatgattagggaaaagaaaacatatacttttctttattcacaaagaaaggaaatcctaggacaaatgtagcttatcttatactagtatatcaggactattcaaacttttttttttttttttttttttttttttgagacggagtctcgctctgtcgcccaggctggagtgcagtggcgcaatcttggcttactgcaagctccacctcgtgggttcacgccattctcctgcctcagcctcccgagtagctgggactacaggcgcctgccaccacgcctggctaattttttgtaatttttattagagacggggtttcaccatgttagccaggatggtctcgatctcctgacctcgtgatctgcccgtctcagcctcccaaagtgctgggattacaaacgcaaacttttttttttttttttttttttaagagcacagttggatattcaagatgcttgatgttttaaatcaaaatttgacatcaagcataatacaacatgatattgggatattgtcaataaatatttttgcctgttaaattatgctcaaggataagtaaaatgcactgtcatagaaaattaatagattataagcacagttactagagcacattttaaagttgttgatgattattccattcacttccatggtctaatgtgaagatgtcctttctccattaaaacactcagcggcaagtacattctatttatctcctaactaactcctggaaagatgcctaaaatctcaaactaagaattagggcaacagtgttatattcagctgtagtaatgaaattgcaaatataaatattaatgcatatggaagcataccaatcagatgaatcccttagaagtgaaaactcatggatacatagattttaattttgatggttattgctaataaatttatactttgtaccaatgtacactgccactgatagcatatgagaggaaagtatgttctttagttattagctagcttgacatttaacaaaaccattgctatgctactaagtgatatactggccagttgaaaatgttcttgtgtgcccccctttgtctctatccaaagtgtgagctcttatccactgatgtattggataaatttggctgtttatatattaagtgaaatcctctttaaacttttattcttccttcccatatttaatattgaagcataaatctccggctgtgttcttctttattaggcatgaagatgaagaaaagtgaaaggtagagggggacagtaagtgagggtaggatggaattaggttggcgataaaaagttaaagcttttattgaattactatattgtgaataatagctattatttattgagtgctacttatatggtaggcattgttacaagcactttacatgaactgtgtcatttaatccttacagtcaacccctcaggtagaaattactgttttctcccttctgtcagtgaggaaactgaggctttgaggggtattaaggaaaaaaaacattcagtgatacttttattaaagcacagtgaggcaaactttattcaggaccatagaaataggtatagggagtcttgtaataggggagaaagactgggcttaattctgaatacagcatatgcaagtgggcatttatagcaaaggagcagagtaggggtcagtggatgaaaaattactaagaggaagcatcagaggtaaggggaacttctggctaaaccaacataacaggattcctgttgaagacagggcagtgtgatcagacattacctgggaggtagtggaggatgaagcacctgatgagctatctgggatgatcatatattgagggtgggagattcttgctaaactaacttagcagggattgctaaaacacagattttatgaggaagtggacagatgggccttgaagaaggttcagaagactcaagtttggccaagcaaggaatctttgtcaaggattaagtaattttaccagggtcatctttaatatacagcttctgaatttgggttcttaacttctattccttgctgcctaccaaccaagagaacatatgtcattactaattagagcttatatttatttagcattttctaaatgtgtggcattgttgtaagttctttatacatattacctcatgaaattctcataacaacgttgtgaagcacatgccgttattatcttcacctttaagatgagcatactgaagctcagaaagttaatcacttcattagtgccaccatctatttgaggtagaattagaacctgtgcagtctagctcaagagcctacaatgggtttcaagtactgaaaagatcactggcctaccagtcaaggagcatggatttggatttgtgtcccagctccatcatgagtgaacccttgggggaaatcctttcacctcaactctgtttcctcatgtaaaaggagggcatttgtttctccatagtcctgagggactacttgcactaacattttaggttcatcaatgaaaggggctgagcaagtgtgctacttctcattcatcagttgttgaggataaccttagactttagtagttatgttattccacagcctctgggattgtacccagaagatgctcaccttctgcaatttaatataccatcatttcccaacacatcaggtgcttttacatctttgtgggacaaagctccatacaccagtgcatattgacatttgaaacctatttatagagatattatatgaccctactgcacatgtgggtgggacctcataaaaaaaaaaacctcttcaaaacagttcaaagatacacatgtcatctcctggtaagttaaaaaaaaaaattaagttacaatgtaaagttcacatattttcttcgaacaattcacttcattatccaacttgccctgctaaaggtctgttacacagatttgtagccaagtacttgaagtagattattttcaacattttatgaaataaagaaacattgaggcatttttactgacaagagttacctaaatattctgcatcttcttgttttgaacgatatgcagattcaactaaaatgatatcttaaaataaagaaattggatactttgtactgtcacaactcctttttcttatggacacttgccatattttaagacttttctccatgagttctacaagtagattttttaagccctgtaatcttagtgcttgtcgttttcccttgtatttgtagcagctgcttcctttcatgatcctctttcttccttctaacttcctcattttagtgcctctcatcaccatcactcccctacttccagctccacatacactcacgcatgtgcacacaagcatacccacacatcatatattgttctgggcacttgtcactttgatgcataaggcttaatgatactatgttaagatatatatgaggtgacataaacatgtttagatcttggatgaggaaggatagaaataaaaataatatcatttccatctacttttacacatttaaagtgtctagagttgtcttggattttgttttacagaactttggattaactcagattctttatgtgctcattttttaaaagcttatatttcttcaaaccttacttaaatgtaagatggtattgtgttcaaaaatgatattattaatagaagggaagaaaaggaaagtgggtcctaaagttgaattattgaacatgctaacaaattaaactttcgttcttaatggtgacataatactcattatagaattctccacccacaaattgttatcaggtgaatatttttcctattggcctgtttccttgatctgccatttaccatgcatattggaggcctcagttttctatacactttatagcacctagacttatttgtgaaatcctgcacacgttgttctaagaacctttgtgttctaccctatattatccagtttcctcaggtttgagctaaacatgagattgcagcaaatcattccaagctgctttggataaaaagtgatagaagattttttacagcttttgaagtcacttatatccggtatgatctttccattttttcctccaagcaactttcatacaaatgccacattcatttagaaacagggctacaatcaaaagtaaacaactgtgcctttttctttaatacacagatggtgcatattctctttgatgtgttaccctttctgggtctgttaggaaaacatgactcctattccaagatcatgtcactcccctttaatacaagatgcttcatctctgtgaacaaggaagatctatttctgaacctgcatctgctccacatctttacaagaccagtgatcttttcctccaggtgataacatttagcccctcccattttcttacatctcattatcaagacatgaacagcttccacctcttctggatcttttacctgtaatcatacgtgattttttcagtcaagatcctctgcaggggcttataaactcttacacatctgtttcagttcatggcagtcctataccttctgctccacctccctgaacctcacaattggttcaatgtctgtaatatgagctgctcactcaccacccagggaatttacagtctttgtcctctcttgaagaacaatcacttctccctgtagtcagcccctgtaatacattcctttcttcagttgagctggtattcctttctccttctattgttgttttgaaaaatctgtgttctgatttcctgggtagaatatgatcctcctcactcttagactcagtgtatagtaataatctcttttattatccacacggctatcctttcatagacaaacaatatccttttgtctcacaagcctttagtaaagtgtacagcctacatttattcttattccttctctttttttttgtacacctgcagcttctgcatacttgattacagtccattggtgttttttgcatggttttgtttccccttcttcactccctattgttgatagtaaaatcctggattcccctgggctttgagaacctagctgtcatcatcatcattatcattatcgtcatcatccagattaatgtttctcaagttctgctctcactgtattgctttcacctaggatctgggtggctctgtaggcttgggactctcagtctagccctatgtgatctgactccaccatacctaacccagtactcccagtatgttcaagtgagttctcccatccaaccaataaagtgtgagtcctcactaatactggttaacctttacctcttcacagcttatgttgattgctctagcctctgaacccctgtcatttctgtagtctgtattttaagtcttcagtatgttatctacaatttcaaaaatctctaagcaaatcaagtttttcctaacccattttgcactcaaatctgagctgaactactgattctcacagtgttatttataatcatttttctcacttaatatgaacgttcaattttccactgcggatatattgatgtgcttgaccgtggggttctgtaccatatcctgcaggaggtgctttataaatatatggaatatgtacctatcacttttctaaaatcagaaaaattctgaattccaaaacacatctggtcctaagagtttcagatgagagattgtggacttgtagtgatttagccatttaataatattaggtcagcaggtagttacatgtctacagtgtgctgggtactgaaacgggagggttccttgatcccccttgcaggacatacagcagggttgtggcttgcctgttccatcgccactgctgctcaaaccactgaggtttggggggtggggggtggggcgagcatgcagacagacaggtgcaagagcccaggtgtgcatgtgttacagtgtgcccttttagccctgctgtctgtagacggcttgagtgttaaccagctcagtggaccctctgcctttctgcaagggcagaaggccagtgtgacaactttctgtatcctgagctcttgtccagtgtcccggtagaattgggtcacacacggactcagtggatgagtgtggacttgaaggatgaatgcaggatttcagtgagtggtggaggtggctctcagtgggatggatggggagctggcagcggggatggagtgggaagatgatcttcccctggagcctggccatccagctgccaaactcctcttccaccacctccagccaaactcctctcagtgttcaaatgttgctcctcttctctatttctctgtcacattgttccgccatccatctgcttgtcccctcctctccttgcctgctggtcagcttttggagcctggggttttggtttatatgggtacaggatagtgggcacggtgggccaaaaggcaacttcttgggcatgaaaacaggaatgttgtccccatttagggccgctggtctccaggcttgagggtgggacctttgccaggcaaccaccctcttctacccagtgtcttctgtttgtatcagtaccatgggagataaagacaagtaaaagcatagaaaggcctcccacttgtgttcaaattgcctcgctttgttgtttaactgtttgaatgacaagccacatgaaacaagattataaattcctggaggacagggcccatacattctttcacaagtagatattacttaggatgagattatttcagaacatcaaattattaattttcagtccattcacctctgtagagctcagttctcatagacacagaaccacaattctcatcagatttcaaactagatattgcaaacatgatgacatttctcactgtgttttaactaacttcctgggaccgagggaagagctgcttctgcttcagtaacagcctctgatggctcccaaggaggtctccataagtattaccaattccagccagggtcacccagagggtggggccatccaatttgttcagggagtaggtaaaataatgtttttaactgttaaatgtttttttgcattggtattttaaaaaatttatttcctctactatttttccaaaagtctacatttagttatttgttacagtgaaaatgttcctatcttaacagagtgattcctttcactatcaggtcaagaaatgtcatcctgcaatgacatttaccaattccacactaagtagatggcctgttatttgtagttattagcctgttttaggggccagaagaaaatacccaaactctatttggccatatgaattacgtgtacatgaagagaaaatagttttcactgttcttgcctcatggagtagcatctaagtcagtatcactatgtaaaaattaaatagtgacactgtagggtgcattgaaaacaagaaaaatccttgactcattttattaatcatgcaacctaccttcactggaaggattctccagcttttgtattatctgcttcactttccttttaaagtcactggtgctgtgaactttcattctaatcactgatgctctctggctctcctaaactcataaactgagttctagctcaagctgcctctgtgcaggtcacttaaaactttagtgtctttgtggggggaaatgccaaattgagactacagttacttctcaattcaaataaaactgcattctttgggttttatatttaaaaaattggtgttcctgaaagttaatattaactttccatagcagacagtttctctttgtattttaccttcttaaccattattaggttattttccttcagaaggagaaactatatatgttacctttattttcttttttttttcttctgggaaaatgttgaaaaatatcattcaattaaatttaagatccccccaaaaatacatgtaaaaatatgttcaagagataacttagaaggcttctagaaagtaaccattaggtaaatggatagagacccttttgtatttcattttctacatttctattacaccctcagtaggaaaaatagattgttggtaagggaaattatttctgtattgtctcatctttcaataggaaggaatataagggaactggcattcttcacttagtatatagcctgttgttttaggaactaaaatacattccgtattgaagattttaggcggccttttctgttttaatttttactcttatttttgcaaagaatggcataaattattaaccacttagaaaatcttaacagagtgtctttttctagttctttgagttaagggtcaacagttagctttgaaattacttatggttatttcaaaaagacataaaaattaagtttttaaaaagaagaactgagttaatgtatgaaataaggtggcatttctaaggaggcccacatttatctatacccttacctttttattcatttattatttaaaaatatttatctaatttttctctaatcgatatttattatacatgtagataaggaagacagcaagaaggaacttagatgctagattaaatatgagatttgggaaggcccatattaatgatctctagagaggaattcaattttggttcttattttagcatgtaaaattttgatcattacaacatctaggcagtactggaatgatttttggcatagcttctctgagaacacatcttttaagatgtgtattttttaagatactgtgtagtatgatgataggtgattttctctacttgatggctttgtgacaatactgtgcttgatacagaaaagacagctaccatctttgagggtgttcgggtgtgttgatgaaactaaggtttaccttatgggaaaatttggagataaaatggtatgagtgggtaaataggtacagcattagggcatcgcattgaaaagcagagatgccccttgtgaaaatgacagcatggttttctggtgttaaaatgtgtaggcatttattagttatggaaaacagtgcatatgtgcatttgtaccccagaaatggttaggatttatgattaagagcatcttggaattatatttggatatcatttgcctgcaaataattcatcacctttaccatctatctgctttaattaggtactttgctttgcatatgtattaaaatttaggtaaagtatcactttcttgtgtattttaatatgagaattaagcaagaccataaaccaaaataagaaatttcattaaaatgtgtcgtatcacatttcgctttgaaaaattaaaacctagaatgtatactcagtagaagtaatgaaatttatttaccagtgataacaagaaacactgccttccttttggttaagacagcattttcaacaactaagctgttacaactctgtggttgacttcagaaaaattcagtgctaccttgtgggataaaatatccaatattctatcttgcaaataaacctcatgatagcagcctgtatttgaaaagttagccatgaggactttctttctgtagtcatttcttctttaactgactcattacaatctataatattacaaattaggggactagacattgcattttgaggtactgcactatatcactctgagtataaacagacactcaaaaagagaggggaaataccctcctcataaatttttaaggcattatcctacaacaaatgaccactgtatgttcagccctgggctggggcagaatgggaaactctcagagtctcattactgcttaagaaaagccttgcctttgttttcctctaattgaggctggagctcaagcaggaggtgaagtaacttagactcgtacggatgacgataaaccagagcatgtggcaaagctcgccagtcttgagcatcactggtctttctcctcacttatatgccatctgccctctcaaatgttcattgtcttcccactttttagcccctttctgcaagcagtttaagagactggatatactcaagatgggaagttttatgtgatggtttaaggcacagactttggagttacataaagatgaatttgaatcttagctctacatacttggaaccattgctcaatcattctaggcctcagtttcttcatctgtgatatggggacagtgatattgcctcaagggcatagtgtaagactatgagtataaccaaagcatcttaaacagtgcttgtcttactataaatcttggctgtaataaaacttggctatatagctacctgctatatggataaggcaggtagtaagggaagaatcttttgtcagtccttataagttgtaattgtagttttacctaagctaagcctaatgctgtctgttttaatcatgttgccattattgagccaactttcatgttctcttgccttctttcttaaatgctagaacctctcctccagtctatctaagtcccaaggatctagaacgtcttttcacagcattcactcccttcccatgaaccatctcagacctatccctgccctgttctttgcaagtagtaattcagacctcaagatttccagtccagctggcacaggtttctcaacaaagctagcacccaagatatctgtggggacctctgactaaaagtgggagtcagtttctatgcaatgatagcttttcagtaagtgtttactgagcacctactctgatagcagcatgtgtggtttgggagaaatctgtcattctcttagtgggttaacaggaaaggatttatgggatgtaatacacagacagaagacattgggacagaggaactataagcaaataaatctcaagtcttggggaataagatctaggcaaactggctgggcgcggtggctcacacctgtaatcccagcactttgggaggccgagatgggcagatcacgaggtcaggagatcgagaccatcctggctaacacggtgaaaccccgtctctactaaaaatacaaaaaattagctgagtgtggcggcgggacctgtagtccaagctactcggaaggctgaggcagaagaatggtgtgaacctgggagacagcttgcagtgagccgaggtcacaccactgcactccagcctgggtgacagagcaagactctgtctcaaaaaaaaaaaaaaagatccaggcagactttacacatttaacttgtataatatgtgatggcagtctgcactgatcacaactgattgtagatattagagaactaataattaacttaaaaattaacagacaaaatttcaaatttaaaagaaaaaagttgattaataatacagcaaccccattgacattcacagagaatacttcatagaattttgagaaaccctgcattactaaatacccctatcttttataaaactcatatataagagttgagaataaaagacaccttgagaaatggatatagctaaatgattagcctcatattgaaaaccttccaggtcttgattccaatttatgtctcaacaaaattataaattactacctgtcataaaccttttaagcttactcatgaatgcttggaaccagcaatgttaaatctgtgaatactaagggtctgctaaaataatgagagacattcatatgactagcgtacgcatatgtgtaattatcttggagaacagtaacaattatgtatctcattaaacaactgcctaattaacgttgttgtaaattttgcctgattagtgtacaatctttatagttgctgatcctgaaacaaagtcgacctctctcataactatttaaaaaagtgaaagagaaatcaatctttggttcacagttttaataatattatattaattcttttagagaggtacttaatagatatgagtgtaatatcctatatgccttgaagaatccatattttgtgaattatatgtggtggccagttctttatgtgttgctcctttagtgtggagaaatcatctctctagattaggaactcagtcatccaaataagcaattggatactttttaacggagaaacttctgcatcagggacagtctgttgtaaagtatttattaagaatttaatatgtacttttttcgtagcagattccagactatgtcaatgacttctcagtttacttaatctccctacccatgtttctccaaaacggagtaattataataaaatgacaagttagagttttttttaaaaaaactttattgagttggagtttacataataccatgccatattttaagtgtacattttcatagccttgccaaatatgtacatggatgtaaccattgccccaagcaagaacttttccatcacctgaaaaatttctcatgtataccctccaccatcagtatcaccactaccaccaccatcatcccacacttcctttctctggcaaccattgttgtgatttctgtcacaatatattagttatgccattttaaaagaacctcacatgaatggaatcccagtgtgctcttttgcgtccaatttcttttgctcagtataatgtttttaagattcacccatgttattgcatgaataaactttgttttattgctgagaagtgtcctattttatgagtatactataattttttatattcattcatctgttgaggaccattttggtttaaagttttgggatgttgtgaagaaaaaaacctttttcctttttttgtaatgtatttttctggttttagtatccagatgatgttaatctcataaaaggagtttcaaagtattctctttttctccatttgctgaaataatttttaagagcagtgttattccttctttaaaatgtttggtagaatttactagtgaaatcatctgggcctggagtttctttgtggaaggattttaattgtgcctttcagtatatttattagtttcatctaggttgtcaaagttaattggcatcagatttttcataatacacttttttaaccttttaatttatatgggatcagcagtaatgtcacctttttcattttgatattgatttgtgttttctctttttcttgctaggggttttcccattttattaatattttcaaagaaacagattttgattttattaattctctccattgtttgtgtgtttgttttgcttgtttattgatttttcactctttttttctacttcctttggatttaatttgttcttttttcagtttcttaagcttagatcattaatttcagtcctttcttcttttctaatacaagcatttaaaaatacaaagtttcctttgagcacttctttgtttgaaattatgcaaactttggctttttaagatatcattattcagttaaatattttctagtttatcttttatttctttgcttaattagttatttagaagtatattttacaaacattttgaaattttcaaatgttttaattatttatttttcgttaatttttttatggttagaaaatatatctgtttcacttcaatcttttaagtatattgagacttcttttaaaacccagagtatagtctgtcttagtgaatgtttttatgtgtactgaaactaacgtatgttacgctgttgttggatgtggtggtttataaatgtcacttaggtcaagttggttgatagtgttgttcaagtcttataaatatgtactgattttcctttttcatttctatagtaactaagatgggaatgttattttctactacatttgtgaatatatccatttctcctttcaattctgtcggttattcatatatttttgtagttctcttattggatatgtacacatgtaggattgttatgtcttcttgataaactgatccttttatcatttatgaaagatcctttttgatttctgataattttatttgtcctgaagttactttgtctgatattactatagctactctggttttcaaacttttttttttatgatttgtgtatagtgtgtgtttttccatccctttgcttttaaccaatctatgtcttaacatatttacaataattttcatattggtcacatgtagttgggtattgccttgttaccaatctgaaaatccttaccttaaattgctatgtttatgtttattgccacttttacttaacttatttattgctgtggttcagcttaagtccatcatcttgttatttgtcttctgtttgtcccattggatctttgtcctttttttcacttttcctgccttcttttaaattagctgagtgattaagtattttttaatttaaatacatttatttagtatttagcatacacatttttaacttatcactatctaccttaatattacataatactacttcatatatattagatgaattttaatatgcatttcaatttttccttcttttctcatcatcttatgcattttatttctccctgcgttataaacctgacaatacattattactatttttgttttaaaccataatgtatctttttttaaaactacaaactgataaagttatgtttgaagtccgttttcttcaacctgaataccttttccataacatttcttatgttacagatctactgataaaacaatttttttctctatttcactatttttttttttttttgaaacaaagtttcattcttgttgcccaggctggagtgcaatggcttggtctcagttcactgcaacctctgcctcccaggttcaagtgattctcctgccttagcctctcaagtagctggggttagaggcgcccgccaccacacctggctaatttttttgtatttttattagagacagggttttaccatgttggccaggctggtctcaaactcctgacctgaagtgatctgcccgcctcagcctcccaaagtgctgggattacaggcgtgagccacaatgcccagcctatttttgaatattttatgggatatagaattctagttttttttttcatttagcactttaaaattatagttttattgtcttctgtactccttttttttctagtgagaagccagtgataatgctttatttctctgattaaactatgtcttgtttttccctttagctacatctttgattttctctttattgttagtttttagcaattagattttgaaaggtgttagagtggctttctttatgtttaccattttgggggttcactgagcttcatagtactgtaggtttatatatttcataaaatttggaaaattttggcagttcttcaaatattatagttttcccttccttctgtgattccagttatacaaatagtagattttttgatattatctcacagattactaagactatattcaattttttcagccttttttccctctgttcttttgtattgatagattctgcctttaagtacagtgattttttcttcttcagtgtctactctgctactaaggccatccagtgactttttccatttcagatattgtatttttttctagctctaaagttatttttggtcttttttatagttgtcaactctcatgttgtgttcatgttttcctttatagccttaaacatatttataatagccattttaaagtttttctctgctaatttcatcgtatgtcatgttatgctttgaaaagtcatattgaaatttaattgccattgtaatactgttgatctaatcaccttctaccttcattaatagattaataccattatctttggagtgggttagttatctcgagactccagccccacttttctctctgcgttgtatgcttgcctggccttctgctttccacggtagaatgatgtaacatgaaggcctttgccagatgctagcaccttgatattgaacttcccagccttcatgagccaaataaacttctattgtttacagattacccagtccgtggtattctgttatagcaacacaaaacagactaagacatgttatttctggtttagtttctatatacttattttttcccacttttttgttctatcatggtcagtacattttaattgaatgctggacactgtgaatgttatgttttcaattgtttgaattttgttcttatttcttaataagaattcagttattttctggaagtcagttaatttacttcaagatcaacctgatcttctggaacctgatcttctggaagtttgtttttaagttttgttaggatggttatagagtagcctatcttctagagctactttagccttctaaggtgtgaacctgggtctctgctggatgtctcacatgttcagtgaggattttctacttcagctggttggatcaataagtatcactcaattctaatcaagttctggtaattgttaagataacagctccctagcaaattttctttctccaacagttattctttgctctgtgcatgcccagcctagtatgctgcccagggaactctcatgcagatttctggagctttttttatgtgtgtctttgtcttcttcaggaccctgttccacagatttcagtcacctcaactttcctaaatgccgaactctgtctccccagttcagcaagatcctgtgctcttcttgaatttttctcttcttacgtcaccagaaaaaaacagagttatcaaaagataacacatgtgcgtgtgtgtgtgcgagtgtgtgtggatggatattttgtgtatatgtatttttccatgatctgggatcccagtcctatacaacacagttgttcagtgtctgaaaactgttgttttatatattttgtccaattttttattagtttatgataggaaggttagtctggtattagttctccatcatggctggaaagcagaagtaaaaatgtatcacttgtcagtataaggaagaagcattagggcaagatatatcaatcaaatgaaacttttacagtgccttgtggagttataagcagaagagagggaaaatgccaacagatagatgcagagcaccttgtagagaataaacaaaaggaagaagtaagaaggtcatggaacaaagactctgcagagaaaatgactgggttttctatgatccagtaattccagaaatctctttgtttagggttgaatgaaaaataatttcaacaagaatcctaggtattaatctcaagttctggtgggtgggtaaagaaaagagacaattccctggtcaacagtggaattgggagaatagcagaagcacaaatagaagtgaactaaaaaggaaagagtaattataaaatgttgtattataacttggattcagagtttcttgacaggcataggagagcagtatatagtaatttgttccttttttctaaggcacgagaccagaatcaaagtaattaaataacatattcattatttatacgttcttcatatactctgtactccataaaaaaaacagtgagtgcacattaaaatatttaattatgtctagtatgcggtgagtggcagtgggaaattacccaaggatgtgacagggaagctgggaaactgcttgaattgggaaggaattagaattaggaaaaactattttaaaattcatatggaaccaaaaaagagtttgaatagccaaggcaatcataaacaaaaagaacaaagctagaggcatcatgttaacccaacttcaaactgttattacaaggctacagtaaccaaaacagcatagtactggtacaaaaacagataatagaccaatacgacagaatggagagcccaaaaataaagctgtacagctaacatcatctgatctttgacaaagtcaacaaaaaacaagcaatgaggaaaggactctgtattcaataaatgatgctagggtaaatggctagccatatacagaaaatcgaaactggacctcttccttacacgttatacaaaaaatcaactcctacctattggatactatgcctattacctgggtgatgaaataatctgtacattagatccccatgatacacaattaacctatgtaacaaacctgcatatgtacccctgaacttaaaataaaagttaaaaacaagcctgaaaaaactagtattagcactttagaaactagggatgaaagcctctgtgactttagcaaatcaggagagtgaatatggattataactcaatagaaattgctataatatagtacatgtaagtagagaagttgaaatacgtattacagatttagagtagcccaaggctttctaggaaaagatacaagaataatatatgctgtgtatccatcagttagagtattatagttttattcagtacatatatattagtcaccaaacatatgtacagtattatttaagacacttttcaaatacagatattttgttaattacttttttaaagaaataccaaatcctgttgaggacatggagcagctgagactctcattcattactggtgggaatacaaaatggtatagatgctttgggagacagtttggcagtttcttaaaaaactaagcatatacctcacacctgtaatcccaacactgtgggaggatcatttgacaccaggaatttgagacgagcctgggaaatatagcaataccctgtctctacaaaaaataaattgaaaaaattagccaggcatggtggtgtgtgcctgtagtcccagctacttgggaggctgagggaggaggatcgcttgaactcaggcgtttgagactgcagtgaaccatgattgtaccactactctccagcctgggtgacagagcaagactccatctttacataaaaacaacaattaagcatactcttaccgtataacctagcaaatcacactccttaatatttacccatatgatgtgaaaacttatgttcatacaaaacttgcacatgaatgtttatagcagctcaattcataatttccaaaacttggaagtaaccaatatgcaaatgaataaatgaactaatatattcagacaatggaatattatttagtgctaaaaaggaataaaccatcaagtcatgaaaagacatggggtaacgttaaatgcatattacagagtgaaagatctgaaaaagctacatactgaatgatttccactatatgatactgtggaaaaggcaaaacaatagagactggaaaaagataaattattgctataggttgggtggctagggaggatggtggaacacaggagattttcaggccagttaaattattctgtgtgatactacaagagtagatcgtgtcatgatccatttgttaaaatccgtttgttacaacaccaagagtgaactctaatgtaaactataaactttaggtgatgatgtgtgagaaggtgcatcactggtaacaaatgtgccactgtggtgcaagtatgttcatagttgtggaggttgtggcatgggggcagggaatatgtgggaattatttgtactttccactgaacttttctgtgaacttaaaaccactaaaaaataaaattgattaaataaaaagagacgctagtttatgcaacatttcaggtggtctgtggattgacagaaagagcatgtactcatctgccattagatttaagttccttatgtattgagccaatgtcacaaaatcttgtcagagtttatatagccacacagtgcagaaacagatacataatgctttccatagcccagttccctaatgcagggccttttctagggtgtgttgggtccttgtctgcatacacaattttactaaatattatattacaaaagttacagtgatttaatgatgaagattcagaatatgggatagagaaaagaaatttacccattcacttattgtccgatcagtgcacatgaagattgtttgtagtgtccaggcaccattttttcctgttcaggtctgagaactttctcttcttgtcctttactgtcaaattcaccacttctggctatttaaaaaagtcttctaccatgagaaaaagacagcaatgttgttattactcataaagctatggctctttaaaatctgtttgtattgaagcagagtagacagattatttatctctgtagttcccaaatactattaacttaatacttgttatattgttacttatgacactgcattactgacttccagagacttgaaagttgttaccacatttaataggtgatgatcaaatacagttcttaacccagggtgttcagcaaagtgtgaatgatcatttattttccggtcatgttaaatttaccattgggaattttaaatataagcacagaacagcacatcttccaaccaaatcttcccttgaactcttgaggccataaacactgtgttcctagaatatgctccctttcagtgttgactgtacccctgctttcccccacactgccacaaggaatagtcaaggactatgttgttaccagaggctatgttcaagatttcttttccttttttttaacttttcaacatgattgtactactgttaaggaatggaaacaaccaccagaaatctttgattgccctccatttggtagctactgtttacttcttggaagccaaggttgcttagaacatcacttaaattgccttttccttctagaagtgtcagacttagaaattaagtcacactattagacatgagggactgctgaagaaaatggtatgagcagactgtggcatgtctgtcagaggttccttgatgctggtaaaagaggtagtgggttatgatggcttctactgacttgtcctaagaatcaacacaaatgtatttaggttttattattataataaagggaaacttgaagtgggagaaaatgagattgtaaattgattttttaaagatatccagataccactttaaaaaaaatggattaactcttctcatggcttaggaaattcacacccaccccctttacagagaagcttctgattacaccacctcttgtcaagttagatgcagcagtgagtgatgtgaaatcatttcttaattatctgtattaatggatggagaataataaatggcaaagaaacaaatgaaaatgctgattttaatataaggtattttttcccaagtgtattttcctttgaccaggaccagctacataattcctgaggcacagtgcaaaatgaaaatgctgggccccatgttcaaaaattaaggctgtcaagatggcattattaggtacctagatagggggtgaatgagagtctcatcttcactgggacatggcctccaggcacctgccatatgcaccatgactgtgggcatgtgctcctaaaccaatgcccaggcatctgcctgggctgaggacagcagcagtcactggagaggggacagggagggggaggccaggtaggacctggggcagcaagatggggtagcagtggccaaaaaccacacagcaggaggcagggatgcctgtgagcctagcctacaagtccctgaagcatgcttttttgtctcattagaccacttacaacagaaattaacagtgaaattattaagaaatcttagatggcaactgcaaagtattaaaagcattaaaccccaggggccctgtgtgattggccatacatccgtgactgcccctgccttggacttttaccagtgtgtactgttaatatcacctgatcatgtgggaagcactgtagaattatgctgactttgacaggaggagtgaacatgtcacataatttataatgtagataaccttgacatatgacatcaagaattgatgatagtttagattctaataaattcattagtgaactatttttattgcacaaacccacattaaggtagagggatggaggaggatgactatgttagtctgttcaggcttctgtaacaaaacaccgtaaactaggtagctaacaaacaacagaaatgtatttcttatacttctagaggctgggaagtccaagatgaaggtatcagcagatttagtgtctggcgagggccttattcctaatagatggctgtcttctcactataacttcataagaaggaagggaagagctctgatctcttcaatcccttataagggcactaatcccatttatgacagctccactcttataccctattcgcttcccaaaggccccaccttttagtactaacacattgcaattaggtttcaacatatgaattttgggagtacacaaacattcagaccattagcaatggctaagtaaggctcactacttactggagttgaaagttacattagggactataaaacaagacagtcatgatgtgtgctataatagagataaaaacaagaacaataggaaaactaggagtaaagagattaactttgacaggcaatgttgacaagccttgtgaaaaaaagaatgactttagtcaggccatgttggataagtagaatttctactcccagagatttgtccttccaaaccaaaagggacagtatgagcaaagatagtgaaatgcagagcttgttgatagataatgcctgcatgtggagacattcaggcattattttattatattgactgaacatctattttccagacactaaaatgaaagcagggatgtgaaaatacagaatttggaattagacaaagccacatttgaatcactatttaccacttaccagttgtgtgactggagacaacttgcataactaagcctcagttttagtcatctgtaaaataaagatattagttttgttgaagtattatacgtataaagattaggtgagataatgtttgtgaaacacttcaaccagcactctcagtctggataaggagaaaagcaagtagacttataaatgtgataataaatgctatgaaggcacagaaaagggtggccatctctgctcgagggtgttgtgcaaggcttcatgaaagaggtgatatttgaactgaagtctgaagggtaagtcatgtgtttgtaagccgaggaaaactgaaaaaaattcttcttagggtgaagtttgaaaatgaactccctttgtaatctgtgtggggggagggtggggataaggatggaagattagcaagcaagaaaaggatgatcatatggcctttaaatctatgtataaagacaaaaaataatgtctcattaccaccccaaaccacttttacctgattcaaaatatcagactcttctgagaagacagaagaccttctgtggtgagctcaccctcatgtaagatgtaaacaagtttgcatgagaacttctgcagcagatgttgtctatattttctttcctttttgaaaccgaatcttggttgctctgtagcccaggctagagtacagtggtacaatcatggctcactgtgacctctgcttccccaattcaaacaattctcctgtctcagcctcccaaatagctgggattacaggtgtgccccaccacacctggctaatttttgtatttttagtagagatggagtttcaccatgttgatcaggctggtctcaaacttctggcctcaagttatccacctgccttggcctcccaaagtgctaggattacaggcaagagccactgtgcccagccctatattttcttctttccagaagtcaagagccaggagagagtgagtgaaactctttaaaaaaatatggttactttttcttactctcatgtggaacattttgcttagttggtagacatttataacaagacatgattggctcttttaaaaataggaatcttagtggttgatatgttttgccatgtgttttacagtgcacatctttttgtgttttcttccagcctgaacacttgcctttgcagactcagttcaaagaaagagaagttggcaatcttcagcactctgtaagtaactgtgttgtcggtatcagcccaggtggagctggtagctaacgtgcttattaaaatatcatttaattgtatacaagttcattttattcatctttcccctatttgagtgtctctgctaagatctggtagtccttgaattttactcttagaagtaatcaagttttatgaaaccaataacgggcagaagagtctgtcccagagacaccacagaacatcatggggggttcattttataggtgctagctgtggcaaggtcaagccagaaggaaaggtcaagacaagaggatatttttggcagagtttcttttcagttttatcaggcatatgttcaaatgccagttcattttgctgtgtccgttccccagttccccagagctgagtcgaggtttcttttgtttggttggcttaattctctgtatgtctcatatgttcatttcaagcttgagccttgcttaagagacttctgaggtttataaccctgttcttctccagtttaccttaactgatagcaactccaaattttaaaatgtgaaactgatcccagtccccattagtcacaattttgtatttaggagctactactattcttattcagggtattgtaagcgacaaatgactggaaaatataagttgttgaactttaccttgccattcaatagtttttggcataatgaatcagggacactaaactgtagtgaattctattcttgcctgtttttaccagtgctagaaaaatgcaaacagctgctctgctaatgtaagcaatgtttgaatttttagaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagcc

SEQ ID NO: 37887 - DNA, 311001 bp, Homo sapiens
ccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggcgcccgccgcaggccatgctgcccctgctcgccgcgctcctggccgccgcctgcccgctgccgcccgtccgcggcggggccgcggacgcgcccggcctcctcggggtgccctccaatgcttcagtcaacgcgtcctccgcggcgagcccatcgccccgcggctgctggcctcggcggcccccgggccccccgagcgcccgggcccggaggaggcggcggcggcggcggcgcctgtgcaacatcagcgtgcagcggcagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcagcaggacctgcgcctctgcgtgggctgcggctgggtgcgcggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggagactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctccagagatgtgtatgtagctttttctttatttgatttgggaaagggaatcccagaattgcaagacgttaccctaaaacctgagcaagggaatctcggaaaagttagagaagggctacttctgtctcctttacctggctgtgagagatagatggaaacagtattatttgccctgatggcgattgtcttgcatctcaccacactgaccctcagttcccatccaccccccacctgtcacggtggcaaacacagttttatatgatttaactttttgctcattgttctaagctctgcaaaacacccaggcaagcatcaaaatggtaaaatcaatagttcctctgagctggatggctttcacgaaaatgactcactttaaaaggcatgtagatttcttttcatatgcatgaactttagcagataagcacattccaaaagctggtattaaaacctgagatattattttggcatttagattttttaaaaagataaactcttgggggataaatagttaatgatcacaagattttcctcactcttggtttccatgttacagtgtctgctgtgtagtagtttcaaattcttccaggttttcagaagaataagtaaaaagtccttaaagagacttaatattaaaaattattttaaaagcgtttttaagagactttgaaagctgctttcccttgctccatctcgtcctcattttgcaagcatatctgagattggtctagagctatagttctcaaagcctggtccctggaccagcaacatcagcatcacctgggaacttggagatgcaaaacttgggctccacccaggacctatagaatccgaaactctgggataaagcctagcaatctgtgttctcacatgccctccaaggcattcctatgcattaccagtttgagaactgctctgctgtgttctagtggaatggaaccctcaaatgtaggttgtctccttttatcttgagatgtctattatatcaaataaatgggatgcttattttcccagcaatctggctgaaggagaggctgggtcattgccctgcagcttcagctgcccctttgactctttgaggtcctgagatatctgtagcaggtaccagcccctgagaggggagagggtggagtattgatctttgtaggttgtaagcatcaccattttttaaccctgtggtaactggcaggagaaaagtcaataattttgctaaccttgatcaatttaatgtaatcatagcatttataactctggagacacattatgtattctttgtacacacatgtaatcactctccctgcttttttccaagatgtataccatggctcagagagattgagcatcttgtctacaatcacacagctacacgaggcagagctgagactaaatccaggatttctgcctccctgaatggtattgttcgtcactagaaacttcttttcccaggaaaattaggagctcactgctcaaggtccaccgttttgttgacctaccctagccaatgtcagattttgtgtagctacaaaccccaaagaacctgatagcattaattttaaatgagacactcaggcacttaatggaactttctatatatgggccctaacatctaccttttaggggtgattgaaatatcaacatctattgactttcagaattgccagtggaacctgcatgtgtgcatgtgtgttctgggctatgtgtgtgtgtgtgtgtgtatcactgatggactagttagtcccagaaagtgaggacagagcctgtaggtccttttgatcttgttcagctgtagtcgcccactgggtaaaggaagtcaggccttgacaagttcatctgtggggtctgtattttctagtcagtttgatttgcatcatctcagtagtgaaacgcttccaagtacgtaatttactaaggataagtcaggagttctatgacaggaaaagacgtgtgccattttagcctgtgtacatgtgcacatggcacccccagattccagcccatttataaagcttcgtggggccagcttgagttgcaaatgatatagcggagtccccaggataaatcatcattgtcagttatttttgcttctcctgagagaaagtttactcctggggagaatggataccccttgtttaatatccagctgctgccgaaggctgccttactgagttttctgctttcatccagagagctgcctccagccccagatctgaacactttagtcttctttgggtcttgcctcagcggaagagaccaccctgtctaaagccgcacctcctacctggggcaccacatccaatgactgatcaacacaggggcagaaagacccagccctctggccacaactggggcagctctgaagggtcctccactaccctccagcgcccgcccctcttccattcaagactgacttccctcagggctggctgaggtgtccatggagatttcatggagttgaactactccctctgtccacgtctgcctcctcccattccttcccttccacaggccttaatccacactccctaataagcctcttgcacagtgatctctatctcacagactgcttcttgaggaaccccacctgtgacaggcaatttacccaacaacgtgcagaattgttctagccatgtggtcattaggcacatatgaggagcacatcacaaaaatgcttctcatttgcatttttttttttttggagacagagtctcactctgtcacccaggctggagtgcagtggtgcgatcttgactcactgcaaggtccacctcccgggttcacgccattctccagctccagcctcccaagtagctgggactacaggcgcctgccaccacgcccagctaattttttgtatttttagtagagacggggtttcaccgtgtaagccaggatggtctcgatctcctgacctcatgatctgcccgcctcggcctcccaaagtgctgggattataggcgtgagccaccgcgcccggcctcatttgcatttcttttacacagatcacacatttctactttttctcttccgtctggatagttctctaataaccagaatcaaaggaggatgccttgtttctttccccctcacatcaccttatcagtcaggatacaccaggttatgctccagtaataagcaatctcagcttctggtggcttgtgcaagaaaggtttattccaggccgggcgcggtggctcacccctgtaatcccagcactttgggaggccaaggtgggtggatcacttgaggtcaggagtttgagaccagcctggccaacacagtgaaactccatttctactaaaaatacaaaaattagccgggcatgcactataggcacgcacctatagtcccatctacttggaaggctgagacaggagaatcgcttgaacccctgtgaggttgcagtgagccgagatcataccactgcattccagcctgggcaacagagcaagactctgtctaaaaaaaaaaaaaggttttttccttgctcatgctgtccaaaggtggcaggagttctgccctttggaatccttcagggacccagattatggggactctggctcaacaaggtggccgccatcatctaggtaggaggaagcaaatcctggagggtctcacactggcaattcagtatgctccaggcaggaagtcacgtcctttctgctcattgatgagaattgtcatgtggccccacccatcacaagggagccaaggagttcacatttcccggtggccaaagggagaggaaaactggcatcagtgagcaacattaatgataaccacgactttcagcactgccatacctgtgtgatctgtggccacccagaagaattacaggacttggtttggtgagtagacaaaggatcattctagaagtgctggctctagactctcctcctctgacacccatgccacctggccatgctggaagctacctgctgctcctggggcatttgacagacaatggcggtatcagcttggtagctttccaaaaatagaggaggggatatccctaaagaacttaatctggaagatttgcactctggatccccacggtctaggaatcttgagggataggagaatagttagaaacaaaatggggagcaaggagagtgtgtcagaacaagcatctcggctctcctggcctagcccctcctccagattcattaacatcaggggcatgaagaggtgggtcttcactctcctattctctcctttttctgggggccaatatcctccatttcccagctagattaagaggttttgagctaaaaggattgggagagttaagagcaatgtaaatggcattcatttcacagctaagccttttcctctggccggagaagccactaggaaaaggaggggataacagaggctaactgcccaaattcacccagctcactggggctggcggcccttgtgtgcaccttgtcatgggtgctcagtggggcctattcctgactaccctctggtctcttgctggtagaccttctgttcagcccccgccccttcaactccccaccccagggcagactggctctatagacagtgccttcgcccttcccggctctgctgcgcctcttctgggacatctctcccagtgcaatacagggctcattctgggctgggagtgccgaaccccttcaccatgtgtgggactgctggggaacaaaccttaaactggaacacggctgcttactgcgtccactgtgggcaggcacttaccagacatcaccttcccttcttgggtcttccttgctgggtctttggttttagggcaaaactgctttgtgcagcctccacacatgaggagacgcctaaggtccgctggattctcctcaccaaggctccattctgcggggattcttgttcttggtattttctctggttcttaccccaagtacaagtttcctacttgcctccagctctcagacattttcaagacgctcacccgtctggtcttaccatctcccattagctctaagtaacttaatttttttttttttttttttgagacagcatctcactctattgcccaggctggagtgcagtggcaccatcttagctcactgcaaactctgcctcccagattcaagccattctcctgcctcagcctcccaaatagctggaactacaggcacctgccaccacactcgactaattttatatttttagtagagacagttttccctatgttgggcaggctggtctcaaactctgacctcaagggatccgcccaccttggcctcccaaagtgctgggattacaggcatgagtcaccgtgtctggtgagtaacttaaatttacaaattttttgtccattccccacacagcaacactgtcctcggtcagctcctgctgttttctttacagccaaggtctctgcagacagcaggcccccatgctttcgccgcaatcttctgtttctggtctttctaagaggctgccttcttttctgcccctcacttccagctatcaagatcacataaccctcagcccaatcgatccagccagtgcaccatcccctccaagcctaggcatcctccaagcctgtgctgacactggatgctttctgccacaccccgggatgggacaaggcccaaggttattttgaggagggtggggatttcctgtggtcgtctgaggacaggtggcatggctgttcactcaggacaattaaaggcctttctcctcgtctcacccttagtattttcctggcgttcttattgcctgagcattcccaggactgtctctcaaagcactagagtgctgccaaagatgcattcttttgtgtgctttcacaggatcagtgataaaaatcaaaatgattggcatcttgataacatgccaaggcctcattttgactatggagacaacatgcctcccagcaagcttttttggcactctagaaaataacctaccttccaggtgccccaccaggaccccttttgttctgtgattagagtccttgctgggctactggcagtcctatcagacttcctgagggtcagtgggcatgggacagaaggctgctggccctatctctccaaccccccaaataccccaaccccaatctagaggtcaagtggctgcaggttggagaaacttgtttagaacctgacagagcccccagagtccccttgcgatggcactccaggcccctctgagccaccactgttaccaatgcacttttctatcccgggggtaacatttgtgatttccagcctacctatagggctgccttctatggtagccactctggacttaaatcatgatccacactgtgtaaggatctagaactgtggtcttgctattgtagtaccttggaatcttatttcagaatatttatgatcctcaggaattccctggctcaagttaattccatgtattatttgttcttgcaagatagatgctgattttcttaccatagaatttaacattacgccctatcttccctcctgtgtttctagataactctgcagctgctgagggaggactacactagaaaatagtgataataataaatatgattattatacagtaatcataataaatatgattactaataacggttcccttggactggagagggaagaagcagaagaaatagaaggaaaggcaataactaagaggagagaaggaaaagagaattgaaacatcagctctaagaacagaaagatgatcccctttctcatcagccccgcactcgcacaaaatgagagacccaaatgctcccaccgcaaggcacaggggagaatggagtgggtgccctggagctggaggctgaggcacggggagaatggagagcagaacatgcacatggaggaccctccatgggaagactccaggcaggaggggcacatgggcaggagcctgcctggtggctgggagcaggttctgctggcttctatcctgcagagctatcccaaggggactagctccatcctctctccttggatcactgagttccagtgtctcactcagcctgaaaggcacataccaccatgccagtgcaaggccatcaccatgtccctgagaggggacctgtgttggttaacactgtgcaggtccatcagagactgagaatggatattttaccatacagcattgcctgaagtcatagaataccttgctaagtaaaaaagaaagaaaagaccacacatcttcctactacccaaaactaagccctgcaaacattttggtgcatgtagttgcagttttgttttacacgtgtgtgtgaccataagtaattattcaaattaaaaaatggaaatggccaggcgtggtggctcatgcccgtaatcccagcactttgggaggccaaagcgggtggatcacctgaggttaggagttcgagaccaccctggccaacatggtgaaaccccatctctactaaaaatgcaaaaattagcccggtgtggtggcaggcacctgtaatcccagctactcgggaggctgaggcaggagaattgcttgaacccgggaggcagaggttgcagtgagctgagatcacgccattgcactccagcctgggagacaaaagccaaactccatctcaaaaaaaaaaggaactgtgttgtgcataactgcttttaaaacttgtatttctttactagaccagtgttatatcatagaaaaattagaaaataccactcataaaacaaatgaatcaatatctccaataacccccagcacccaaaagtgagcatgactgatatttattgatgggtattcaaatggatatattatacatattttaaccccaaactgggtacctgcttcttagcaccctgcattcctgcactcagcagctcttaggcagttccctccctctgcagaaggtcatagagggcttctcacggcaggtgtgtgaaggctgtattcttgatgcgtgggtcagacatcagctgcacaggatattgaaatctatcaaggccaaagacctaatggagatgggggagggaggattggatctgctatatttcccttcccaagtttatcatctccagacacatatcaaaaccagaccgaactttccgcccctcctggcagaaacatctctgcttttgtgtctgagatttcagatgaggctgataaggaacagaacacaactttagaggatgaacaactcaattcgtctcaagtcataactgcaaacggcttcgtatttcctgggtttatttgatgtctttggtccgaaaatgaattctgagatccaattagcaggaaggatattgctcccgtgtaatgctgctccaagagctgtcacaacatatggctgagttaaagctgcagccagaacccctctgaagtcagaacatccagaggcttgccagagaggaaaagatctcaccagaggtcggggaatcaccaaggacaggaaccacccatgggtcaaaatgtattcggcagctctcacagtcagtggaaagtgttaaggtcttccagaatggatcgtgacttagactgggttccctagaagcagagcctgagatggagagtctcatccaagcgatgaattggggcatgctttcaggagaaggggagtgagggaagcagaatggggcaggggaagtagcaaagcaagcacgtggtctcagctgatgtgggcttcagcctgaccccaggggaacctctggagcaggccgtgcaccacagttgctgcaccttgagacaaagggctggtcttttgtatttccactttaaccaatcacgggtcaaattctaggtagaggagtcagcacagcctccctggcagcttccgtttagctgggcccagctctctagaaggggaggcagctgggagaagtctgcagcctacactcagagcagctgtaagaggaatgtggatggggtgcctgcagcattcactgcagacctcacagtgttcttcagtgccattcccatcaatggtggagtggggggtgcccagaggacatgaagcttaaatgtgcccatcaaagtttcaactccctctccggccaacaatgctgaccaccaggccttgccagtctcgaggagatctggctgggtggtcttgtctctggtgtcctgcactggggcccactgaggtacagctggctttgtcatgccggccctccctaatgaggtcagaagtccctgccatctgtcattgcgtgcaaagtcctggttccccagtatgtgcattataagggaagcccctcagtattagggaatttgctgaggccaccagcaggctggtaatagcatgggacaggaccccaggacacctgcttgcagtacctgccctgccatgcatgagctgtttggctgcagcttgagcttccgtctcctcctctacagaacaaggggattggggcaggtaaggccccagtccctcgcaggcctgcagttttgtgttcaggctttccctccccatcttccaggccaagtcagaccacatccaccacaaagacacttccctcgaggatttttccagcaggtagactgaaacagaggccaagtcctctcatttttctgagtgacttgaaggggaaacatgtacaagtaagaaaagaggatgcttaagatatcagaatgtattttgccctggattgtctaaattggctgtttgcgtggctctaataatctataaaatcattatgatttttgcatttttctattcaaatgaccagggccatggagtaaagattttttttcaagtcaatgaggtaaacaagaaagaagaaatgtttcacattttaaaaatgatttctttgtcagttagcaatgaatatcatgctctaaagtaaggaagagaagaaattagcatgggttgtagatgccaggaacttgaccttccaaatcctcacagcaatctaatgagggctgtgcctccaaagtgcacagtggggcagctaggttgtcctccctgggtgtggggagaatcctggaattttaccatcttggtgtctcagagatgtgcccacacaggccttcaagaactctctgttgaattgcattatgagcaaaaattgtgtgttcctgtggtttccttgcaggcctcttccagcccaggctcagaaaacattgggcagatttcctgtgtggcctgactaaacggggttttaagcgccaccaacacctctgtgggaaatgccattcctgtcgccaagagacaccccctccagataggcatctgcaaggaaaaagcagctgttctggcggctttgtgaaccttcacctcggtttagagcacctgagggcagatcgagatgtgcgtccccacctggctgctagagagccggcccagagaaacaggagattcaggtagccatcagcaatgccagagaagccctcgctccactgcctttcacccaggatgtcacagacccacctcctggcccacacacgtgcatgccaccagcatcaacatgcaggcagacacagccactcccagatgcacctcccctggtgccaagaagagttttcagatacaaggagggaaaggaacaggggtttgggcattgcagacctgagtttgtttgcatcttagctctgccattttaccttgctgggcattctcttcctcatctgtaaaacagagaaaataatacctacccagcagccagagagttgggaagagtaattatgaagaacccctagggtgttccttggcacatagaaagtgcttcatgagtgaggtttactaatactgattattgaaaatcttcagggctgttgttcttgatcttttgcaagcatcccctctcccaccacctagagtctggttcactctggggccctggggatgttgaaggaaaggtttctcggggccttctgcctcccctctgaccaccccactgaaatggagagtcccagcaccgcgtagggctggggccacaggctctgccgctgcactggggcaaggaccctccatggtttctgatccttcagtgtggggaggggactctccaggtttgcatcccctcaaagagtctctctcctgtgctgaagcagcaaacagatgtggggtcctccaggaaggcctcgccactccaggaatggcccagccccactcatacagctccccaagtcccttttcaatgcagatccatgactggcccgattctaggctcaaataagcccgtgttctttacaattcacatccacttcattccggaacccccatgtcacacttaatttgccagatgagatggccgaaaccctgcagattcagctcagcctaccaattcccttcagagggaagtcaaaggcccaacatcgttagacattttagctcatggaatgattccagcagaatggagtgagaagtgggaccagccaggtggggtggaggtggtgcccagtgaggccagactagtctatttcaaatactagccctggcactggccagctgctttctaggcctcagtttccttttctgtaaaatgggaataataacagtacctctcccataggtactgttgtcatgattttaaaggaaaacatacctaagagtttacttcctctccacactcctttagaaacacatgtcccaactggagacctggctcacccaggactatcttatagcctagttggttctgtttgggatgataaaaaagttttgaaaccagagagtggtggtggtttcacaatattgtggatgtaattaatgccaccaaatcatatcctttaaaagggttaaatattaatttaatagccaggcgtggtgggattacatgcctgtaatcccaattacttgggaggctgagacaggagaattgcttgaaaccggaaggtggaggttgcggtgagtcaagatcgcaccattgcactccagcctgggcaacaagagcgaaactccatctcaaaataaataaataaatagataaacaaacaaacataaaagaattgcatattatgtatgtcataccacaattttagaaaacatttttaaaataataagaataagggaaaggcttacctgactccaactgagaactgaacatgggtcataaaagatgggttttgtccccttcccagtggaatgatccagaaacagcctgcgccccctgatgcacgggctccttgtggtggccccgcctacgccaccccactcctgggtttttctcctgcttgagttgcggaatggcctagtgcagtacaaaggagacagttgaggcttctctctctttcgtcaccagcacagacagatgtggcaatggtgttcaggaaagagagctgagagcagactcgatgccccgccatgaggcaggtgatggaaccccaggtttctgctcccagtgtacccaaagcagcccccctggtccagcaaactcccaaattccatacaggcatgactgcagggaacaagtgagagagcgtccctgccgccttctatttctgccaattccctcttcttttctctcaggtctgagtcgtgcaggaaaagagtgatgaaaccattccctcactctctcctgccactgagaattattcgttttgttccaaagagtctcgtgggctggaggcagccacagggcttggatggagttcattatcgggcacagacccagggcagaacataaaagattcagccttgacattttacagatggaaacaaatttctgcgctgtcatggtggggctcagagagagcacattttaacacagacacaggatgaaaactctttacagtcctggactggtgggagcagcagcacagctcgcaggagaccaacattggcacgatcggcctcatgaccctcaacaaggctctcatgctccatgagcctcagttcccctatatatacaagaggggacactaaacacctgctgtagggctgttggtgcctagcgctcccatggcacacagcctatctggacctacctctaggttatcagctgtgtcacactttgccggggaccacggatgtgtactattataaatagctattgtttattgaaatgttactatgttctgagaatttttaatcatgcatatagaagactttggtggtgccccagccatcccccctccccactaaccatttccatacatgttgtcccaacttccgaatgccatcatttccgaatctatctgaggatcctctctggttgctggtgcccaccgtgcccacgtgtcaaataatgagagagctgaggcattaaggcaccccaggagtggtcctcccacagtgaatgatgggaatctgtggataaataccccagctcccttgcccctcaggcaaggtcctactgagagggatggtgtgcaggtgccctcagtggcaaaacacttgctggataagtcactcttgccatcttcttccccactcctggctcacatcgccctccccaagtggtttttcctggagtcacttctcaaataaactacttatgtctgaatctctcaggatctatttctgaggaatccaaagcataatcttatttttaacaaagaacccaaagagctaggtactttgatcttccttttactgataagaaacaggcttagagacgtttaatgtctaaggttgcacaagccctaagcgcagaacttaaattctgacatctggccacagggccccagccaagccagcaaatgtcatgtccaaggcggtggcttgccagggaagcctgaggctgcagagggtaaatcccctccccatccactttaccctccacctaaacacacacacgcgtgcacacacacacaccccccccaacagagagagagagagagagcccatcccacagagtgcccgccaccaggtggtgcccttgctgggaggtgcaggctggccctgcagagaatctacccgcaggccagtggtgtcgtcaggtctggctgagctacttcgaagaaccgagcagtcggccttcagaagtgtctttctgaggaaggctggagcccagtaggcagaacttggattgggaagtttttaaaagctcccaggacttctgagctgttggagcagcacacacacacgcacttccccagctgttagcagtgggaggacaagcgtactttctaaacctgcctgcaaagttgaggttctagaaaccctctctatggtcactcagggtagcaaattccatcttcctggtccagctcccgtactgtgggacataaggacccccacccacccacacccccacaacctctgcctcctccccaccttgccttggtgtgaggattgggcttgggacttgggacggaaggatcaggggcaacaggacagctccttcggtggagctgccccaaggttctggccctgggctgacctgtgttatttgcaagtgcagcaagaagggacagaagcctgctctcctttctctggggtggttccagcccctgcaggagaccactgggacctagcatcagtctccccaaaaaacacagaatgaccgtccgtgatttaaaggagtaccactcctgtttttctgctgttaaagttctgactccaggtcaggcacagtggctcatgcctgtaatcccagcactttgggcagcctgggggacagagtgagactctgcctcaaaaaaaaaaaaaaaaggttctgactccagactgatatgtcaagatacatgattctgttttttgtttgtttacttaagctgtaaaacccaactttaaattcctaaatatatccacagagcctcttattttcttcatatttatcttaacatttaaaaatgtatcactggctgtcttaggtcgggttcccagaagcagacattgagatgagttttgtgtgcaagtgatttatgaaggatgtgctctcagaaaagccaagctagggcgtcatctcaggctgagtcccagggagaatagctttagcctgccccacagggaaccccaagtataaatagccctcagaatccccctgcctcccaccccgtgcacctggacaaggcttacattcctacattctaccagtcattggtgaagggctgccccagaggagtgtaaattctcaggcaatgccccctccagcagcccaagactggatctacaaagaagagttacaggtgccagctgctgggagtggtgatgaggccacacactcacgcatcagtaaaagcagatccaaaggctgggtacggtggttcacgcctgtaatcccagcactttgggaggccgaggtgggaggatcgcctgaggtcaggagttcaagaccagcctggccaacatggtgaaaccctatctgtactaaaaatacaaaaacaattagccaggcatggtggcgcacgcctgtagtccgagctgctcaggaggctgaggcaggaggatcacttgagcctgggaagtcggggctgcagtgagccaagattgcacaactgcactccagcctgagaaaaaggtatgagactccatctcaaaaaaaaaaaaaaattaaagaatcttgtgaacaagtaagatgcacatacaatcacagtgatacacatacacatgcacatatacatagaaaaaagatgggaaaaaaataaaccaagatgtttacagtggttatctatggctggtgaaattacagaattatttttattttcttctttatagtatttccccccaagttttctacaatgaaatcatatatattaccatcataattgaaaaaaaataagtatgtagttatggaagtcatgagtatcctgtggtcagggtagaatttgctcagatatgcaaaacacaaccatcaataagatcccaaccagctcttgaaaccccatttccgctgcatgcaagaaaatttttgatcttactgttatggtatctcagcctcctctggtttaaaataatctctttttgagtaattacatagtgtctgggtctctccaccaatgcaaggattttcctttctccgctttattccaagatggcagctggatgcaggggaagctaacttagcttcaggtcttggccttgtggcacaatcacatgctgcctgcaaggttagaggctttaccttgctgcctcagcctcatctggctctcactgtgactcctgatccccaagggctgcatgggaaagctatttgattgctggtttgaggagtcctttctgcagctcttcgttatagagtcactttgccttctttatggtgatgttctggtgaaatcaccagctagtacctcagatactttttggcccccaacccctgttggcacacaggaactcctgggctccctccacaactcatgcaagttcaaatgttattttacttttttttttttttttttttcttgacagcctctccctctgtcgcccaggctggagtgcagtggttcgatctcggctcactgcaacttctgcctcctgggttcaagggatcctcctgcctcatcttcccaagtagctgggactacaggtgtgctttttgtatttttagtagagacggggcttcaccatgttggccaggccggtctcgaactcctgacctcaagtgatccacccgacttggcctcccaaagtgctgggattacagacttgagccaccgcgcccaggcaagcccatacgttctatgtcaggtgagttgtctcaggcccaggccactgaagtgcctccctcagccatttctgctctgtgacttgggcaccatgttggatgcagcgttagcctgatccaaaggctcccttgagagatttgaagactcctcaggctatacccagggaagtgggagcaccagcccttatgttcgtggagtctttaaaactatctgagtgtttctatcgtctcttacacctggagctttgatcctgatgggtggggcgggaaaaaccagcacactcacaacctgcccctggcctgccttttcttgtcccatttcttaactccttctccaagtctcaaagtagctgtccttcttcctgtagggtagaaacttcccttttgtcatatctgcatttttctttcttccatgattcactcaatgatcactcaatttctctgagcttcgatttttttgatatgtaaaaaccccagccttgggggttttaagaaaaccctttctctctctgcaaagtctggcatttgagactattgtcttgctatcagattttaagtctactttgaaacttaaagcagaaaaatgaagcctttcattaatgctgtcaccaccttcctcttccttagagagatttacccctgcttcctggtccaggcttaatggcacaaaggctataagaatgagtgatgaggccaggcgcagtggctcacacctgtaatcccagcactttgggaggccaaggcagtcgatcacctgaaatcaggaattcgagaccagcctgaccaacatggtgaaaccgcatctctactaaatacaaaaaattagccgggcatgctggcacatgcctgtaatcccagctactcaggtggctgaggcaggagaatcacttgaattcgggaggtggaggttgcagtgagaagagatcacgctgctgcactccagcctgggcaacagagcaagactctgtctcaaaaaaaaaaaaaaaaaaaaaaaaaggcctggcctcgtgaaggcaatttggaatgtaatttggcaagagatatcctaccaagcccctccaggtggggcaaaaaccctttgcagcgatgggtgcccctgggaaataggactttaccctatccattttcaggatgaactcttaggaatgtgctagggttattctgtaccacaccttgcacctggtaagtggacaggtatgtagccagtctccaaaatacttggggttgcagggctagaagtaggagcaataaaccccttcacccctcctattggcagatggcaccttgtgcctggcagagcccttgctctgtgaggttggcatcacttgtggagctctgtcctcatgggcatttggggatctgaggacctttacctgtgtctgtaagtaagctggtgttgaggctacaacagctccatcctggaagttaatccaccatgttagcttctgattaaccgctgttctgggaagtcctctaagatttccagtttattgttccttgtttagagcaggtacttaccataaatcctgcccttagatcaagcaaccttgatgttatctacttcaattgacctacatgtcccttctaacccacccctcccttgtggtatataagcccagggtcttggggggtgatggtgcagggatcccccatctggtcttgctgccactggagaagtagacatggcttctgttcctaagaccctattaaatgtttctttctaagaaaccagatttggctgggcacaggggctcatgcctataattccagcactttgggaggctgaggcaggtggatcatttgaggtcagcagttcgagaccagcctgaccaacatggtgaaaccctgtctccactaaaaatacaaaaagtagccaggcatggtggtggtgcatgcctgcatgcctgtagttccagctactagggaggctgagacaggagagaatctcttgaacctgggaggcggaggttgcagtgagcgagagtgccactgcactccagcctgggtgacacagcaagactctgtttaaatatatatatatatatatatatatatatatatatatatatatatatatatatatggccgggcgcggtagctcacgcctgtaatcccagcactttgggaggccgaggcgggcagatcatgaggtcaggagattgagaccatcctggctaacacggagaaaccccgtctctactaaaaatacaaaaaattagccaggtgtggtggtgggcgcctatagtcccagctactcggggggctgtggcaggagaatggcgtgaacccaggaggcggagcttgcagtgagccaagatctcgccactgcactccagcctgagcgacagagccagactccgtctcaaaataaataaataaataaatataaaaaataaaatatatatgtgtttatacatatatgtgtatgtgtatatatgtgtgtgtgtgtatatacgtgtgtgtgtgtgtatatatatatatatatatgaaaccagatttgtcagcctctttctttggcttctcagcttcctcaaactttgtggcaggtttgcatagacctgcccactgtgaaacagctggactgcctcctgctttctgtaaccatttccacacatttccacagccttcatcattaaagtgactctgctgatctacttcccctgctgatatctgctacatctttccactggcatgtcatgtcacatcctgcagtgatatccacattacaatcacttcttgcttgcaacaagctctctcagctgctcctggaaaggttgtgtttctataaacattcaaataggtcatcaagctctggaactgtaaccatgaggaaaatattgaaaactatctctgcaatcagatagcttataccacttacctgacaaatgactgaatatttgttagctctgtaagggttcccagaaatactatatcatcctcataaaatataagccagcacctgaggtgatatgtcctggctctgatgtgtatttcctgctaccatattactgtgccgtatctagttcacctattcattgagttaacacctgcgcatggaccatcagttaagtgctcagtcctaatctttgtggaataggtgcccaagttgagatcgagccttctttttgacaaccttgatgatcagaaggggagtgggtgaagaggtgggtactgttcttctaaaacttaaacacaagctgggcacagtggctcatgcctgtaatcccgcactttggaaggccaaggcaggaggatcacttgaacccaggagttgaagaccagcctgggtaacatgatgagaccccatctctacaagaaataaaaaattatctgggcacggtagtgcatacctgtagtcccagctacttgggaggctgaggtgggaggattgcttaagcctgggaggtgaaggttgcagtgagctatgattgcaccactgcactccagccggggcaacagagaatgaccctgtctcaaataaataaataaatacatacatacataaatgtaaacacatttttctgccttcttagagccaggagtttgaatgtgcctttgaaggaagtcggtttcttttgggaaaaacctctaatgggactattagtcaggactctgttgattgttgagggcataaacccatttcaaaccagcatgggccaaaaggggaatttcctggattaagtaaccaaatcccaggaagcgggggactgcagctgggctcagagagagacaagagccaagacttacccgggactttctcactctccctctgtttcttgtctctgctgctctcagctccttggcttcttctataagtctcaggaagatgccttcaggagaagaaagggccccattagggagtgtgcgatccaaatcagctgaagggcaaagttatgtaaaggtttttttgtaaattttttatttaaggattagaaaagtgcacaaatcaaaaactcccaatttgatgaattttcatagtagattaaagacacttgtctagccagcacccagatcaagaatcagaacttaccagcacccacagccccgctaatttcccttgcagtcactaccccaggtcagttgtggacttttctataggtatgatgtatgtcaatgaaagtgtcaagcagcatagagtagttttgcgttttgcctgtttttgaactttatgcaatgaatccaggcagtttgtactcttttctggctggctcctgtggctcactactatgtttgtgagatgcatccacgctgttgcgtgccatcatggttcatgcattcccatcaccacgtggcatctcatggtgtagaggtgccactctactgatgacagacatgtaggcagtttccaggttttggtaattacaagtagggttactatgcacattcttgtatattattattattattattgagacagggtctcactctatcaccaaggctggagtgcagaggcaccatcatggctcaccactgccttgacctcccaggctcgcatgatcctcatacctcagcttcccaagtagctgggactacaggcacatgccaccatgcctggctaaattttgtgttttttatagagatgggttttcactatgttgcctaggctggtctcaaactcctaggctcaagcaatcctccaacctccgccgcctgagtagctgggactacagatatgtgccaccacacctggttaacctaaaaaaatttttgtagagatggggtctccctgtgttgcccaggctggtcttgaatttctggcctcaaatgatcctcctgcctcagcctcccaaagtattgagactacaggcgggagccacagtgcccacccttcttgcacattatctttggtaagcacacacattcatttgtgtttactacatacccaggagtgtgtgtctatgtcatagagtctctatgtgttctgattgagtagatagggagttactgttgttccatgtcctctccaacacttaggatggccagccttttaattttagcattccagtaggtgtgtagtggtaatccattgtggttttagattgaactgcgtttcatatccctattagccacttaaatacagtcatgcaccacataatgatgttttggtcaatgacagactgcacatacaacaattatattatattatatgtttacaataccatatttttactataccttttctatgtttaggtgtgttttgacacacaaatatttactgtgttacagctgtctacagtattcagtacagtaacatgctgagcatgtttgtagcttcagagcaataagactacaccatatagcctaggtgtatagtaagctataccatctaggtttgtataagtacactgtatgatatttatacaatgacagaatcatccaacccatttctcagatcatacccctgtcattaagtggtgcgtgactgcattctctgttgtgaactgccagttcaggtcatttgcccatttccgtactgagctgttgacattgcctattggcatggaggggttctttatgtcctgtgaatcctctgtgagatgtacttatcaacaaatgccctctcaagtctgtgacatcgttttcatagtcttaccttctgatggttggaagttcttaaatttagtgtagcccaatttatcaaaatttcccctgatgtttaatgccttttgagttatatttaagaaatagttgcctattgcagagactgaattttaaagatgattttaggtagaaagaaatgaagttttaaagcaagaatcacttagagaaaaaattgtaagcaaaatgtttatgtacatccaagttgtaatgtgaacatttcagccctaaaacatatattttagacttacttggaccctgaaaataaagtttactgcctcggttgtttttcttttttaattcatcatggaatatcagggttgcaaagtctgaaaagtctttcctttcgttggtctgactcaggtcaacaaatactcactgagcacctctctgtgccatgctctcctgggaattaggaatgagaaatgatggtgttgctcagggcctggtagggaggatagtgcgcccaagtcatcttgatcccaagccatcttgatgatgctgcaatggaagcatgtccctggcatctgcagcctcaaaggataagagtgcatctgcttgagagagaaggcctgcagaagaagagagatacttaggaattgggtcttaagcagctgtatgagagctctcaggtggatacagatggagggtatgggttttgtttgtttgtttgtttgtttatttgagacggagtttcgctcttttcacccaggctagagtgcaatggcgttatcttggctcactgcaacctctgcctccaagattcaagtgattctcctgcctcagcctcctgagcggctgggattacaggcacctgccaccacgcccagctaatttttgtattattagtagagacgaggtttcaccatgttggccaggctagtcttgaactccagacctcaggtgatccacccgccttggccttccaaagtgctgggattacaggcgtgagccactgcgcctggcctgaggggttttattccagggagaaggaataggtgatctgtggtttgtgcttataagggattgggcttgaatggggacatttgcagcctgccttcaaggcttctacgtgcctcatggactcaaactccaaaataaaacttccaaacatcccctttctagacctgtggtggcaacaggtgacccattgggaaatctaggatcctggacccaaggaccagagccaggatgtgaggtgggctgtattgccctacttggtagcatctcattgcctacatctgatctttgaaggagttggtggctttcaacttgccagaaaaaggacctcttacagaaaaattggtttggaaggcctatacatgaagaggaagctgtggaaaaggggtgttcctttgctgaacctcctagagtaataattactgtgtagtatgaccaacactttattatgaccaacctttattataaccatgttttattttaaatgcctggcttctagtgacaatgtacacctggaaaaataaacaagtttgaggctggttacaaaaggaaaaaaagatgctcactaatggtgctgaataattaagagagaacagaaaaagaacacacttgattaagcatcaatggggtctgaggctattctaaacattttactcactgtatcccattttattattgtgacacaaaggtagggtgtaataatccccattttacagtttccatgagcaaacagagctccagaaaggttaagtcaccaggctggacagtaacagagccagaattctcacctgggtctgagtctgacctcctctagctagaattattgcaaacaaaccaatgtgcctgacaaatatggggcacagttatatcactgccacataattaaaaaggataattgccccagggagaagagcggcacatggtgacgaagtcccctgaagggtggcaaatatcttgtgagttcaggggaactagatgatgacaccagcaggtcccagctggcaagtgcctccttgcttccctatgagtttgctcttcccaacagtcacacaggagtgtccctgtctttctactgtcctgcctccaagtgttctcatcttagcctgtccttttagatcattctccagacttctaaataggttctcttttctgttgattaaaataataataataataaggctttgattctaagcctgttacatacaatgattcttaactggatggtgattggtgatgactcacttaccagcgatgtgggagtgtccttacattcctgcgggcttggaaagtattccctgagagcctttccttgtgttgaagtccattcatcttccttgcgttccccaaccttacacaacatctgtcctcctgtctgcttacctgcagtgtaatcaaggatctcacaggcatgtttgatgctcagagaactcagggatgtttcaatcagcgactgtcccagagctgccctgcatcttagtcatcgtgttccgatgggtttctgcacttccttcattcataagaactgttagttcagtgcctttttaggaaaggatcacccagcaggagagctggagagtttttggtctgcataataagtgggaatcacaaggagatgacaaatacagttgaggggttgggctgtgggaagagtggagattaaaacaggtagaaaaggtggctgaatgctgggcaggaaaaaacccagtcacagaggaaggctatcttgaaaggagctagccttggaggaaggcttgcgaggatgatttcactctgcatggaaaagatggttgcagttgtattttttaaagatggatgcaatatctcccacctctccccaaccccatgcttttctattaccttatcatttctccatcaagaggtggagttcaattcccctccccttgatgtggggtgggcttttgtgactggtttgtttgtttgtgtgtttgttttttaagacagggtctcactctgtcactcaggctggagtgcagtggcacaatcacggcttcactgcagccttgacctccccaaattcaagcaatcctcccacctcagcctcctgtatagctaggactacaggcacacaccgccacgcacagctaatttttgtatattttgtagagacagagttttgccatgttgcccaggccggtcttgaactcctgagctcaagcaatctgcccacctcagtctcccaaagtgctgggactacaggcgtcagccaccacacccatcctctttgtgattgtttcaattaacagcatgccattgaagtgatgctgtgtgacttcagaggctcagctgtaaaagggacccatattccaccttattccctgtgatcctcactcctgaagttttgagccctgtgtaagcattttaactgtcctgaggccatcagtctgtgaggaggcctaaaccagtccacatggagaggccacagaggccctgaagccatataaagaagcagaggtgcccagccggccacctgctgcttcaaccctggctctccaagctccagccactgtccaagagtaaccacacaaatgactggaaccagaaccaccccaacaagcctttcccaaactccttatctacagaaatcctgagagattacgaaactgtaaggcactaaattgtgaggtgatttgttctgcggcactagctagctaaacagaagttctggccaagtctatattaggcaagataacaaagtggagtcattgtaaatcatttgaagaaagaaacattttgcttgtcttttctggattttctatgccaaagcattttggattaaatcaatagcactttcaccagcctatggcctcaaaatgatgccctccttccttataaccacatggtaaagacccaagccccatcatcttgaccactggctatcagcaaccctgtggttcaacctgctacttctaggagtcacatggggtgtcctctcaggcctgctgatccactgcagtttctgtcccacctgtgcatcacttcctgccccagccacccctcctcctggccaggacattgcccacaaggtcatttggtggagctttctcactaccatgccatctggttctggcgctgaggcaaggtgaccagtcctgcccacaaccagtgccccatggtgctcccaggaccctaaagcagatgtgcttgggcccagggtctccaaaaatctcatctgagcagcttcattctctaacccttttcctttctctattatggttcaaagaagagatgccatagcatccctctggtggtccttctgtctcctccagcccatcctccaattaaaactgatccctcttcccctcactgtagatcaaaagatcccatgcaggccgggagcggtggctcacgcctgtaatcccagcactttgggaagtcggggagggaggatcacttgaggtcaggagttaaagaccagtctggccaacatgctgaaaccctgtctctactaaaaatacaaaaattagctgagtgtggtggcacatgcctgtagtgccagctactcaggaggctgaggcaggagaattacttgaacccaggaggcagaggttgcagtgagctgagatcaggccactgcactccagcctgggcaaaaagactgaaactgcatctcaaaaaatatttttaaaaagatcccatgcatacaaagagaagctgggttgggatgggggggatttttatacatcagggcccttgtgcaacccaccaaaaatacttcctaactggaatcatctcaaccaacagcctcatctccacagagtacatttgacttctgaggagtcaaaaattttttaaaggactatttaaattgtatttcagagaaatgggggtgagagaattaagatataaaacctgctggcaataaaactcttccacttatgggaatctttcctggtggattttgtgggagcattattgcatgtttcattacagacttgagcagacactggtgccattatggaaacacatcacaacacggggttctctgcaaaccagtttgctttaaaaatgcatttaaattatgctctgcaggctttatgccatagacctgaaatcagctaagagctggttatcccagagtcctggtctacatgattagtgggatccattaatagatgggtatatctatcaggtcactgggaatctgaaaggacagctactgtggtatggaacatttttgtagccatgcagaacagaatctgagctgaaatctgcagctgtgtacctacttggagtttctagacaggacactaaagatgaggaaattatttgttgagacctcatgaaaattaaagacatgggaaagaaatgaaaagaaaagctatggctttaaagagtctgcaaaaaggaaagagacgttcagtgttagtgaaagtcagtgcagaagaagatggaatggaaattttgaagcagaagccactattatcacagactgcaaatgacatctcaccagagaatcgcccaaggtgagaagcaccatattcaaaagagcttctacttaacatggccaccgtgaaaatactttccccaactcctacccaccctgaggcttttcagaaaatcaccaaaatgtccttgactaacagcagtacctcactcttgccatagagatgtctgacccaccatctctttcctctcctgccaggcaatgggtgccctccttcagcccattcctcctttcttctgtctccactactcatggatcaattagctcccagacatatggctgctacccaaccgcttgtccaacaagatcccagctttgttctgtacctaccttcctccatggcagttacatgatttgtaggggatgagcccaacttcatctcccaaagagtgggtgctaattagtgtaagccaatgttggtggcaccattaccctcacctgtgattgggttaggcaggaacatatcatacaattttggccaatgaaatatgagtgaatgtttatggggagttttgggaaccatttttgttttggtttggctttttaatagagatggggtctcatcatgttgctcagactggcctcaaactcctagtctcaaacaatccatcttggcctcccaaagtgctgggattataggcatgagccactgggccaagcctgggaatcattttttactggtaaaagagacatacctcccccttttatcactagacatggttgggtctgctgatgatgctagaactgtggtggccatcctgggactaaggagagccaacctaatgataaaagagcaaaaacaaggaaagaacccaggtatttggtcctgtcgttgagctgccaaactatcaatgttggagacaccccggcttgggtatttatattggttggtccactgtcagttggtatttctgttgcttgtatctgaaaatatcctaactgatataaccatttagcttactccttcctccattcttccagctcttgcccagttggagaaagcagcttagggattctctgtctctatatttttcctttctctttttattccttttgtgaacccaaaggtaactatcataattgctgataggtttaagagacagctcaaccttgcaactgtatcatagaaagagaaaccctgaagttttaaagttaaatgacacaacatgttccaaaggaattgttctacttctcaggggtcacagatccctttgaaaatctgataagaaggccgggtgtgatggctcacacctgtgatcccagcactttgggaggccaaaacgggtggatctcttgagatcaggagttcgagaccaacctggccaacatggtgaaacacagtctctaccaaaaatacaaaaattagccaggcatactggtgggcgcctgtagtcccagctactcaggaggctgaggcaggagaatcattcaaacccgggaggtagaggttgcagtgagctgagatcgcaccactgcactttagcctgggtgacagcgtgagactcagaaggaaagaaagaaaaaaaagaaggaaggaaggaaggaaaagaaagagaaggaaagggaggaagggaggaagggaagaagggaagaaaggaaggaaggaagggaaaatctggtaagagccaagaggtagctcattagaaaagtgcacatgcacacccgaatgtgcccatatgctaaagtttccagagggactttggaatcactagtgggaatctccacagcctaaggtgtgttcatggtgctgtgttttttattcaagaaatgggatggagaaaattttcttcaccaaaaatcaggagaaggctttagaagagagcagtggggcagggtgggtggggcatgctgttctcatggaagaagtcataaagaggctggactgtgttccacaaatgtttatggaatgaaaaggggaagagaggaactctggaaaataaccaagtggaaaaacgaagaagggctgcgggcacccggatggtagatgcccatggcaggtggtgagctttctgcatagctcctccaagtgtcacggaattcaccaaactcacgaaatgttgagaaaggttaggtttcctatggaaaacagtggtgggggctaaaatttacatttgggtttgctgtgaggcaacacacacagacatacagggtgaaggcagagaaaaacccaaacaaaaaagtcttttgagacaggatctcactctgttgcccgggctggagtgcagtggcatgatcatggctcactgcagccttgacctcccaggctcaagtaatcctcccaccccggcctcctgagtagctgcaactacaggtgcacaccactacacttgactaatttaattttttttaatcttaaaattttttagtagagatgaggtctcactatattgccccaggctggtctcaaactcctgggctcaagcgatcctgctgccttggcctcccaaagtagtaggactacaggcgtgagccaccacacccagcccaaaaaagtttttaaaaagaattaggaattagaacatgcagaaactgtgaggcaaactctgagtttacttaacccactacacactgtgtttaagtcaaatttcctaaatctccatggggcaggaagacccccaaatgacattcagatcacacatacacagccctgagttaagcagcatgcccagaatgacacagttcctaagtgacgagctgggatcccaagcctattctgactcagatccatcaaaggaaagaaaaatgttttaaaggttatttttcttaatcactggtactgccataatattgacttctatttttattattattattttgtgtttctttgagatggagtatcactcttgtcgcccaggctggagtgcaatggtgcaatctcggctcatcgcaacctccacctcccaggttcaagcgattctcctgcctcagcctcctgagtagctgggactgtagacaagcaccaccacacccagctaatgtttgtatttttagtagagacggggtttcaccacattggccaggctggtctcaaactcctgacctcagatgatccacctgcctcatcctcccaaagtgctgggattacaggtgtgagccattgcagccagcccctatttttattattaaatataattttgcaataattcagctacattcattattctttcacccatattaatcaagagtctattatatgtataaggtattcaaggttgggttttggttttccgattctgacattcctctcttctacccctgggatttctcatcaaagggactgtactcataaggaatgagaactaaatgggaaataaggtagtgctgcataaacacagaggaagaccctgtaactagcatgaccatatgccctggtgtcattggaacatgcccagtttgtgcctattttctcagtgtccatgttaataactggacccctcttcactctcaagatgcctggttggatcatgagttatatggtgtccctactgagaatcccagtgcagagttctggtacgagctgatgtggagcaagcagttcagattaggaagcctaaaagaacccttgattttcacacaccaacccgactccccatgaatctcaggtacccgaatctgaagcttccaaccttaggtggagaaagtagactagaaagaggcaggtcttgccaggttgtgtgcactacacggaacagaaagtgaaggagcaaaggatgcctgggcctgcccggagaagacaggctttgcttatttatacttaccacacatggatgggaagggcaaggggaaactctctagtgtgccctcacctctgacactcagtgacccaacccactggtaaactgccgcccaatccatgtctcgggatctgaccactcatgttaccaattcttcctcccctgggaggagctaggtgtcagggcagcctaagaagcctccctttccctgtaacaggctctaacagtgtataaaatatactatcacaatatataatatatcaggatacaacagtaacctgctagggtgccttcaaaatggaataagacaggttcatgtgtactaggagcatctatggtgtggccacaaagtctggagatgtagatcatattttatttttctatagattgaaaagctcttgacgatgttatgtatgttgacgtacgtcagtttactttgcagacactgtgtagtttatcagaggagcaaaggtatgcacacaaatgcccacaatgcaaagtagaaagcagtgagaagcataaaggagacacagattgtgctacagggacttggaagaggagagtcctgacttggccaatctgggaagtcttcatggaggaaggaagggccaagcgagagtttaaagtgaaggtggggcttcaatgtgtggaagtggaaaaaaagggtatttgcttcagaaagacttcttttggtagcaaagagaaaaagaaaactaactcagactatttcatagaaaataggtttcctataggaaatacatggactagagtgaaaatgagagatttggcaactgaaacaattccaggagcctgaccttcccttaacaaattttttcctccctttgcaggttttctctactttcctctctgctcccactctgccatacagtacgtgtttgttttttgctttgggcaaacacagactatggactatgtgccaggtactattctaagggctttaagcaattttaactcatgtaaccctcctaacaaccctgtgcagtgggtattattatcatcccctattttacaaatgagaagtgggtgcagaaaggataaatgacttagccaaggacatatggcttgttgtggtggggccaggatgcaaaacgaggcagctcagttccagggctctggtcacactcagtggctctgccacctcctgcttggtctcatgacagctgaggcagcctggtcaatagcccaggatgtggtctgatggtaaaacctcttcccagcagtaacagtgattagttgtgctaatccgatttcctagctctcaagtgtggacaaaaaaggccagtggatggagggaagagaggagggcaagcccacagcaagtccccagctctagagtggagagtcctcgctccttccatcgtggtcccacaggtattctacactgatctggccttggtagacctagttctgtggtttcctaggcctggatcttaggcttccctgccctcctgagcatgaggatctttgcaataactgtgctcactcttagttgaggtagtttgagggagtttatgtttcttggaatctagaaagccccacctctactctctactctgtagagctcagaaggactactagtgctggcttggtttttaactcactgggtgaactggacaaatcacttccgttttttctctgcctggtttgctctagctacacaaatgcaaagaccctcgtgtgtggttaactggaataagatataggtggaaggggatgcactggatcttacaatggctctggcatgtaaaaaaatatgggaggcaggccgggcgcagtggctcatacctgtaatcccagcactttgggaggctgaggcaggggatcacgaggtcaggagattgagaccatcctggctaatacggtgaaaccccgtctctactaaaaatacaaaaaattagccggacatggtggcgggcgcctgtagtcccagctactcgggacgctgaggcaggagaatggtgtgaacccgggaggcggagcttgcagtgagccaagatcacaccactgcactccagcctgggcgacagagcgagactctgtctcaaaaaaaaaagggaagccaagcacaggggttcatgcctgtaattctaacactttgggaagctgagaccataggatcacttgaggccaggagttcaagaccaccctgggtaacaaagtgagaccccaatttgtaaattttaaaaaaattagccaggtatagtaatgtatgcctgtagtcccagctattcaggaggctgaggtgggaggatggcttaagcccaggagttcaaggctgcaatgagctacaatcacatcactgcactccatcctggatgacaaagggagactgcatctcttaaacaaaaaaaatcaagggagaaagtattattataaagactgtgaaattgggtagctcttgctaaccaccattcatgctttaaagagagaaaataacaggccaatgacaagtcatcatcagttcaaactgtgaaagtcagagggcttccttggcagtggttaaaggcatagtggctcctctcttatagccaaaaggcagaccgtgctgaagggcagctttaggacccaactgtaaaaatagcagaacttcagagcgttgatttctcagccccatcaaaaccagagacgcgaatcagacctacccaagtgccatcaccccatagtgggaaagctgtccacttctcccatgagggagactgaccatgagacatcaaatgaccttgttgccagaactgcccatcatgagctgggtaatgtcagacccaccagttgataaggttggcaggcccagcagcaattcttcaaagatggaagccgtggaggcaggatcaggtgtacaaagggcagagcgcacgagtgggccatgtgatgaggtggcggccccacatggcaccatcactgttgcaccgacatctctccctccgcccacccctttggccccacaagaagttcctatgacctgctgacacaggatgggaaaagtcagagcttggttcatgcgtgagttggcttgatatgtgggtaccagttgaaacggattgctgctgtaccacagccccacatgggtgaccctgaaaggcagcttgcaaggaaatcttcctgatgggccgggctttggatgaagtgcactggccctccgctttgtgtggaaagagaggcctgaaataagaatatacacagatgcacgagcagtgaggaatggctgagctggttgatgaggggcctaaactaacaagattgggagatcagggacaagaagatctggagaaaaggcagatggtggatctaggagagtacgcacaaattgtgaggatctctgtgttgcatgttaatgcccatcagagaatatctgctgcagaataagcactaaaggatgggcactgtggctcacccccataatccaagcactttgggaggccgaggtgggtggatcatctgaggtcaggagttcgagaccaggctggccaacatggtgaaaccccatctctactaaaaatacaaaaattaatcgggtgtggtggcaggtgcctatattcccagctactcggaaggctgaggcaggagaatcacttgaacccgggaggcagaggttgcagtgagcctcgatgacatcactgcactccagcctgggcaacagagtgagactccgtctcagaaaaaaaaaaaaaaaaataggcactaaataactaagtgaacaggatgactccaccactagacatcagtctttgtcctcaaacactcagtgtttgcacagtgggctcataaatggagtagccagggtggcagagatggagtctattcagaggcctatagcatggctcacctctcactgagactcctctagctcttgttgctgctgagtatcctacctgccagcaatggagattaactctgaggctccaacatggtattatcccttgaggagaccaaacgactgcttggcgggaagttaattacccaggaaggacagcgattaatcttgtacaggattgatacatattccaaggatgtgtcttccttgcctgcctgaaaggtctcagcaagcacagcagccacaaacagcccttgaaaatatctattgcaggaagcccagaaaggaagcaccaaggtgatttaagggactgttcttggggttgtgggggaaaggaaataaaaggaagctaagatctgagatcccagaagatcttaatactgactcaagactcttttgaaagatgtaaactccaatagagcatatggatgatttgtttgatcctttctggggcttaagccaagaccctatcaagcaattaagtgggagactgtgcttatgaacagctcttttgaagtaaggcagatgttctccttgcttctcagaatagtttaggccaaagcatttcgtgggcataaattagcctaatatcagtgtcaatgctctatttcagcttactcgtgaagacctggtctttgtgctgtaagcaattaagaaagacagaattcttaagtgtattccaaggaaatgtaaaaacaaagtgttcaatgcacacttatgtatatatattatgatgttcataacaaaagtgtaaaaacatatatgggaaagattgaaacttactttgaggtagtggttttctgggcaggcaggaagagaaatgtgtctatgtgtgttacttcttatttctgaaataaaatgacagtatctgagcaactgcagcaataagttaacttctgttaaatccgagtaagtggtacctaattttctctatgttcaaaatattttataatttaaattaagaaaaaaaaaacctaaacttgtagatggaaatcattagattaaaggagtctttcccaggggtgggtatagtaagccccttacagaggatgacttgatgactttctatagataatagatgttggggggttgcccacagcacccagagtcgtctttgcttcacacaaatctgaccatatttgttccctgcttaaaagctttccatggctccccatgttcttcaggataagctgatgcccttttggcctggcaaacacagtccttgaggatggttctccagacctcgggaacagcccctcccaccatgctcccacatgcaccacgtgcccctagatcctgaactccctgggctctgagcatgctctggctcgcctctgagatgcacacatactgctctgactaggcagtctcaccatcaaggccaagatatctctatccttcagcttagacgtcacttcctccaggaagccttcccatctagaactttgtggttgcttatgtgaccaccaagcatccattcaccctccttccagggatatcccccaatttcactagaaaaccacatacttaccccagtttcagtccatttgctgaagcaaggctgagaccagacctactctagggatgcagtgtggggctgcccctgggctcccttgatacacagtgatagcttcaggaactgaggacaacaagactcaaggccacttttgctgagtcagaaacacctgctgagagacatgggagactgctgcagccttctagcgatcccaggagagagcccacctgagagtggagtgaatacgaagggaagaaagacaaacaacaggtcccggcagcattccaccctagtaagagtgcacccgacggtggcctaccctgggatgctcatgttatttaagccaattattccctgcaccatgcccatgcccaccttttctgtacacatttagttagtcttccttacccaaaaaaggttgggtaagtacacttggataagtatatccaccctcctgcctccctgcagaccctgggttacccaagctctttgggtggtcccctgggagtggtactttttttcttttctaaatcaaactaaatgtgactctgtgtccctttacctggaggatgtgcaggagcagtcattgccacacttcctttggattctaccaaaatttcagagtgtgtgtggtgccgagaaaacagggagagggcccatcttggttcctgatgggcacaggcatcactgtggctccttttgctacccgagaccattgtcaagtgcttctccccagccctaacctggcactgcagctcctgaagaccagagatgcccatcacagcaggtctgcacagggagccaccccatgctgttgggttccccacactcagtgcccaacctcacagccacgctggaaccagctccccatccccgacttgggccatggacactaccagactcattcctgggaaggaagaatggcccgagtgaggctcctcaccaggtgagccttatagcaaatgtgtaatggaggcagacagttggagttttttctttggagggggcgggatgaggtgaaatccacataacataaaatttgccacttttaaatgaacaactcagtgacaatgagttgtgcaacgatcacctccatccacttccaaacattttcaccactccagaagaatcccttacacattaaacacttaccctaccacctatcctccccctagcccctgacaatcaccaacctctctgtctctatggatttaatcctattccggatatttcattacattggaattgtgccatgtgtggctttttgtgtctggcttctttcacttagcataatgttttttaggttcgtaacggtttttaggtttgtagcatgtgtcagaacttcattcttgtttatgtctaaataacattctattttacagatagaccacacttatgatccattcagccattgatggatacagatggggttttacttgacaaaaacaaacaaacaaaaactgtttctaaagttttttttagtgagccaccaatgttttcatgtcccatgatttcatttagatgtccagtcacacttcaaaaatcagattctggctgggcaaggtgactcacacctgcaatcccagcactttgggaggccgaggtcggccaggactccgagttcaggagtttgagaccaggctggccaacatggtgaaaccccgtctctactaaaaatacaaaaattagctaggcatggtggcaggtgcctgtaatcccacctacttgggaggctgaggcaggagaatagcttgaacctgggaggcagaggttgcagtgagccgagatcacaccactgcactccagcctgggtgacagagcgaggctccatctcaataaacaaagaaataaatataaaataaatcagcttctgcaacctggggcccagggcaatgctgaggagagatgtgcagcagtgaccccttggacaggactggacccagtagctctcccttttcctcctccctggcttgtattcacagtcccctgcctggcccctccgggtaccctacagtcctggccagacccttagaagagaaactcagggcaagggggaaagggccttttcttctctccttgcaaggtcaagacataattaatagagatctccatgaagatcacccagcctcaaagccaccaaagcagcctgtgggtggggacaccatcaagtcagtagcctgtcttcttcaagatagggcctccctgagagcagggactgacattgtggctaggcccggccggaggtcagcagtgccctcatccatccttcttattgtgtcttgtcctccgtcaattcatgcgcaggctgtggctgtacaccagcttccttccacacacacacgaaaacacagccatactcagcatgtcatgatttccttaggtcttgcttgagtttgtggaatgaaacagaaagtccacttcacagggtgagggagtcttccatgccccactcctcccttccttggcagcacctctctttcagttccccgctcctctccactgatcccgtctggaacagtccatgggcttgtctccttcctgcatcaggccaagtatcacatctaccaagcaaaggtgctttctttccccccatgctagtgactgggaaagtaagaatatgtccacatttttaagacaaaatttgctgagtgcacttatttgagagggaagaagggttagaagcacctggaaagtggagtttgcagctcaggtcattattccagctgcaatctctcattctgaagtgaccacattaacccaggtcccaagaaaccaggtgagccttggcaaagggacagggcttccctaggagctcactcttctcctgcagacccagacaggcccctccacgcttccatttattctcttcccttataggacaaggacaacatttaggaaccccagtgagcatcaggcattagctaattagtgatcttcaccagtcagagatgtaatactcagcagtaatcacagactcagagatgcactcattgcagttcagtaagtttcagtttactttttcaataaggacaggaaattgtctgccctacaagggtgggcagcgtttggaagcaagcccacgctgtggagttagggggccttgaaagttcaccaagttctgaaacggtaacttttgaagagtgctcatgtgtctatgatttagtttccaaaaatgcacctagcagggccccaaatggctccttattgcccctgcagaatatagtcccaagatcctcatcctcatcttcctggaaggcagaggggagctgaaagcagtgaggaccacacactacctggtccctggtctctggagtactcacatctgcatctccccaaaaactccacaggagacagaattctccctatgttacttgggaggactggaagcctccaaggtggccagtgacttgcccacagtcttccagctgctatgggccagaatttgtcctgtccctaatgccagctgggggcaactgggccagggttttgttttgcaggcaatatcctccagccacctttgatctgggcataaaaacctgttggtagtatcatcacttttgtgcctcatgttttgaagtctagtgtttgaggggggctctctctctctcttttaggtgaatcccatttggggcccctccagaagatggactgagcctgctcagaactcagcctctgctttctggccccagccccttagaactggagctctgtttggaagaaaaactacatgtccatagagcgaactggtgctggtaattccttaatgaaaaccagaaatacgatgcaaacacccagtgggttaacccattctgggggtggctctgagccagtacttagggctgggtgcataaagaccccccggacagggcttctgccccgccaggcttctatcagaacgtgcagccatcgcagtgccagaggcagaggagcttacgccagcacacaggagaggagacagtgggattcagagccccactgccctccaccccaaccccagcacccattctacaggtgaagtggctcaagtgacctgcctatgtcaccttgctgagactgaagagcagctgcttaaagatgctgggaaataaaaaagaaggaagccagattctttcaacctcaggcagatgtcctcaaaggcagatccaaaactaagaacttgatggcctgagtgactggggtggcagatatcctgatggccctagatccagcccctagtgcagggcctgcacttcataggtccttagtacacggttgctggtggaatgttcaaatgaaagaggccttgaacttttgtggctgagactcttcccagccttcatattaagctccactgtcatctttttctttccagattccccagctcccctgggggcagccctccgccctaagagaaactgagaagtgcatgagtcagcacattcattctctgcctcacctcgcctgcctgcctgcctgcctgcctgcctgcctgcctgggatcagaattagccaacacccattccaaacacactggttacaccatccacctccacccagctctgcctgcaagggtggcacctgttttgccacaccctctctgcagctttaaacctcccacggaagcacagaaacagattaacctggcccactggaagcacctccaactctcaggagtcagataagtgaggactggtttttacggtgcttacttctgaaacgactggaggctgctgtttacaataagaaacaaagaaacaatccactctcaaggcctggaatggaagaacagtaacaatgtaatgaagtccatgcatgtgcctttgcttggcagcaggcaagaattccttgtgtcaggaatcctgatttaaaccaggctgggtgggttaagcctgtaatcccagcactctgggaggcccaggcgtgagggtagcttgaggccaagagttggagaccagcctggtcaacatagcaagaccttgtctctacagaaactaaaaaaatgaggcaggcatgttggtgtgttcctgtagtcccagctacctggaatgctgaggtgggaagatcttttgagaccaggaattcgaggttgcagggggctatgatcatgccgctgcactccaggctgggtgacagagcaagaccccttctcaaccaataaaaaaaaaaaaaaagaaagaaagataaagaaaagaagtcctgatttagaaagaatactataatttacacaaaatcttgtactgagcctcctaggaagcaagggggaaaatggtttatgctgctctctttatcagatgttaaaaagcataccataccttctcaggcaccaaaactcttagcaatttttttctaacctagagaagggcttcaaaaaataagtgtgaggccgggtgcggtggctcgtgcctgtaatcccggcactttgggaggtcaaggcgggcggatcacctgaggtcaggagttggagaccagcctggccaacatggtgaaaccctgtctctactaaaaaatacaaaaattagctgggcgtggtggtgcacgcctgtaatcctggctactagggaggctgaagcacgagaattgcttgaacccaggaggcagagattgcggtgagtagagatggcaccactgcactccagcctgggcgacataatgagactctgtcaaaaaaaaaaaaaaaaggtggagggaagaagggaaagcaaacttactcctagccttgataccttcactactaaacactaatcaattatcagctggggagagcatcaaataagcatgggcactggcatccatggaaagttttacaacatatgcagagttattttccctgtgatggtttcagaatcacctgtgaagcctgcaaaaatgcaaattgctgatcccatccccagacccacagaaatggaatctctcaggggatagaccctggaagctgcatttcctttgtattccccacggaattcttgggcatcctaaagttagagaactgttccagaacttctttacgcttgaaagggaagctgcatttcaacttggaccctgggagagtagctcccctttccctcactactgtgactttgagcagccaaagaggatcccactcccaggaccacgccagctctaatgaaactagatgtttgtaaatcaagcctgcccacattgcaaacgttcaccccaccccgccccgccccaccccgccatccccactgtgttagtcccagtcctctgagaaacagagattaagaaaggattaaacaggaaaagattttgttggaggaaatgcatatatgacagaaagtaagaaggagcagaccaggctacagtgtgagtctgaccccaaagagggtcaccaaatttgtcaaatagccaggataatcaggtaaatatgaatttcagataaacaacaaataatctttttagtataagaatatcccatgcaatgtttgagccatacttacacgaataattctttgtttatctagtattcagattttcctgggcgtcctgtgttgcatctggcaaccctgactcccagtgaaggagaaaggcaggctgagtaggagcaccctggactgctgtgccgtctaggggaggttcagtaaagtcatcggggaatccttgagccaaaggtaggggaggaatcccccagcttccaggctcgggccagctttagtatccctgctgcactccgtcttgacgtcagcacaagccaggggatggattctagagccaggggggccctgggccagctgtactgccgtaactggaggcctgcgaggcaaaccctcatgccaccacaccccaatgcaaagcccagagtggcagaaggctcggcagaggctgccagtggtcacctgtgttctagcctcagcttgacctccttgaaactaggtcaggaaaaaccacctctcccccagttttcccagctggctcacagataccctagagagataaatgaggtgatgagactaagtacttcttggtcctcagatcaaaggttctgtatgctgagcgctggatgagtctttcatggggactggatcttctggtcagagacactctgcctcacccctacagagacacctccaactctacttggtggatgtggccaattgaacctcttttccacaaatgtgaacttctgagacaccaagtcccacaggtctcagagcatctctcacccatccctggaaatggaactgagatgcttgaagaagccgagaggagatttggagggcagaactggccaggagttccaggcctgggcaagaggtgtgcagcatgagagtaggggagcgtccccttgagtggcagaatgacacaggggtccttaatcagcagcactcctgaggccatctgcaagccggggaacagctgtatagactgtggggttttaaaacaaacccttaatttgtctgatacatctcgctttatacagtgggacgaattccccttgccttaagtgtgggtgtccttagtgacttgcttctaactaataaaatgtgcagaagaggtggtgtgtgatgtcaagattgggacatacaaggcattttggcttcctacttgctgtctctcttgggcttcttgctctgggggaagccagctgccaaatcatgggcataatcaagcagccctaggaacaacacagtggcaaggaaccgaagcctccagtcatgaggggtgtgagtgatctgcttggtattcgatcctccagccccggttgagcctttagatgactgcatccctggctgataacttgactacaacttcacgagagaccctgagccagaaccactcggctaagctgcttctgaattcctgacccactgaaactgcgggatagtaaatgtttgttgtttaatgccactacagtttggagtaatttgttatgcatcaatagataacaaatacaagcattgcagttacacattcaaatcccagctccactcacctgctcatgtccttgggcaaggtacctaacccctctgagcatcagttccctctggctgccccccaacagcagccagaagacactgtctgatcctcatatcctggagagaactccaacctggcctcaaatacagccaactagggtgccctgcgggcagggggcccttccaaggccagccagttatcttggggagagaaactaggtcatgttttcttccaaacatcttctgtcttacacctgatgaaggctttcaaatgtaaacgtcaagattttgtcaactttattctctggcaaagtcatgagtcctggtcccagccacctgggcttggcgaaggaccttagaatacaagtgtggaaattcaagttcatgcagatctcttccaacccctttcacagctgtgtggtccctccccagcttctttgtgtttgctccttgggaccgacccctccaagacctgggcaccacagccactgggcccttgtggagagtctgggagttttacatccccgctccacccccagcagcctgtggccaataactgactgctgtcagggacaaacaccagctcctgtgccttcaggcaagacaaacccagagctccccagggacctggctgaggctgtcccttctgaaaccttcccctggccaggcttctcccccttacctcacttgctttctccactccctcccttactgggctgtcctgggaagactcccttaataaattgctggcacccagccaggctcttgcctataatcccagcattttggaaggccaaggtaagcagttcgcttgaagtcaggagttcaagacccgcttgggcaacatggtgaaaccccatctgtatttaaaatacaaagattagccagggatggtggcacatgcctgttatcccagctactcgggaagtgtggcacaagaattgcttcaaccaaggaggtggaggctgctgagatggtgccaatgcactgcagcctgggtgacagagtgagaccctgtctcaaaaaaaaaaaattgctgtcacccaaattcttgacctaggttctgggggaatctgtcctgagactgggggagcacaccggttagtacctccagggtgttatgccaagagttatcattataggacacgtgatattgagtggggctgtgcccgctgcctttagagccagctgtcaaaaaagagtattgtgtgtgccaagttacaattggaaaaactgagaaattgtaccttcagtaggtggttaagagatcagtccaagcctcacaggagaggaaagtgggggagctggggtcctgcctcagattattactccagagccacgctcctggtacacagtgcacctcacggcttcccggatccaggcaggttagaagctgtttgcgcttgtttgtttttttaacccagaaacataaacccacttctctgattaccactgtgaccacagacattccacagaagaggcagccctccatgccaggacctcccgggcagatgctggaggcagtggcgccgcctgctcccttggcagttgggcctggtggtaagaggtgactggtggtgatgctggaacctggacactgttccccaaaggcagggccaagaagagtgctttcaaatgacgccacaagctccagctcgcacactccctggagggtgttctcactagaggcagtgcccctgctgtcagctgtgtggcctctctcacgttttgttctccagtgactctgaacacacagggcagcttcacccctttggtctgtcctcaggctggctcccttgtctgcagtgacttctccacgcttcgtcttgtaaacatttcctagatcatttttcatgtggatggcagtgaggcgtagtgcttaagggcttgggatcagaccctggaatcctgcgtctggggctctatttcaggctctgctgccaaacaaatgtgtgaatgtgggcaaggtattcaacttctccttgttgttcttgtatgtaaaatggagccagagacaccttggaaggctgctaggaggactaaataagataaattagatgttaagcacttagcagacagcctgaaacataaaggacagtgacctatctatctatctatctatctattctcataaaattctatgggtcaggcactgttttgaggtctggagacactggggtagatatgatgtagacagggcacctgagacacagggaaagctctttttttttttttttttttttttgagacggagtcttgctctgtctcccaggctggagtgcagtaatctcggctcactgcaagctctgcctccctggttcacgccattctcctgcctcaacctccccagtagctgggactacagatgcccgctgccacacctggctgattttttgtatttttagtagagacggggtttcaccgtgttagccaagatggtcttgatctcctgacctcgtgatctgcctgcctcagcctcccaaagtgctggaagggaaagctcttaatgttttatgtatatatgtatttttgagacagggtctcactctgtcacccaggctggagtgcagtggcacaatcacagctcactgcagccttgacctcccaagatcaaatgatcctcccacctcagcctcccaagtagttagggctacagggcatgccatcttgcctggctaatttttattatttttttgtagagacagcatctcactatgttgcccaggctggtttcagactcctaggctcaagcagtcctcagcctcccaaagtgctggaattacaggcatgagccactgcacctggcccttaatattttatttttaactgataatgattaacttgtttgtaccttacgtagagtggtagcacgtggctcgcaaggcaacatagtagtgcctggagttaagaactcagactgcttctagctgagaacttcacagggaatgttaggttcaaatcccagctcctccctttccagctgagtaaccttggaacgaatctccaatttacttcccaaggctactggaaagaccaaaaggtagtttgaacaggataaagcaagtgccatacaatcagcagatgttagtgatggacaggggcttcctggagatgaaaaaggtgcgaagaactggctttggtggaatgtcaagcccaggcaggccagaggaagagctgcatttggaggtaaggggccttcccagtgagctggaaaattaagtcctggaggacccagctttgacagtcctgcataaagctgatttggggcttggtcaaagctccatcaatcctgaaggcaagaggccctatggaggaatagagtgaagaattcttgataaaataaagcgtgcattcaggaaaagctgtatctggaactatgccaaacacttacatattttatagcagctcatttacaattacaactctgcaaagcaggagtcattatacccattttatagatgagaaaactgaagctcagaggcattgtaacctgcccagggatgcacacaatccatttatctggcagtggcaggattccagcccagagaagttggttctaaagcccaggatctccccctagggtgcattccccctccctggcagagcttccaggtaacttctgagcaatattcatttttctccgctgcagtctagaccagcaggaaggattgtcataaagtcttggagttgaggtctccagctactagtgtgctgagttttccttcctagcttgagccctgcctcagttgtgcagtatttactgtctgttaagcatcagtgcagagctgctcatcccagctcatgggtatgaaattttcacttcatagaatcatgtacgcctttttgaacactccaacacctagcacggtgtccagtacaacgtagatgttcaatcaatggttgttgaatgaataagcaaaaaatatcaactgtcacttattgcatattacaaatcttcctctcctgtattattattactattattattttacagagtcttgctctgttgcccaggctggagtgcagaggcacaatctcagctcactgcaacctccgtctcccaggttcaagtgattcttctgcctcagcctcccaagtagctgagattacaggtgtgcaccaccacacccacctactttttatatttttagtagagacagggtttctctagattggccaggctgatctcgaactcctgacctcagatgatatgcctgcctcggcctcccaaagtgctgggattataagcatgaaccaccgtgcccggccatctcctgtattatcttatttgaccttaacaacaacctctgaggtaataaatggattcctagcccagctcacagagggtctacatggttcatctatgaagaggattggtggtcattcctctaatcccctaatggagatatttggaagcaaaaccccattattagttccttggctgtagggtgggagctaccatagtagaaagggccaaatggaccccctaccgaccatatcacatccctggaggactggcaatgactagttccactattaaacattctaaaagatggagaggtggtggtccctcacaaaagacaggtcctggaagatgacagtgaactactgcaaacttaaccaagtcgtagcctcagtggctgttgccaaatgtagtatctttgctacagcagattaataaggcctcacatacacagtatgcagccataatctggcaaatgcattttcctttttttttttttttacatttttataagaaaaggggatcagaaacaagtcacatccccttgggataggcagcagtgcacattgctgaccttgcccaagggctgtgttaactcccctgtcctctgttgtaatgtggggacctatctcatgtcgacagacctcagagcatccttgatccactgcactgaggagatcatgtcattggaagagaggatcaagaagtgactagcatgtcagagatgtcaataagacatgcacattccaggggatgggagagaattcctatggggactcaggcacccaccagatcgggcaagtgtttaggagcccgggggtccaaggcattccagaacacccctcctaagtaacgagcacattatggcttcttgtacctctccctaagaaggaagtataatgcctggtcagcttcttcagactcgaaggctgcatatgacacacttgtgaatactgcttggaaccaggtactgatgggcaggcccagagccagcttgagcgggtccctgagcaggaaagagccgtgcagcaggtccaggctgcagtacaaggggcccagccacttgggtttatggaccagcagaccctctggtattagaggtatctgtggtgggaaaagatgttgtttgcagtttgtaacaagtctcaatagaaggatcaatgtagctgactaggattctgcaggaaggccatgccatctgcagtggagaattacatactttctgaaaaacaggacctaggaagttcctgagccctggccatgggacttaaagtgaccacacagctaaaggaagtaagaacatgccaccccaaagtattccactctggcatgtcgactcctttgagtgaaaggcacttgaaaaacagcaagtgcaagaatatcactccaggctccatgctgtttcttaaaagcagatgaagttcccctacgaaagatgccctccccatactagaaggaaagtaacagtgttatcatcaaggatgagaagctgagactgagagaattctgaacaaagctagtgaaaatcacttatcttcttttagcctccccacatagttcagctgcttttttacaactttttattctttgctcaattcagttcataagcgttcaactctaactgtggcttcaggccttcatttccttatgaagactcctgtgccacataaaacttgtatgaaataaatttgtatgcttttctcctactgttccatcttaaatcaacttaattctcaggctcagccaaaacactctaagggagtagaggtgaaatatttcctcccttacacagccaaggctgccatcatgtgctgggttctttcacatctaccaaagcagaaggtcagactcagcaggaagccatcataagatggaagtggcacctccaagattaggtccaagcagggccagagggcacaagtcacctgtacaagcagatggaccagacctcatgtcatctgcacactctggcaccaggaccacccctccttccttcaggccacaccaatgaccatgagttgggggcttgggtggaaggctgcatttggttcacaaataactcagcctaatttgtgggtgagggccaaaaatcgaccacaactccatccaggggcagccctgaaaagcagcagggaaagaaaaccctccccatagaaagagaagtggtcttaaattagaatttacgcaggtgtgcaggcagcagaaaatggctgcgctagttcctcaggggcccagaagagaaaaattggaagaaagagactaaggagggctgggaaagaggcacctggatggaccctcgggaaggggcacagcgtgacctgcaagacaagaggatgggcccacaggaatgggcaccaaatcgtattgcacagcaatgtccaccacagagcacccactacaggaaaggcactgaacagccacatggtcagagtgactttcccagcctccatcactggccacatgggtacatgaacagagtagttaccgcagaacagtgcatgctaccactagctgggttctttcacacgcatcaaggcagaacggatggaggattgcgcatgggctggacaccatagccttccactctccaaggtgatgcagcaactgccactatccagtgtctaacctgacagccccagagaccaacactgaggccgaaatggcaacaacccttagggagccgagccagcctttcagtgactagttcaacatttgaacccttccaccttggaaggagcagcaattcactctgggtggaattgacccatactgtgggcatggattcacctattatgcccacagaccttggccagcacctgcagaatatgtggtctaccaatacaggatcccatgtagcattgagacaaagagacctactttgcaaaggcaagtgaccatgaggtccctggtgataccacgtcctcatcctctagaggccagccggaggtggaatggtcactgaaggtccaggcagccaaagcaccagctggagagggcgctatgtatcctgacactctaagtcaacaggcattgtatggtactgtgcccctaccccctgagaggagtggttcacctggaaatcaaggggtggaagcctgagtcgccccacttaccatcacttccaggacaagatctcttaaccagtttcaatgtcccattcccacagctctgtggtttagagatcttggttcccagaagaggatacacttctaccagtgacactctgaggattccatcaaactcctagctatggctgctttccagtcactttgggctctttgtgcagagagaccagcagggagaagagccaccatcccatcgtgggtaacgggaccctggtcatcaggagaaagcagggttgctgattacacaatgggggcaggcaagaatatgtttggcactcgggtggtccactggggcatcccttggttgtcctgaccccaatttatttttttatttttatttttatttatttatttagagatggagtttcactctgttgcccagtctagagtgcagtggtgcagtcttggctcgctgtaacctctgcctcccaggttcaagcgattctcctgcctcagcctaccgagtagctgggattacaggtgcccaccaccacacctgactaatttttgtatttttgtagagatggggtttcaccatattgcccaggctggtctcaaacttctgacctcaggtgatccacccacctcagcctctcaaagttctgggattacagatatgagccaccacgccctgcctaaggttttgtttttctataactcaacccagcttccactgaagccccattctgctgcagtggtagatgtctcccttggagcagagtccaagtttgggagcatcatttgcaccaaggcctttcaagaaccctccagaagttccatcctcaacacactgaccctttctagcttctagccctcagagaaaaccccacactccccaaggccctccctaaaccctttctctcagccccaaatcttttcagtcaaaagttgtgaaggggagagaggggcaaatgtggcccaggggattcatttgcagcctaaatttttaaattagttatcaacctttacaaattaaggaatttcacatgaaattttgtatttttatgcttttctaaagagatcagtctatccttcaatttcctctggtggcactggctgtcgcgagagggagccacctcctcttgctttagtttttccagtggtccagatctctccactctgccttgctgcctggagccaggggctttggctttgctgccctgagctcccttatgggtgcagggttgtggctttgggaatacaggtttgttagtcacttctttttgctgaggcaaaggttggggagtgagtgacggtgatgagagggaaatgctaagaaagctctttgagctgggtggtgaagactggataggagtgagaaagtaaggcgaaggccgggcacggtggctcacacctgtaatcccagcactttgggaggccaagacgggtggatcacttgaggccaggagtttgaaaccagcctggccaacagggcaaaaccccatctctaccaaaaaattaaaaaatatgccaggcgtgatggtgcatgcctgtaatcccagctgctcgggaggctgaggcgtgagaatcccttcaaaccaagaggcagaagttgcagtgagcagagatcacatcactgcactccagcctgggtgtcatagtgagactctgtctcaaaaaacaaaaaacaaaacaaaacaaaaaaacagaaagtagggagaagcagagagggcgtcccaggcagaggaaaccacctgagcaaaggcctgggggtacccctgctgggagaccgtgagggtacctgtctgattaaacgatgggtttgacattatgctgcagtgggggaaaggctgggtagggaaactggggacagaatgtagacagtaaacttgacctagtcaactcacaagcttgtgggcagctggaggcagaaaatgattgacttctccaaacattttgtgtttctgagtgacttaatgggaaggaagtgggttcattccaatctatcttctgcacccagatctgtaccaatccagaaggcaacttgacccaaccagcaattttgcctaatattctgttcagggctctatgttaggtacaaagaagaggcgtacaacaaaggccaacagtgggggttgaagacctgtctgcaacattcctcctaggaaatggtagagtctcattccccttcccttgactatgagtcccttttagtgactcgattctaaccaatgaaacacaggggagtgacattgtgtgacttctgaggctaggtcataagagaaaatacagcttcctcctgtctgatgtgttctctctctcttcctttctctctcttggagcccagccaccatgctgtgaagaagcccaggccataaagggaggaacactcgtgggtgttccagccagcagtgccagctaaggtcccagctggcagccagcaccagtcaccagccattagtgagcaagcctcggaagattcctgccccagccttctggctgccctagctgataccacagaggcaagcaaaataaagcccctaggttttggaatgtttattatgcagcatgaagtaactggagcacaaatacacagagccaggctctaacccagcccgggacaactgggaaccaagcacggtatatggaacatcctaaacattcctcagctgacaggtgtatattccgctgttttcagatggaacaaaatcagttctgagctgtggcaccgagctgtagacccacatataaacgatgtgccatccaggtgggggaaatgaaggaaggcctcagaggggaagccgttttgaccacactgtggaggatgaggaagacaatttcaagagaaaagggcaatgcaaatcacagacactgtgagctggacactgtggcctcagggcgctctggtcaatccctgcatcctctgttaaagattggcagtactgacccctgcactcaggcttcctatgtcctactgggcatgtcccctcttcaggtcacctagaggctgccctcagctctcctctccctgacctttagggtaggagggatttgacagaatttgatgttcgtccaccagaggtggtctgttgactgttgagtgatttccacagaactgtgtattttgcattccttatctttccattccccacctagacccctgcaaggccccgcaatttcttttcacccactcactgcttcgttagtgctggagttagtcagatctcatcagtccctcctcgatggctccttccctcttgttccactgctgacaaaggggcttgctctccaccagccttccctgttggactctgtgctttggaaccaagtaattgttccattactcattacgttttacagttataaatgcaagacaagtccattacagaaaatgctgaatcaagaaaagaaactacacacaatctcatcaccctgccccgccatcaataaccattcatctcgtcttctttgaggatttttttttcaacacctatagcgtttttaaaatcctgttatagccgggcacggtggctcacacctgtaatcccagcactttgggaggccgaggcaggcagatcacctgaggtcaggagttcgagaccagcctggccaacatggcaaaaccccatctctactaaaaatacaaaaaccagacatggtggcttacccctctaatcccagctactcgggaggctgagacaggagaattacttgaacccaggaggcagaggttgcagtgagcctacatggcgccactgcactccagcttgggtgacagagcaaggctccatctcaaaaaaataaaaaataaaaataaataaaaataaacaaaccctcttatcatactgcacattcaattgtgaatgctgagttttgtctttggtgtcacagtgcatgctttttgtcatcattttctttcctaatgaatacgtagtggtgtcaagtggctgaacctcgttttctttaactatttttacagtgtttggcatctacgtggtttccagtttttccctgcagtaaacatctccctgcctagggctttttctgaaagctgaactacttcctcaggacagattcctaagagaaatgactgggtcagaagttgtgggtatattaatggctctggatatagaccacttgtcaaattatctcagcgacttgtttctttgaactgtgatcttgtagttaatgctgttgttgttctggaagtattagatgaccactggagaaaatttggaaacgttgagagaagtgaataaaaatcaatctcatttcacccataaaatgataatcattatcagtaacatgttggtgtcttcctctccagtctatttttcttcatgtaagttttagggtttttttttttgtttcagtgcctatatgaattagcataattatcatggcactctaaataaattagacttcataatttttcttgaacataacagctaagcattttccactttattgcaaacttcaaacagtttaagatattttccactgagtagatgtatcctcatttactttcccattatcctatttggggacacttacactgattccaaatttttgctcttaaaaacatttgccaggaataaatcttcaagttctgacttaaaaagcagtttgtaagttgggtaaacagaaaaatgatgaaaacttacaatagaagagttgactaattggtcttgattgtggaaaaggctaatttctaagctccttcctagattcatgaatggaatttaaataactaagctttttttttgttcgtttacaatcaaagcaaacccaatgaagattactgattgggagcccagacacctggttttctggtggtttttccctcggacaagtcacaggcctggcctcttgtgacttagtcaaatgcacagtcagactaaacggtggcggcaccggcgctgcagggctcccggctgtttccttttaccaacccacaccgttgtcaagggcggcgccttcgttaagcattcctcagtcaccgcggtgaagttgccatttgcttcctgcctgactctgactcacacagcagcctggggcacaagtcctaccatctgtgggcctgggccggctggcggcacaaagaggagcagaaagtgtgcctcgatgcgcaggacatgaaaaacaagtgatgccgcttcctgtgtgcagacatggaaagataaggaagaggcttatgatgttggaaaagaaaacaacagcggcaacagaaaccaaacctgagggcaagacaaacagtatatgctatcgtttgtataaaaataaaatagagagccagatatgcacataccacccccggtccccccaaaataaagagctcaatggcagtgaagggctatatagtcaccactggcaactgcagaatggatgcttattgttcctcagaaaattactgtatttcctgcgtgactcagagttctgttcactgcattggtcggttgaaaagtgacataggcttgggtggaaggagtgaagccagttccccaaacacttccttggtacccaggctgacctgtggtggagacatcctcccccaacacctgtgcccattccaatggcagacaggcagtcagatgcaggcacactgagaaatgcaattaggagagagaaggaaggagagggagagaagggagacaaggggtgcagctagagagggaacagagtgagaaaaagaaagaaactttggccatcttttgaacaaccatgacaatcttgaggagttttggtggtgcttcatttaggatgagcttttaatggtcctattctctaaaggcagcctccttctcaggatgtccttaccctgagcagctcagaaaatcaagggctgctgcagcctggcagccttttgctggggactggtcctgcctggaatgggtcttgagaccctgggttggcctgacctccagtcctagccctgttcttccagtacagtaacaagtgaccttggcccatgatcatggctggccaccgcccagcctctgggaaggcctcagcccaggagcccccatctgctcacccactgaaatgggcctctcccgctccccagtgaggccttggagcagagccactgagaaccctgaggccctaggagagaagagaagaattaacagggtcagttgtttccagatgtctcttacttatgtcaggattaatctttttactacagagccattaaactggacagaacacatggagaaaatgcatataaagcagatgtcctggataacaaggagaggaggtaagaaccacgaggagaacatggagtggacagaaagcactgcccaaggatgacacacatgacaggaggaagcagggaccctgaaggccagccaggctcctgaggcttcaactctaccgcttcagaatcttctgccagcaacttgacactagttccctgtattagtctgttctcatactgctataaagacatacctgagactgggtaatttataaagaaaagaggtttaattagctcatggttctgcaggctgtacaggcttcttcttgtggggaggcctcaggaaacttacaatcatggtggaaggtgaaggggaagcaagcacattttacatggctggcaggagaaagagaaaaaaagaaagtgctacacacttttaaacaaccagatccccagataacgctagcacaaggcagcgctagggggatggtgctaaaccattagaaaccgccccagtgatccaatcacctcccaccaggcccctcctccaacactgggaattacaatttgacatgagattttggtggggaaacaattccaagccatattattgcccactcaaaaggctgggctgcctgcagggcactcccttccttgcttcctccttcccatcttccgactggggtcagtaaaactgagtagcaagccaaggctggcctgaccacagaccctgatttgctatgggaaatttctcttctgatcacctacctactgcttcctgccaccgttagggactgagctagtcagtgtctgcaagtctttttttgttcctgaaaagtgactcaggatacaggaaacagagataaaaatattgtgttaggccgggcgcggtggctcgtgcctgtattcccagcaatttgggaggctgaggcgggtggatcacctgaggtcaggagttagagaccagcctggccaacctggtgaaacccccccatactaaaaatacaaaacttagccaggcatggtggtaagcgcctataattctagctactcaggaggctgaggcacgagaatagcttgaacccgggaagcggaggttgccgtcagccaagatcacaccactgcactctggcctgggtgacagagcaagactctgtctcaaaaaaaaaaaaaaaaaatgtgttcataataatagcaagtgcttccaagcactcactgagtgccaggcactatgctccattatttggtcctatttggtccttataatgaccctatcaggtagatgcagttatatatctccagtttatatgtaaggaaacaggctcatagagggtaaagatcaaacagtaggctagatttgaaggcaggtggtcttcgactgtgtacccttagaacagtaacacatctcattactaacacagctgattggaggacatggcttagatcggtcgccagtggggcttgctgatacatcactcttgaatgagactatcttagccactcacgcttggcagcaccagaagctgtggggagtggagccctgaagcgcatttcacagaggagcagaggacacctgcaccccaaagagagaaaagccaccaacctctgagcagagcatgctgcagcacccaaagtgtctgggggcaagggtgatgctccagcactgtgggatctcacccttgcctgcatgttagtaacctgagaagttttcagttacttccaatgcccagcctccctgttgtcctccccttccccagtgaaatcccatccctgggtcccatatggacccaggcatccatatttttgaaactccaggtaattccaataggtggctaaggttgagaactacttctgggaaggaatgtccttatgggacagtaggtccaagggaatggttttttcttttttacattaatattgggatgtgggagtgggatgaataacagctgtaagaccctgtcagtctctcacacttcggtgtggattaattttggtcttgattcccctcatgacgggtgagatccaggcaccaaagcaatgtgagtgtttatagcagagaagggaagggtgtgtatggctcaagagggccagccccagagaggaccagctctggtgggagatacagtgggccagggaacagaggccttagagagagaacttgaagatggacaaacatcatgtgcttcctggcttgctccagagttggccccaactggctgtgagtttctgcagctcagagtcagcgtcttagaataggccagcgtggtctcgggtgacagtcacccagcatctgttgcaaacttttcacagcgcaggagatgattctccccaccccaagtacctctttggacaaatagctcttccttgaactaagctaaaagtcctcttcctgtgacatccaacccatgcccagagttctgctctgtagagatacaaacaagaattccagtcctggctcaagagaatggcccttcagacactggaacccatccccacctctctcagagcctgctctttcctaattgccttcatgctgcctaaatcacctgtttcaggctttcaaaggaatctttacggcttctccaaggatggccatgatgctgccatgtacaggtgaagtctgtgtcctctggccccgattgtagggttctgcctgtaccctgcaagtattctcttgaatcttcagtacaatactgcaaaacagacactctgatgaacattttatagataagggaactgaaactcagagctgcaaagtaacttgtgcaaagtcacaaagcaggtcgttggcagattcagacccaggcctacccgatgccaagactcacatccatcttagtaaacctcccctgtcagtccctgctggggaacagcacaccgcagcaagtgctctgagcatcacacgagcagtggagcctcccctggcctggagacccttcttgacttctaagcaaagatgagactggtttggcctaccccatccgaccccaggagtcccaaacagacaaatgctcccagaaaaaactacccctgtcactgatgaagttcaccccatctctctcatagcccttagaggtggtatgagttttcctcccaaacactttcttgtttatgctattttctttcttggcacttttcttgggactagccttggacccttcaaatatattttattacttgaaaaattcaggccaggcgcagtagcttacgcctgtaattccagcactttgggaggccgaggcgggcagatcacctgaggtcaggagttcgagacaagcctggccaacatagcaaaagcccgtctctactaaaaatacaaaaattagccaggtgtggccatgcatgcctgtaatcccagctatttgggaggctaaggctggagaatcgcttgagcccaggaggcggaggtgacagtgagctgagatcaagatcacaccactgcactccagcctgggggacagagcaagactctgtctccaaacaaaacaaaacaaaacaaaacaaaacaaaaaaattcaaacgacagcccaaaaaaagaaaaaacaaagcagtagaggagccaaggaagaaatatcccctttgctctctgaagttttgcaaaaaagtgaactcacagcaggtggattaacaagagaaaaagcatagaaatgtattagggtgcaaggtggaggttgggaatcacagagtgattacccagaccccacaatgggatgcagaagtgtatagattctgcatcccattgcagaatctgtatagaatctgtatagtgtatagattctgcatcttgagattatagaaagaatggtggctctagttgcatcaatgcaaattttctctacggatgcaaatctccaccacaaacgacagctttgtagggctacttctgttttcagaccctctgaacagccatctcaaaatatgtcaaagaagtatattgtggggtgaaatattttgatttccctcagtagcctataaagtgatgaaaatgttctggaattagatagtggtcattgatgaacaaccttgtgaacatactaaaaatcactgagtcgtacacttcaaaagagcggacttcgtggcatgtgaattcaatctcaaaagagctgtcagctttattttttaaaacagcccattaaagcacatcttcttaatggagtggagtgaatttggaaagttctggaaagaatgaatataagacttgtgccaatcccttaaatactgttagaccatggacaggtccggtttgcataaatggactataactttcacccattactaaaggtatgttaaggtcattgtctaaagcagaggaggccaggcagcaagctctgtgaatgtgggcttctcactacgctgaagaatacctcggaagaaggccatgcagtagggagagagagatgaggcttcaggagctgacagctgggtttcttaatacagagtactcttatcactggctcaaaagaatatccacaggtgaaccatgaataccctatccatctcaaataccatcgacgtaccttataccgctgttgcaagtacctctagggaagaaaaaaacacacactgtgtcctttttttttttttttctctgttgcccaggctggagtgcaatggcatgatttcagctcactccaacctccacctcccaggttcaagagattctcctgcctcagcctccctagtagctgggattacaggtgtacgccaccaggcccagttactttttatatttttagtagagatgaggtttcaccatgttggccaggctggtctcgaactcctgacctcaagtgatcaccccgccttggcctcccaaagtgctgggattacaggcatgagccactgcacctggccactgtgttcttttctgaacagctataacatgcatccaaatttcagaaatgttcaaatgtgagaggaagaaagtgtccctgaatcaatacaatgtggcaaaaggcttcaaggtgaaatgcatttgggaaatctttgagtttgacaagcctccttaacaaaggacttgtcagagcattcaatacgctcacatgcactatgagaagagggagcaaggaatgacctgttctctgcatgcatttccacagacctctttctaccagagcatcccagcaagaacacattctgtagagtcagctgggaagaagctgatttaagaaacaggggtgcatacaggggactgagcccaaaacctgggagcatttaaatctgaagagagaaacaccaagacacattggaagaaagacctcagaaggtagacctttggtgggaactaaggcgagggcaagggcaggaagggaagaagagatggagaaaaacacaggattctgattcaaagagaaactcaaactccaccctcaaggagagggagcgcaactctccaaaatctaagatggccagttgggtgtgtttattactcaagcggaaaagaaacaaaaagcccactgacatagcagtagatttcaatttggccaagaacagctatagaaatgtaataaggatgaggagaatcaaattattattttaagaaaaagggattggtttgggttttcaaatatgcattccaactagaccttgttcctggtaaatgctcaataaatatacatattgattaactgctggcttcattccaacaacaaatatttttgaaataccatgtaagcactgagctacattctttgggaaggtcacccagataaataaaatggggttcttgccacccacataaccagaaacctgtatttcattgattctaagatgcacattttaaaaacttttttttttcaggtggagtctctgtctgtcacccaggctggagtgcagtagcatgatctcagctcactgcaagatccgcctcccaggttcaagcttttctccttcctcagcctcccaggtagctgggattacaggtgcccgccaccacgccagactaaattttttgtatttttagtagagacggggattcaccatgttggccagtctggtcttgaactcctggcctcaggtgatccgctcaccttggcctcccaaagtgctgggattacaggtgtgagccactgcgcccagcctaaaaacttgtaacatctccgaaattgggcagcctttcacagttgggcatctctgacgtggttgttatgatagtgtgtgccaacatttggccataactattcatattggcatcatcttcaattgaagtatgtgcatggttggttctacagctatggagcttaattaccatttaaagtatcatcagcttttttcttccctggctgtctgagattagaccgccatcatgaacgacacggtagctatctgcactagaaagttcatgaccaaccgactacttagaggaaacaaatggtcattgatgtcattcaccccgggaaggcaacagtgcctaaggcagaaatttgggaaaaactagccaaaatgtacaataccacactggatgtcatctttgtatttggattcagaactcattttggtggtggcaagacaactggctttggcatgatttatgattccctggattatgcaaagaaaaatgaacccaaacatagacttgcaagacttggcctgtatgagaagaaaaatacctcaagaaagcaatgaaaggaacgcaagaacagaatgaagaaagtcagggggactgcaaaggccaatgttggtgccggcaaaaaagccaaaggagtaaaggtgctgcaatgatgttctctgtggctgttgtggatttttcacaagaagattaataaaccataaattttcatgtgaaaaaaaatcattgaacaattgctattattaaaaagtcaaaaataatagatgctggtgagattgcagagaaaagggaacacttatacactgctggtgggaatgtaaattagttcagccacagtgaaaagtactgatgttttctcagagaatttaaaatagaaccaccatttgacccagcaatcccactattgggtatatacccagaggaatataaatcattctactgtaaagacacatgcacacgtatgttcactgcagcactcttaacaatagcaaagccatagaatcaacctagatgtccatcaatggtgaactaaataaagaaaatatggtacatatacaccacagaatactatgcagccataataaagaatgaaatcatgtcctttgcagcaacatggatggaactggaggccattaccctaagtgaattaacacaggaacagaaaaccaaatccacgtgttctcacttataagtgggagctaagcattgagtacacgtggacacaaagaagggaacaaccaataccagggcctacttgagggtgaagaatgggaggagggtgggattgaaaaactatcaggcattatgccaattacctaggtgacaaaattatctgtacaccaaacccccatgacatgcaatttacccatgtaacaaacctgcacatgtaccccttgaacctaaaataaaataccatcaaaaagattgtaacccgattcaatgtggaaactaaaagttggtgtgggtacagcaaagcatggaaatgcagcagtggggcagatatttaataggagagtagcaaatatttctcactaaaggaatggctgcaattctatactttcttgcaaagctataaccaagtgcttaggggacttaggcaagaatgctgaagacacagaattagaataagctgtcttgtcacagagaagcgtgcaaaagaacagaccacacaccaagcaatgcaaggaaggacaggagaaactactcaatccatggggtagatgaaggaagggccaaagtcatgcaataaaagctggtgtgacccaagcccatgctgcacaggctgcccatgtcagcacaccagacctccatcagcagaggcttcccactgatgttgatttgacttccagaaaatgagattcaattgagggaaaaataaaactatgagtttagttaaaaaggaaaatggtaactcacccttggtattcttcagtttgcctcaaaattatactgacagtgtaagaaagcgttgtattgtagattaatttgcagtgtttttttcgttcttaattgtacataaaataacggtgttctttaccatggcagtaactttgatttgctgaagatactatgtgcaatgggggtagaaaatgagttgtcttcacttaggaaagtactttgataaggttaagtcctgagggaacctaaaggtgttattagaatcaaagcaatacactgagaatcaatagctgctaacttcacaaaaagagacaccaggagcctcctgacagaagtccacaactctactcatgaattgttcctgctgaaggaataaaacaggaaggagatcaggcctccagctccaaataccagcttacaggaaatacagagggcaagggaagatgtaaaatgacattagactgcaggacacagtacgagacaaatgaatgacctgatttcctcaacaagtaaatttcaaaaaaaaaaaaaaatagaaagagaaggttcccctctatacagactttattttataaattaaaatagatttacagacatatcatggacttagtgacgcacttccaaagaacagagtatggaaaggtgaaatttagtaacttaacagtggagaaacctagcagacacaaccttaaccaagtgatgaaggttaacatcaccagagatgctgtggggacatcatgtacccctgatgcactatgacaagaagggcacatcacgtctgtgaaattcttcccaaatagtccccccttttttttttttttttgagatagagtctcgctctgtcacccaggctggagtgcagtggtgtaatcttggctcgctgcaacctccacatcccaggttcaagcaattattgtgccttagcctcccaagtagctgggattacaggcatgcgccaccatacctggctaacttttgtatttttagtacagatggggttttgccatgttggccaggctggtctcaaactcctgacctcaagtgatccacccaccttagcctcccaaagtgctgggattacaagcgtgagccaccatgcctggccttcccaaagtgtcttaatcccagctaatcatgacaaaaatattggacaaacccatattgagggaaactctgcaaaatacctgaccacgacgcctcaaaattttcaagatcatgaaaaacaaaacctgaggacctgtcaccgatgggaggagtctgagacacaataactaaatgcagtgtggggtcctggatgggatcttgaaacagaaagaggacattcatagaaaaaggagtgaaatttgaataaagtctggagtttgctcatagtaaagtgctgataatattttcttagttttgacaaatatacagtaatatgcaagatattgacattagaactagctagcgaacgagtgcatgagcgttctctgtagtacctttgcagtttttctgtaaatatgacaccaaaattaagtttatttttttagaaagacataccaaccaattgtaatataggaactttatttggattctgattcaaacaatgaaacttttatttatttatttatttatttatttatttatttatttatctatttatcttttgagacagagtcttgctctgtcacccaggctggagagcagtggtgcgttctcagctcactgcagcctccacctcctggggttcaagcgatcctcccacctcagcttccctagtagctgggaccacaggcacacactaccacccctgcctactttttgtatttagtagagacagggtttaccatgtcgcccaagttggtcttgaactcctgagttcaaacgatcctcctgcctcagcatcccaaagtgctggcattacagtcatgagccaccatgcctggcctaaaatattttaaaaataacattgataagacaattggaaacctcacagtgactggacattaaatgtgattaaggagtcatgattcattcatttgtaggtgtgacaatggcattgtagttatgctttttaaaaagagtacatatgaggttcctcgaagcattaagcatggaattatcatatgatccagcaattctactctgggtatatacacaaaagaactgaaaacggcatcttgaagagatatttgtacaaccatggttcagagcagcattactcacaataactaaagggtagaaacaatccaagtgtccactgatggataaatggataaacaaattgtggtgtgtatgtgtatctacacaatggaatattattcagctttaggaaggaaggaaattgtgacatgcgacaacatggatggatctggaggaccttatgctaagtgaagtaagccagtctcaaatggacaaatatacaattccatttactacctagaataggcaaattcatagagacagaaagtagaggctgggcgcagcggctcacccctgtaatcccagcactttgggaggccaaggtgggtggatcatgaggtcaggagattgagactatccaggctaacacggtgaaaccccatctctactaaaaatataaaaaattagccggccatggtggcaggcgcctgtagtcccagctactctggaggctgaggcaggagaatggcatgaacccgggaggcagagcttgcagtgagccgagatcgcaccactgcactccagcctgggaaacagagcgagactccatttcaaaaaaaaaaaaaaagaaagtagagtggtggatgacaggggctggagggaagcaaggaaggggagttatagtttaatggttgcagagtttcagttcgggaagaagggaaagctctggagatggatggtggtgacagctgcaagacaatatgaatgtactaatgccactaaactgcacacttaaaaatggttaaaatggcaaatgttatgttatatacatattctaccacaatttttaaaaagggggtcaggcacacacctggctaatttttaaaatttatttgtagagacaggatctcactatgttgcccaggctggtctcaaattcctaacatcaagctatcctcctgcctcagcctcccaaagtgctaggattataggcacaagccagagcattcagccaggaaccaagatttttcagaaaggaaagctcatgaactattggatggacacctggcttctgctctgaaggtcacctgctatttgactcaactgtgtcaccctttccaggcctgcgtccatcagggagatgtcaaccagatgagctccaagtcctcctgctcaacaatgatgtgactcaattccctctccagggggaggaaaatccctgagagcacgactaaagctcttttcctcccagatttcaaggaaacacacagaaaagaaagaagcaaggctggcaagcagaggcctgacatggggatggatcatatccgagggtgatgcagactccagggatgggcagggtatggctctctctaccctgtgggcaagtgacttactgagagctggttgcacaagcttaagaaaggagtagacatctatactcttcctctctttttgcccctgggcatttcaacttgatatcttagatggtacagtttgaggaggtgatggtgcatggatcccaggcctctggtcgctttggggtgacctcagaaggtgctcagctacctgctgccgagttcctgagtcatgcagaactgagttcattcagactccatccgtggcggcatgactagctgctctgcaaggattgttgttatttgtcttactcattctaagactgaaattataccaagtggttaacgttgggcaaattacttggcaaagtcagtcattcccaaggaacttctatctcatcctgagacaatggcaaactcttctgttttgaggctcacaaagaagctctgctcaaactgtgaatgggaagttttctccctcaaacagtagttgacattgacagtgacactaagagctatttgtgcactgaaagaatctcaactttattaacttgcttaatcaccggaaaggaaagtttcggagaagttacctgatttggacagatgttctgtccatcctctgttcaaactggataaagtcctggcccaccggactctggcccatcctacaaggcaagggaggctgctagacacccaacatggccacaatgactgcattcgaccaggggccctaccccctctttaaaatgagctgtgcattcatcttttcagggtcacaagtttcaaagagctccctgggctcagtggcccagttggtggggtaatccacacatccttggctaatgagttcattcattccccaactatttgttaagcatttactcaatccttatcttcagctccagaaatataaagatgaataaaacagacacagcttcctgccttgaggagctgacactttcagatttgaatgagactatgaagaaatttgtctgtagcattctctttccagaactctgcactccacttccatagcttacctccccaccaagctaatacccactcctttcatcccttgctcacaacacaggcaatctcagctaactttactgtgcatttactatgtgccaagcactgtgctaaatgtgttacatatattacctcattaatctttacaacacccgattcatggacccagttcatggatgaggaaagtgaggcacatgtaggtgaaaggagttggcacaagccagtaaagttgcagaggcagtatttgtatttgtttttgtttttgtttgagatggagtctcgctttgtcacccaggctggagtgcagtggtgcaatctcagctcaccacaacctccacctcccgggtttaggtgattctcctgcctcatcctcctgagtagctgggactacaggatcataccaccatgcctggctaatttttgtatttttagtagagacggggtttcaccgtgttggccaggctggtcttgaactcctgatcttaggtgatctgcttgcctcagcctcccaaattgctgggattacaggcgtgagccaccgcacccggcaagagacagtatttgaatccaggacatctgactgcagaatgcacattcatagtcgctgagccattccatcttacccacttaggtcaagtcctttatttgcagtgaatcacatgggtttgctctcccttccattttccatagcagcagaaaaatctcctaagcctgccttaggatggggttcaggcacaagtgactggaagcttaaaaaagagacgtttattcttctttcatgtaaaaagctaggtaggtatccagggctggtgcaggctccttctctgtgcttgttcaggtgtacgtggctcaagggcatttgcagagcacaggtttgtgtcgggggcggggggggggtggtcttaaccaagcaccattattatttgagaatctcatcactaaaagcaatggctccatttgatttaactccgcccatctgttcactcaggagagaagggtggctacggaattcagggcccagtgtagttggccatgtgtttatggcttgactcagtctggatgctgggctctctaagtctggggcacatcaccctgggagttccttgactctcccttgggctgtatctgtacttcatatatctagaggcaagtacacaaagaagctaagaaagctccagtgtgcttccctggtcataggtctttgtcaaatttgcaaaggcacgtattctgactgccaaaaaaagccttccctccactttctttccatcaaacttccccttatacaatgtagcattgattggctgtgggcattttgggatcaggctaaagggatgttaactcagacatacatttattataattggggtctggtgggatatatttatttgattcatggtcacattcatgtatagttaagccattgcttgttctcacattgtagtaatggcttctaggaatactcctcccatccactgggctgactcacaaggtaaggtgaccagaaggagcaaggccagaggtgatattacattatgaacctgtgctacagtgtccaacacccagagtatgtgcacagtggaggaggaggaataaagtgaaatgtacagatccggaagaagctagtctgtggaaaatttttccaattatcaaagctaaaattttaagcagaacatgcaactcatcatggcttatcaaaaatgatgggcttttttttctgtcagaaacaaattggtaatcagcagtataattttgaatgcactatactattttgatctttatatttaataggaatcacacaaatggaatttataggaatttctgtatttgtagggcacaaaactataatggttctatggacagtgagtatttctgcatgtgaattcacaggtcttacggatctcaacatatcagttgcatcttatctgatgcatcttgcaaaatgacctggagaatgacttagagttgaaccagacaattaacagtaaaaatactatgttattttttctggattttggaacatttgtgatatttttccatttgtaattcattgagatttctttcctcagtctaaacacagtaatcgttttcacacctgattttcttttcttttctttctctctctctctcttttttttttttttttttttttttagacaggagtcttgccccgtcacccgggctggagtgcaatggtgcgatatcagttcactgcaacctccgcctcccgggttcaagccattctcctgcctcagcctcccaagtagctaggattacaggcatgtgccaccatgcctggctaatttttgtagttttagtagagacagggtttcactatgttggccaggctggtctcgaactcctgacctcaggtgatccgtccacccctgcctcccaaagtgctgggattacaggtatgagccaccatgcctggccccacacttgattttctatttgcaactttgtattatttttcttaaggtgattatgtttaccccccacaaacctgtatccactcctccctgtgttgtaggcattttttgttttaatgcaacacatcttccagtattttcttgagaagaggtatgtaggaggtttggaggttttttaagatcttgaacgtttaaaagtgccctttttctaccttattgtttaattggtagtttggctaggtatagaattctaatttggaagttatctctcttcagaattttgaaggtattgcttcattgttttccaaattccagtgttgttcttgagaaatccaaaaccactttgatttttgttattttctgtgagacccttttcttgcctctggaagctacagaatcttcttttttgttgtttgtttgtttccatcacccaggctggagtacagtagtgtaatctcggctcactgcaacctccacctccagagttcaagtgattctcgtgtctaagcctcaggaatagttgggattataggcgtgagccaccacgcctggcctagaatcttcttttcgttattggtttctggtatttcaccatgatgtgcctggacgtgagtctgcctatattatccattgtgcagggcactccatgactcttttaatctggaaactcatgtcattcaggcctggagaatttcttcacttatattattgatgatgtcgtctcctctgtttcatctgctctctctttttaggaaacttatttttcagatgttggattttctgaactggacctcaaattttctttacttttccctcctactttttatctctttgtctttttgctttactttctgggagcacttctaactcttctatttatttattattattttttttatctacaatcactttttttcatttccaataattcttttgtggttctctgaatctttttgtttgttttgttctgtttttgagatggagtttcgctcttgttgcccaggctggagtgcagtggtgcaatcctggctcactgcaacctctgcctactgggttctagtggttctcctgcctcagcctcctgagtagctgggattacaggcacacaccaccacgcctggctaattttttgtatttttagtagagacagggtttctccatgttggtcaggtcggtctcaaactcccaaccttaggtgatccacccgcctcagcctcccaaagtgctgggattacaggtgtgagccaccacacccggccttgttttgttttttataacatgctgttcctgcttcacagagagaatgttgtctgacaccaaattatagttgcctacatcactctaagagagttagtaatttttttgttttgcttccttttattttcttctctttgtatagtctttcaggttgcttctttctttctttctttctttctttctttctttcttttttctcggtttggttacttggttggctttgactctaatatgttagaagctctcctcagatatcctgaaatcctgattgctcatgtttaaaagtgagatattggccaggcacagtggctcacgcctgtaatcccagcactatgggaggttgaggtgggtggatcacatgaggtcaggagttcgagaccagcctggccaacatggtgaaacctcatctctactaaaaatacaaaacttagccaggcgtggtggtgtgcaactgtagtcccagctacttgggaggctgaggcaggagaatcgcttgaacccgggaggcagaggttgcagtgagccgagatcgcgccattgcactccagcctgggtgacagagcgagactccatctcaaaaaaaataaataaataaaaattaaaattaaaatgagatattaaaaagctaagttggtggggcttaattgaaagcctcatggtaggaagctggttggcctgtttatgagggtctaatgtccatatgtttgggtctttcctcctgtgctggtcagactccccagaagaagactttttccatccccaatatggataacaaagcctttttgtctcatccttggatgcaggttggggccagacagctggggatctcagcattcagaatgcatatcttccctttatttacctacttttacaatgtttcctatgctttcagctatgcctggcatccctcagcccacatccctaggttttaatctctccagaagacaacactaaagttgttaagcttaccaaccctctaacttgtcaagatctaaagatcgataatataggcagactcacatcaaggcacattatggtgaaatttcagaaaccaatgaacaaaaagaagattctacagctttagaggcaagaaaagggtctcaaagaaaataataaaaatgagaatggttttggatttctcaagaacaacactggaagctggacgagggactgttgcccaggcaagggtaatgatggatgggttctgggatctaaccacagtacttctcaaacagctttcttctagcctttcttgtttaactcctctttcaccctccagttgcagaataccttgtgctgccatttcctgaggatcttttttgaggatttctgtgttaatcgtgttatttctgagttttccccactactggcttagggttctgccatctccaggctcctaaggcagctaccactagtccagctgctgtctagcttccagggtgattttgctgttgtcttctctctgttcttcccacctttgtgggcttatgtaattttttttaatccctgttttacagcctttgcagggtttcagaagaggtcaaaattagatgggacagtctgttttaagactcaccttccttttttttttttttctttttttagagagagaactttactctgtcgcccaggctggagtggaatggtgcaatcttagctcactgcaacctccacctcccaggttcaagcaattctcctgtctcagcctcctgggtagctgggactacaggcgcccgccaccacagccggctaatttttgtgtttttagtagagatgaggttttgccatgttggccaggctggtctccaactcctgacctcaagttatccacccaccttgtcctcccaaagtgctgggattacaggcatgagctactgcacccagccgaaaatttacctttcaatctctcatttctctctagcactagattatagttacctacgttgctttccagttcagaaataaccttttaaaatttactccttccattcagccatgtttgtaaagacaaaacatgtccattcttggcaatgctttgttcacactccacttggaggaccaggacagtatgtcaggacatctttacttcaactatgtagttgggttgtcacgcaaaggatgctgaagtgcctccctattttcttctttctcgttgctgctactttctggaaccaccaccaatgcttcatatttgggaattagtgactctcattccattttcagaaagctggtgtcaactatcccaagaaagacagttaagcaaactttggagagacgaaatagtaaggaaataacttgttccttaggcttaacttgtcaagcaatatttctgatattttgcattcaatacactgccattctagtactgttgtgggtattactgtatgtgggaaacaatggtgtcatggatgttaggaaaagatgctgggatatatatgcctgcttagaatcaggagaaaagacaaatctcctttcaccctcctggtcagcataaatatttttaaagattgtttagatttttgtcaagatttctttctcttgatgaatttgtcctcgattcagtggggagaaccaagagcctctcttcgtttctcatcctctcccttccctctagttctcagttttcccatttttctgcacaaggacagaagtggactagaagattacatctaaggtcccgtttagctcacgatacaggccctcccagaggtgggggtgtgggcagggtcatgttccaagttctgcctccctcgatggactgtgggctcccagagggcagagctagctctattctcatgattaaggacatcgagaaggaaggggtgacgctcctaggagatgatttcccacccctgtccacaaggaggattggggcagcctggagaggctcagtgcccgcaagaattaagcagaagttgggactggactgtaaactgatgctgtcgcacatgctttggttcctgtcccaagcctcccaggttgctccgggtgactctggcccagcttctggctatccatgaacacaagtagtcccagggagtcattctggcagaacccaggtctgctagctaagaactcctgaaccatccgcaatctctgcctgtggcctggacttggtgtatggccggcagggtggaaggagaacccacagggcctctgaagacaggcaggtggcacacctgcggctgggaggatttggaaaaggagtccagcgccattcatttttcattcattttccagcccaacgtttgacctgaatgcttcacgctcacactgcacacactactccatttataatacaactcgagaagggcacatactactccatccacagctcagtgaagggatgcatactactctactcacaattcaacgaagtggtgcatctgcctctaatttactagctaccctggggaccttggacacgttgcgtgtctggaaatactgcaggtgatgtgtgtggagtaggctgcaggctcaccgtcctgcaaatactagctgtaccaccaccggctttaaagtccaacagacctctggcccaagtcaagtagcagaggatccagggcttgggtggcccacaaataggattcttctccaaaacgaggcgcataatggcctttgtctcctcgacagaaaagggaaggtagactggcttcctctatgggcgaccttcgcgactctggagaaaaagacctcatcattctcagacttgggaaggaagactaagcccggaaaggtggggacaagtccgctccaacgccgcaatggggagtagtagggacccagcaacccggtgccgggagccctgcaccctgggagggagaggcggtcgctgaggcaggaagaggaggaggagagagaggagggacgcaccgggtcagctcgcgatcctgctgcgcagggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcaggtgagtgccgggctttggaggcggatggcgtggagtggtgagctagccagccagcggacgcccggcggagatgcggccgagggacgcagggtgcggagggtgcggagggtgcggagagagggcggggacggcgtagtcaaaatgcgcgggtggctccgggacccccggactgttcggttcctgcgcgcgccgcgtcgggcgcgtgggccttgccctcctggagtcaaccttgccctcggcacgtgagagtgtccccgatcggggagcctcccggtccgggaggatgagcccggtgctggccgagaaggcgggaaaaggagctcccggtagccgatcccaggcgacatgtccaaggtggcgcgccgtgcgccccagggtctttgccgggattcttgaaagcacccaggcagggtgtgggaagagatctttcctctccaggctcgccctctacctcctcgcctggtccagagagaaggtgcaaaaaaagtgctttcacgtccgcatttcccactagatcccctttttcccgtccgcacgctgcattccccctctcctaaagttgaagagcgttggtgcaaaaatgaaagcgcccggatttcttttagggggtcccagagaaagccgccaggcatctgcgccaccgcagagactggacattcccgcgcccctcgcactttttggcagtggactttgagggcaggaggctgttgttccggggatatgtgtgaatttcgagttgtttcggttgggggaagggaccaacacgtcccagtgacctgtgccagccaggaaatgccctgtgggccctggatgtattagaacgtagtaaataacctggtttcttcatgtaagaacttgatgtgaggctagtacaggtttcgcgagattagtacaggttttgtgttttttaaatagagctctccaggaagccatgtgggtttgattccccttgctgcatctagggtggatttgtgtttggcaggtgtaaattagataaaggaataaaaggacgcaagtgaggttgaatttgggcgtcccggtgactgccgtctttacaaatacaagacaggagcttctaaaatatcaatataagctccaggaatacttcctggttcattctccaacatcaggtgacatattgctgcatagtagatagaaaatttaaaacttcatttaaaccatggcatggatttataaatatatatataaattatatatattaaagtagagacagggtttcactgtgttgcccaggctggtctcgagctcctgagctcaagtgatcctcccacctgggcctcccaaagtgctgggattacagatgtgagccactgtgcctggctgatgaatatttactataatttcttaggactgaatttccaagattccctttgaagaaaaagaattagtttaagaataaaaaggaagtgaaaatatgtgtatatgtgtgctgagaaaaatgcgtgcctaccagtcttggaacagtattgaaactctgggaattatctgagatgtttttggctttctgtgacaacagtggggaactcttccagtcagaacagggtgttaatcaaggcattgctaataatgagagcctctgttcctggtctcatttctccctgtgatctgggaaggctgccattttggtccagtaactccaatggagtcccttccaggaagtccttgactggctgagccctgtctcatggttcaatacataaatacgtagaaacctaggaactttccctttcgctttcttaagttcctccctatggtctcaggaactggccctttgagggtacatcaggctgaactgagagcttttgtggttggagtagttgcctgtagtcttgaggatctaagtggcaaaggcctttgagaaattcctggagactgtcctgaaaggatacagaaagccagagccctggcacagtggatttgttttataaatccatgaagtctcttaacaaagaaagactcagcagagtaaaaatgaatttggtgtcactgcagagatgaaaagtaaaggaaagtttgtgtcttggtgtcgtgtgtttgtgtgactttggtatccccaccaactcccccatttccaagagtgaaacactggttacattgggatcatagccttttgaaaacctccatttggttgctttctaagaaccactcagataccagagtctgggtcagtgaccccaatcttgccaccattgtctcttgccaaaaatgtgagcagacagatcaaatgatatattcacactccctgggtgagtgtgggtgttcattctgtttccgattcaaatgaggagctactggctgttgtctggaatgtgtaactggtagcgctgatgagtctcccccatctcctcccccacatccccacagatttgcatgacttggagtcagacctgttagccctagggctcacctcagatgctgccatttcatctatgatggttgcacgccttgcatgtgcacacacacactcttctgggtgttctccctggctatcaatatgggggaaggaagttaataattaagatgttttaagtagcatatagttattgtagaaaaagtggcaataaatataaccaaaatggaaaaaaattatctataagcaaactgccttattcactttgatgcagtcttcttaatgtgtatgtatgcacgctcatgtgcacaaaccaaaaatgggatcatcccattgtatggctttaaccagtccccagttgttggacatttaagttgcttccagtttttcttattaaaaatagaacacgtccaacaatagccagctgcttgtatcaattttaataggtctattcagtgaaaaggcacttgaaattacatagcacagactagaaaatgacatgaaaggatgaaccattatcctcatgttgccaaggttataaaatggtatcaactggattatcccattttgatgtatctaagaatgtgttcttcagctgtgttgttctgcacactctttttttaaatttttgagacagagtttcactcttattgcccaagctggagtgcaatggcgcgatctcggctcactgcaacctccgtctcccaggttcaagctattctcctacctcagcctcctgagtagctgggattacaggtgtgcaccaccacacccagctaattttttgtatttttagtagaaacggggtttcaccatattagccaggctcgtctcaaactcctgacctcaggtgatctgcccgcctcggcctcctgaagtgctgggattacaggcgtgagccaccgcgcccatgttctgaacattcttaactattttgtccagctacagttctggaagcagagttgctgggatgaagagtagagaggctcttagggctttggacgcgcatttccacgttctggaagcagagttgctgggatgaagagtagagaggttcttaggtctttgcacgcgtatttccgtgttctggaagcagagttgctgggatgaagagtagagaggctcttagggctttagttgcgtatttccatgttctggaagcagaattgctgggatgaagagtagagaggttcttagggctttggatgcgtctttccatgtcacctgtggagagcctgtcctggtgtgctttccagccatcagtgtgttagtgcttgtttctcacattctcccaggctctcctcactgttgtttcaccagcatctatggaagaagcattttcctccctccaatttggcaaatagaatctggacagtgttgctgggcagactcaagagtcttagaagcaccaccccagctggatggtactaatagctcaccagtgcttttttgccaaaagaaaacagaactgggtcccttggcttataacacaagcctcacctgcgtttttgcctagcggtgctgacctgggtttggatgggataggatgaggtggggagtgggtagggagaggagtctgctggtcagaaagacccctgattgaggtcagggtgggtgggacagtgggagatgataagaccactgatgtgggggaccagtggctagggttctctgccttggtggttaagaaaagtttataccgagccaggcgcagtggctcacgcctgtaatcccaacactttgggatgctgaggggggcagatcacatgaggttaggagttcaagaccagcccggccaacatggcaaaacaccgtctgtactaaaaaatacaaaaattagccaaacatggtggtacacacctgtaatcccagctacgcaggatgctgaggcttgagaatcgcttgaacccggggggcagaggttggagtaagcctagatcatgacactgcactccagcctaagtgacagaacaagactttgtctcaaaaaaaaaagaaaagtttataccccttaattatcattctaaattataaaaattatgccataatcaaattatttcaaaccacttcccacaaccttgtaattttcatctcccgggcagctggcgcattctagacaaccaggtaaggagatccaggctccttccctcgcccctttgtagccttgggtttgtatctggtccatcagtctttaaaagtattaactactattgctgcttgtaatagccaacacatttgctgtgccagccactcctctgaggattttacaaataagcatcttctgattaacatcagtaatccattcctgaaaaccagacattctgtatgaaaacactaagcaacgctatacatcccattattttatgtgggaaaaagtataacaatccactgcacagcgatgcaaaacctctaacagtttctgaaagtgtgatgaaaaacaggaagatacctgtgtataattaaccaatcctgttaagcataaagtgcataagacatcacttgaggactaccaaaccatttacatggttgtttgcaaacagttgctttgtgtgcagtaatgtagggcacctccctttgttgacatttttgacacttggggtgtcctcacttgatcctgacattctttttttttttgagacggagtcttactctgttgcccaggctggaatgcagtggcatgatcttggctcactgcaacccccacctcctgggttcaagtgattctcatgcctcagcctcccaagtagctggaattacaggcgtgcacaaccatgcccagctaatttttgtatttttagtagaggtggggtttcaccatgttggccaggctggcctcaaactcctggcctcaagcaatccacccacctcgctctgccaaagtgctggaattataggcgtgagccaccacgcccagccagatcctgacattcttgatcctagtgtatttggaatataagtaaagactttctgcacataattttgtttaaaatgtgttgaggttggagatgtaaatatacacatttctgaaatagaccttggccaaaaataactttcatagatgaaacataagttctacagtgttcaatgataaaaatgaagctattttctcctgagaaaatgtaaatgggagaggtggtcttgagtaggtctgcgtgtcatttaattctccgtcctcaaacaattgctcttactaacttcctgttagtaggcacagagaggtgacgtgacttgccagggctccctagctggtatgtaatgatgctgagctggcagccccaggagtatgactccagaacccagctcggtcataggactgcaaggccagtaaatgcctcccctcagggtgggaatatgcttaaataataaatctgagaacgtcttgaaaagaaaattaaaactgttccctgagcacagatggcgtagctttctttaagttttaaatgaagtgcaaatgatcctaccctcaatgacaggagatcaaagggttccgggagaaatgtgccaaatgcaaaaatgtacaaggtgacaatctgctgcctttgtctgggtaaatacagtctccagaaatgagttttatcaactccctgagtccaaagattatatagagttgaagtcgggctgttgtctttattttgggtctgcctacttccttggcatctgccatgtcacaaaacccttggagccatgagagggcttcttcaattcttggcaatgtgtggtccagctgggagctgagctagaatggtgtacatccaggcatatgccatatgcatccaaagagatgccttctgttactgatctggaggcgggaacatctggccatttcaaacaaggaagtttggctaaaacaatgtttaaccccgagaacagcttagagcagacaagcagtttctgggacatcacagagaatgcagaggtggtaagatgaagcccctgagtttgaaggactcacggcatctcttggacacaggtagacagtcaactcctacagagtggccaccagccacagtggagaggtacacaccaagaaccaaacaacataatgagatgagttattacacactgctgctcatactggaactctgtgctctgctggagtctgcccagggacactgtgtcaggagggttcagcctgtgttgatgggctgttttcacatcaactgccctgctgacaagtctcgctggagttgcatcctgggccaccctcaaggatacaaacaccaggctctcccggtcactattgcctctgagttcttgctcactgctacattgcccgtgtcttcagactgcacatcccaaagggcttagcttcccagctggaagttggtggagggaggagggcagagaaatggaaggactggagccaaagacctcactggactcagagttgcctttccagctttttggagacagcctcattcagacaagctctggagttggtcaaagcttggttcaaatcctgactccaccacttattaacgaggtgagctgggcaagttgcttaacctgtagggacagcagcaccctgaggctggctggaggtctgaatgaaatgatgtgtgcactagtctggcctagaacaaattcctcagttagtgagaatttcatgactttgtgctgtagtttggatgattgtttcctccaaatctcatgttgaaatttgatccccagtgctggaggtggggcctaatgggaagtgttgggtcatggggtggatccctcaggagtgagtgagttcttaactctgttagttccctagagagctggttgttaaaaagagcccagcaagaaccccctgcccttgcttcttctcttgctatgtgatctctacacaccagatcccctttgccctctgccgtgagtggaagcagcctgaggccctcaccagatgctcaatcttgaaccttttagccagcagaatcatgagctaaataaacctcttttcttttcggtctttctttttcttttctttcttcttttttttctttgagatggagttttcgctctgttgcccaggctagagtacaatggcacaatctcagctcactgcaacctccacctcctgggaagcagttctcttgcctcagcctcctgagtagttgggattacaggcgcctgccaccacctccggctaatttttgtatttttagtagagacgaggtttcaccatgtcggccaggctggtctcgaactcttgacctcaggtgatccacccgcctcggcctcagcctcccaaagtgccgggattaaaggaatgagccaccgcaaccagccaaacctcttttctttatcaattagccagctttaggtattcctttatagcaacacaaaacgaactaagacactttgattatttgagtcaggtccaagaagaacatttagatattcaataggcagacaacctgggccaaaattataggctatcatagtctgtataaccaggtctctagtgggagacagtaagattatttttgacttttgttacctacacattgtgctttggttactgtcccagtgcagtcgactttggggacgtgtaaggatatctgtggaagaaattcctagaagtgaagctgctcagtgaaaagccgtatgaagttattctaaaagacactagaacaagtttttaaaaaatgttctgtgagcaagtgcctgcacacacatgaatttcctggtagccaaggaactgactggaccagttttataacaacttaattgtcatgctcagttacatttgagatgggaatgagaacaccccagtggtctcctggggattgcagctatcttcatgaccgggtgttattagccaagactgggctgcagtttgccagtctgtgaaactagagctagatctccatggagggaaacctggcagggccctggcctttaatccctgctgagagatggaggattactctggaactggcttggaagtttctgacagtcttatcaggtacttcagccttgggctacatctgtcagagctaagtccttatcttcacggaacatagaagactttttttttttttttctgttgcccaggctggagtgcagtggcatgatctcgactcactgcagcctctgcctcccaggttccggcaattctgctacctcagcctcccatgtacctgggattacaggcacgtgccaccatgcctggctaattttttttttttttttttgtatttttaatagagatggggtttcaccatgttggccaggctggtcttgaactcctgatctcaggtgatctgcccaccttggcctcccaaagtgctgggattacaggtatgaaccactgcacccagcctagcagacatttttcaagttgtaaacaatgcttggatcatcttgcagaagcccaccacaacccgaatggtgccaaaccctcaacataacttcttctagcctcactggcctctgcctctatgggaaatacaactcaagttccaggcaggaacctggaatactggtgggaaggtatgtcccactggcatcttcccctccttgccctagttgctagagactggaaacaacccaaatgctcatcattagaatgtggagagaaaaacacaaggatcagaacagtacatatggcatgcaaccttttggcaaaataaaatgaaatagggatggtatataaatacacacttgcatattcatagattacttctggaatagtgcacaaatactggtaatagtggttgcctatgggaacagaaccagattcaagggtaggagaacgactttttacattttgttttactttattgtgtgcttcatatattatttatctaaatgtaaaaatatttttcagctctactgagatataatgtacataccatcaaattcaccagtatcaattgtataattcaatgggtcctgtcaaatgcatggtataacatttccatcaccctgcgaagttcctccagattcctttgtaataaatccatacctcttagcccctggcaaccactgatttgccttctgtcaccgtagttttgcctctaagatattttaaaaataaaaacaatttaaagccaggtatgaatatagcccttactatttttgttgcattaaaacaaatttctcaagtatagaccccgtcttcaaaaaagcctaaagttacttcctgcaagaatgtggttgtgtagaagggatgcagtagaagtgttaagttgctaggaactgaggagttgatgaccaaaaaactgacttctcgacttggagcagcttttcatgaagagcaacttgctgtgatttgttttgttttgttttttccctatctacttttagggcctagcactgagcaggcctagaaaatttgatttattatttgatggataactggagatcacctataagagcaaagcagaatatagtggaatgaggattaatgcttcatcgccccaaattttctagctagttttgttcccatcctcctccttcttccttagcaatagctcttagcagtagggctaacttctactgtaaggaaggaatatggttcatgaaaaggaaagtactttgacccacagtctctctccctgtcaggaagaaccatctgcttttttttcttccacccacccacacaatgtgctttggagccaggcttcttaaaacccccaactcagcattcttggttccttaacttagtttttcacatccctgaattctcagaaggtcttgaaaagatctagcccagtccaaggtcattttgataacaaattctgttcattctgtagatattggcgaccccttgtgcatctagctctgtgtgcccttatctcttgctctccaaggactcaccatctggaagggattgaaacatgtaaaccaggggctacaaattgatggcctaggggttttggcctagttcctttttgtatgttttgaaaaaacctaaattacaaagtatttgatagagcttgcaccctctaattcaacgaagaccctcttccctatgttgcctttcatatttgggtttgcaacaatttccagtgtaataagtaaagcaagagatgtaggtataagaattgcagtataagcttctacaggcaagacaagagaaagaggaggacaaaatattctcctggtgcctgaggtctgtgggacatcattaacaaaaccccgagtttggccctggagcagaagtatagctctgttattaattaccaataaccccacaatgtttatttttatatttaaaatggcatttcccaccatctctgaaatgacaacttgctaagtgatccactgtctggaaagacgcaattcagagttaatccttcaatatctgatttctaactggagatcacctacaagagcaagcagaatatagtctaatgaggattaaattcttgattactccaaattttctagcttgggttttgttcgaagcctccttttcctcccttgacaatagctgttagcagtagggccaacttctactgtaaggaaggaatgcagaaagtgctctgccccacaatctctctccctttcaggaagaaccatctgttttttgtttttttttttttctatccacccacacaatgtgctttggagccaagcttctcaaaacccatctcagaattcttggtgcctcaacttagtttttcatatccctgaatttttgtatattcatcttaagatcactggctggtcccaacattgacactgtcttgttgccaataatgaccatcctagttgatataacgccttccgtaatgactgtccttgttcttgtaacttcattatgatgcccaaacaccttttataatggctgtcctcgttgacttaacaccttccacatccataccttttactgcagtcacccttgtgaatgtatcttctaccatgactatccttgttgatatagtatcttctataatggccttcctcattgacataacacctttcaaaggtaaccaacttctgatgtaggttattttggagagctgtctgtaatggacatcctcattgacataatacctcctggaagctgccctgggccctctgggtgaggaaggcatgtgtctggccccaaagatctcctggagtgtgccacgttgtgttgctgatctgtttatcctgggctgcctggtttgctgtggaatcatgttattgacctggcttgtggtcgcttgcaagggcttcattcagaaacctgtttgccatctcaggctgtgtggtttgctctcccgtcccccactttaagattgctggacacaacaacagcaacaacaaaaatggtgttaatccctggtccctaaaacagaaggtttaaactgagggatgtatttctggttggctgccctggcctctgggatggcaatacacccacactccccagtcaagtcccctgagtgatcaagaggttggggctttgcagttaagaaagaagtagatctgggccgggcgcggtggcccgcgcctgtaatcccagcactttgggaggccaaggcggggagatcacgaggtcaggagatcgagaccatcctggctaacacggtgaaaccccgtctctactaaaaatacaaaaaattagctgggtgtggtggcgggcgcctgtagtctcagctactcaggaggctgaggcaggagaatgatgtgaaccccggaggcggagcttgcagtgagcatagatcgcaccactgcactgagactccatctcaaaaaaaaaaaaagaaagaagtagatctaaggcctcaaaaacatgggtttctccccttgctcagtggggaagctgacatcccaaatggtcacttcctctcacaccctggctgccgtgggtgggtgctgcaatctgtccttccagggcagcaagaaaggagcagggagtgagtcagctggtggtcatccttcagaccacagtgaagcagaggatggattgctgccaaagtatcggaagtaaaggcagtgacggaggtggtgaggacatcggagatggaggaggagcagatgctcttcctgattgattgcccagggcttgtgattaatgaggaagagtttgggggactcagaggcaagattacaggccaaggaagggcccacgctagggagagacttctgtcttggagggctgctagcctctttttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccatgcccagccaagagttctgtattggttttctattgctgcatacaaattgccagaaacttggtgtcataaaacaacacctgttagctcacagttctgtaggtcggaagtccagaaatgtacagcacgggtgggttctctgcacaaggtctcaaaaggctaagatcaagacgttgtcaggctacattctccacaggagcttgtggtgctcttctgagcatgttggttgtagcagaatccagttcttgtggctgcaggtctgatgtctccctttccttgctggctttcaaccaacactgctctcagctttcagagaccacctacattccttgtcatgtggacccctccatcttcaatactagctacagagactctcccttatgttgaattcctttcacacatcgactccttttctccaggaaaagcccagcctattttaagagttcaactgattaggccagaaccacccaggatagtctttctttcctaaagttaacagtaccgttcaacatggtctaatcaggcgagtgatatcccatccttcccacactcaagtggaagagattctacaaggatgtgagtcactggagggcatcttagaattctgtccaccactgggtgccgtggcacagaggctttgccccctctgtcggaatggtaatgatcatggccatcaatcactctttgagggcctgccacatgcctggctttgcacatgtggtctcattccaatgcttgtaaaagctctgcacagttgatgtttttagccaaatgctgcagatgagaaacttatggttcagagaggtcaggtggcttctagtggcccagccaagtgactgaagtgatgaggcacagaagcagggagtattacacatgtgaggtcaggtgatgggggccgcagaacaggtctctgtcttaatagaacctcctctcctgctgccttttgttcctcccccatgagtggattttcaaagctgcaggctgaactaacctagagctgaacattttggtagtgaagtgtttccctactaccaccccaccccgtctctagtgttatcctttgagggatgacaaatggtaaggtagaaatagccggatgtaaccttctggaaaagctcattttaaactgaactttatttttagtttaagcagctcatggcttatgttcagacaagtaagaacgttttcttttatatgtctttttttttttttttgagacggagtctcactgtgtcgccaggctgtagtgcagtggtgtgatctcagctcactgcaacctctgcctccggggctcaagtgattctcctgcctcagcctcccgagtagctgggattacaggcatgtgccaccacgcctgctaatttttgtatttttttaagtagagacagagttttaccgtgttggccaggctggtctcgaactcctgacctcagatgatccgcctgccctggcctcccaaagtgctgggattacaggcatgagccaccacacccagccttacatggctcttaatcgccaaaaaaatgcagtcctgtcagaacatttctcacaggcctgcccgcagcagtgtcccttattcagtgcgtggcctacagagaccaaggtaaggtctctgaatgtagtggtcaatgggctgcattatgtgctaaccagcttttcacttatcagggaaatccttatttttcgtgaccttttgccatcttttgagttttctagtcattgacatcatttttgtttaaacaagtttctctccctcccttccatagtaatccaggggattactgtgaatatatatgaatttgaggctatgtagttttagtcaatgtttggttggcatccaaattagtaattagcaattaattctcacctacattatgctaaatgaaataagccagatacaaaaggacaagtactgtctgattccacttagattagtagtcaaattcatagagacaaagtaggatgctggttaccagggttgagaggagagatgggagttataatttaatggatacagggtttctgtttaggataatgaaaacattccagaggcggatggtggtaatggttgcacaacagtgtgaatgtgcttaatgcttctgaactacacactttaaaacggttaaaatgataaagtttgtgtatgcatattttactataataaaaaagcaaaaagaaatatttgcagggtttatttataggtgcttttttcccttttctattttattgagttgggtttttttttttaaccacaataaaaaaaatttttttaaagaagtgaagcataggtcaggcacgatggcatgcacccgtcatcccagcatttggggaggctaaagcttgagcctaggagttcaaaaccaacctgggcaacataggaagacccccgtctctacaaaaatgaaaacaaaaaaattagccaggcatggtgtcattcgctggtggtcccagctactcaggaggctgaggtgggcggattgcgtgagcccgggaggtcaaggctgcagtgagctgtgattgtgccattgcactccagcctgagcaacaaaacgagaccctgtcactgaaagaaaaaaaaaatgaagcataccttccaattctatggctagctttgtaaatatactattggtttctaatgctagactgtctctgctaaaaaggaagctcctccccttacaaggcccagggacaacacctgtaagcaactcccctgagcataactcactgcacttagggttcagatcatgaggaaggaccaacaggtttttctcctcaattttcagagttgtgcaaacaacaatttgttgtaacaagaaccgtgaagccctgcaagaacctagtaccttgagggcagagactgaaccatctgtggatgagaccttatgcccaggaccttacaggcacaaagatcgactcagaaggggtttggtgtatgtccagaaggatggcgggagaggagcttctcagcatccaagaaagtttcacatagctagcaatggttttactgagttttaagaattgttttattgtggctggacacagcctcaagcctgtaatcccagcactttgggaggccaaggcaggaggatcgcttgagcccaggagttcaagaccaacctgagcaacatagtgataccctggctctacaaaaattaaaaaattagtcaggtgtggtggcatgcgtttgaggtcccagctatccaggagactgaggtgggaggattgcttgagcctgggaggccgaagctgcagtgagccaagatcacaccactgctctgcagcctgggtgacagaatgagactgtgtctcaaaaaaaaaaaaaaagttgttttattgagacttaagtacccaaatcttaagcgtatagctggataatttttaggtgtgtgtgtgtgtcatattgtgtgtgtgtgtgtgtcttgttaccaagatttggaacattctagtactgcagaattttctctcttacccctttctaatcacctgcccaccttccccaccccaggttcactattctgacatacaagcacagattggttttgtcttcttgaacttgatataaataggatttatatcaagtcttttgtgtgtggatttttgtttaaccaccccgctgctgactttttgtcagaagaacttgaacaactatttaatctctgatggcaaggttggaccattggaatgaggtactctggagggaatactaaagacactggaaattcagtaacttctaaacatttagcaggtgagggaggggagctgtgggcctttgcgtgtgtgtccctgagtgtacatacagatgggttttttaatccactcctttgatttttctccagccatccttgtgatcctcagtgactttcatggtcctcgtgactcacacttcaaggtttaacaaaataaatctttttaacatttcataaaatgttaatgtgatttaaagtagccttgtggcattttagcatcttgtatgaattatttacagtggtcacaaggtgagttatatttgttatttaattctgcaattcccgtgttcaaagtctgttattatgcagctttcttacctctgtggtcctcttggaaaccattccttcaccgatacggtgtgattcaatctggaattaaatgttaatgtccgtgttttggattgacaaggagccttaagatggcctcagtctcagaggggtttatacgcagatgtgtccttttgctacagactgtgatatagactgtgacccagacagggccacctctctcatatggcatgtgtctttgatcataaaagggaaaaatgcaacagaagagtttggatggttctgtgcaaacctgtcaccactttagaaaaatgattcaaagcataagcactgcagacagtgaactgctagcattgcttttgaggaatggttcagttactttagaaaataaataacttggccaggcacagtgtctcacgcctgtaatcccagcactttgggaggctaaggcaggtgtatcacctgaggtcaggagttccagaccagtctggccaatatggtgaaaccccgttctactgaaagtacacagattagccaggcatggtggcgggcacctgtaatcccagctactcgggaggctgaggcaggagaatcacttgaacctggaaggcagaggttgtggtgagctgagattgtgccattgcactccagcctgggcaacaagagcaagactctgtctcaaaaaagtaaaataaataaaagaaacaacttgcatcatcacatatcattttctttcttaaggaccttgagaattaagagtagggagtgaatgaatgtataaaacagtcccgtgttgataaactgttccaacaagttggattgactaagcgtgcacatggttcttttcaacgttgctattggaacttaattttactctcttctgtaattaatctaagagctgtggaaatagtagactattttaatgggaactttgtgtctctctcactgagggggtgggaccctgatgtctcttgagccctgaggtcactggatataattctggaagttggagcccggccttgttcatctttgtatgccagcacctggcatgacagtaactcatggcaaaatgatcttgagagatgtggccagagtcggccttcatcaacattttgcagcaagttgtctctgcacttcccacctgcactgtgcatgcccttgtcctactccctcgggccttcttccctgccctgacttcccagtgcagtcctgtgtctcaggcccactgcaggtgggaggttgtgcttgatcactccccaggtcctttcttgataactagggtctatgtccaatccttcctgggtgttaactgatcactgcagtgtttaatgtggtcctttcctttggagagcctataatggcagaatggcaggcaagttcttgtagccacctgtggcacagtatcttcagttgggaggtgcacctgccgttggggttggggaatgggatggtcacctgccctgccacccatccctttctccagacctgcaacagtagcctgaaagcatttcctcagcttggcctgacggctgtaccttgccccagcttctttctaggggagtctggtaagcagccatcatttcacatccctttacttctcagagggagaatgagagatttgccctgctgtcttgacaggctctttcctgaaaccagccatgggaataaggtggaaggagtggggtggggaatgggaattggcaggtcctggcaggtcctacttgacttccaaaccagtggatgaaaggctttacagctcagatacccagaaggacaggtggaggtctcttttaggaagaagcatttcctgtgaagccaaagcagaagcctggttgaaattgactcaaacttgcatcggattttcccatgagtctcattgacagctgtctagagaagtgagtcctgcaggccagggcttctatagcatgcttttctgctaaaacttggcactggcctttcattcccagtgctttgttctagaatcatggctgcttttcttttgccactaactcagccacattaacttcccatgcccacaccccccgggcagacctcatgaagctgtggagccatcagcagtggaaccatgccagttccctttcttagaaccttacacctggcactgccaaaaaagaacaatacaaaagaacaaccacgccccaaacatttcaaattctgtggaatttaaatcttaagcttaaattccaactatactttcaaattactttgacatgaaggaggatttgcagtaatacagtgtgcttgttggaccatttaaaacaaatatgttttccttttgatatcctagaaagccagcagcttggaaatacttcattctaccttgattgactttgttggtaagaacaacgcaccatcatcagaaagttcctggttgtgtgtggagttcttcgggcggggctagctctgatgaatagtcatttatcatgccccgggcaccggtgtcagagctgggacacaaaacttgtctctacctcttattaatcatatatgcctgggtacattacttaacctacccaagcctcagtttcttcatctgtacaatggggtttaatattagaacctactttatggagtggttgtggggatttataaatatttataaacatatgcacggggctgcctaatattaaggaatcattaaatgtttgttgttgttactatttagacaggcctggtgtctagattccaaaggtttttctcccatccaagagagaatgattagcccttgaaatggcaattcatgttctagttctttcttatgtgaaggtggaaatgaactatttccaggtaggcagatcagtggtcttcctgttgttggcaagacttacacctcaatttaccagtctgtaaatggacccggccaagtcaatgacacgtggattttgagtgtctaaaccagttgtctctctatgcctttaggcctcactgcctcaggtccactggactaggaagactccaagtttggcgatgtgactatctggcacccccacccctcccacagcaggcactgttagaatgaattctgttggaggtgactccccacttcctggaatcagccaacaactgcattcacttaataagaatggcagtttctgtcacctccagggtagacaaaaaaaagaaacagagagagagagagagaagaaggaaggaaggaagaaaggaaggaaagaaagaaggaaggaaggaaagaaagaaagagagagagagagaaagaaggaaagaaagaaagaaagaaagaaagaaagaaagaaagaaagaaagaaagaaagaaagaaagaaagagagagagacaaagaatggcagcagttgctcctcttctgctaggtaacttgaccagccttggcagcttctatgagggcagctcattgtggtaccctgggtgggtggagactgcagaggtgccagggttgaaccagaatgtcccagctgcctcctgagttcagcaaacttggagaagggaggtcacttctctggtctcagtgagggtgctggagtcacatgagtcaacatgtagaagggcctattaatagccaatgatcagggccagggccatggctaggtgaggcagataaggtgtgcagaatttaaggaggcactcatacttgcttccttaagtggcactgccctgacagtgagtgcctccttaaggtttgcctcttcagtgctttgcctgccttacgtagtccccacccagccagccaggactgtaggctttagactcagagccaaactgctgctatagttgtctgcttagcacccttcaatggtgccccatcgctgctagtagtagttgtaatatgctatcattgataatatcaacaatactaacagccaatattgattgactacctggcaccattctaagcactttgtaggtattaactcatttaggccttacaggaatttcattattatcctgtttgcagatgaggaaagtgaggcaccaagaagctaaggaatttgcccaaggaagcacatctgggtgagtggtagtgccgggaattgaccctagacagtttgattctagaatctgtactcttcaccaccacaccaagctgctaaggtgtgctggtcccagtgggtgaagcccaaactccgtggccaacaaccaagccctttcccacttctccagcctcctctacccacccaaacaaaactctggccaaatcaaactccccagagtggctccaaggaagccatgattttcatatcttggcatctttgcacctgctattccttccatctgtccttcctgacagtcatctcacagttcctggttggcacactcatatccattcttttagacccatcttaagtcatacgccttctgtgaagccctccttgaccaccacccccagatggttgatagcagaccctcaatgtcttcagagtaccttgaagttccctggtgtcctaaaattactatttgggtctaatgaacagacaggcaaatgttcattcaatgtgtgtgaattcaacactcgctccctgcagggaataaaggttgggagaaatcattgcaatggtgtgtgtgtccccttggggtggatatgaggtagggtataaacttgccaatctgctggacatcctggggctcccatggtgtgcacatccacaatttaatgaaacgtattttgcaaacctggcccctaaaagcatatcacgacttatctgatgctcagtctgaaaagcagggatctgctccatggatggaggaaacaccagctgctggacttgttgagaatggaatgttggtctgcaatgtgacctcttcctaagagaggacagggctattttggccataagtggaacctgactcacatgcaagccgtgactgagcagccacaaacttcttggtttctgagtctgcctcccttggcatcctgggcactcctccagggcaccatgcatcttaatatgtatctcctggtgcctaggctgagcccagccctggctgggagctgctcagtccatcttccttggacagagaaggtgaatgagagccgagtcccacaggcaaccacacccagaattgaggcaacttgttccaattcgtctacaaattttagacgggttgccagttattttgccagtcttttaaactgtatttgacagatctgggagaaaaatgacttccggtgtttatcacctggaattccctcccctacattagtttcccttactagaatcgagaattgcaaagaaataggatggcagggagaagaaataacagggatgtgtgatatggtgattaatgaatggtgaatcatgaatgatgattaaaacaaatggaaattcttcccccaaccctgcctgcccaggaaggagctggtgaggcagatgctcacaaaggtgtcctaataaggagaggtcaggaggcaggagagctgaagaaaagagctgtgtgtgactcaggagcccaagcctgtgccttgtaagcttttccaaatgccctaagcccaggagcccatgcactgctctagtgaaagcttggatgcctttcagcccataaagcctcaaagtcacaccagaatctggagcatttctaagtttctctgaacctgggtaatgattttctgaaatattagaccaatgaaataccaaattcctggggaggcaaaagaaagagatgtgatccaagcatttgtgatcaaatgagctgacaagttactctacttaagcagtggggattttaccactgtttttattgcagcgaaataaatgcctccagagtggcagaattggtgggggtcaggagagagtccacatttcaagtatgtacaaggtgttgaatcattatcttcttgctcctgttcaccccttctagctaacttatttatcagttaggatgagggggatcattaaaaatgacagccatgtgagtgatgtgtccttggctgtgaccctagaaaagagcctataatataagtcatctcctcctgttggaaaggtagctaaattcagctttgcctatcatgtgtctttagcttagttgtttcctctgaactatgagctggacaccaggtgggggattactcaagcccaaattctctggtctggtataccaaagaatagttacaaactacagctggacagtagaacgtgctgggttgatcatctcagccagggcaaagaaacatattaagacgttaaacatctaccaggagtgagtcatttaaccctcgtaaggtttcatcttccttgattgcaaaatgagtttgtgtgaaagaccataaataaaaaatagaaacaacagaagtagcattagtaattcatgaaggaaggactggtatattcaacgcttagagttggaacaatgggctctccatatggaaaaaaaagtaaaagcgaatccctacttctcaccatggaccaaaaaaaaaaaaatccctacgtctcagcatagaccagtacagattcccagagcccttgttatacctactagggcttagaactttatcacagaccatttgtaggcccttagtctaggctattaattccctaagggcagggactctggctgtttttatcattaagtcatttgcaccaagtgtgtccctagaatagattatgaacccagaaaatgtttgtcgaatgaatacatcatttccaaaattctttaaaaaatgaatttctaggccaggtgcagtggctcacacctgtaatcccagcactttgggaggccgaggtgggcaaatcacttgaggccaggagttcaagaccagcccagccaacatggtgaaaccccctctttactacaaaatacaaaaattagccaggcgtggtggcacacctgtagtcccagctactcgggagactgaggcacgagaatcacttgagtcccaaaggcagaggttgccaagatcacgccattgcactccggcctgggcaacagagggaaactctgtctcaaaaaaaaatttctaaaagagattatacatttttctggctgggcacaatggctcacgcctgtaatcccagcactttgggaggctgaggtgggtggatcacctgaggtcaggagttcaagaccagcttggccaacatggtgaaaccccagctctactaaaaatacaaaaattagctgagcgtggtggcacatgcctttagtcccagctactcgggaggctgaggcaggagaatagcttgagcccaggaggcggaggttgcagtgagccgaggttgcgccaccgcactccagcctgggcaacagagtgagattccgtctcaaaaaaaaaaaaaaaaatacagattatacatttttctttgactgtcattataaaagaataccttgccatatacccagaattattttgggtactaacctggccaaacaacagagaagaactgagtggagagattttggtgagatcagctttggtcttctctgaatctaagttaaagagatttaaaatattacatatacctaggcttcccccaaaatattattaaaccatattttaactgtggtaatgattattcttttattaatttattacatgcctactttgtgtgaaaacatgatcttttgaacactttttctttttattaaggtatagcttacataaaataaacatcatcaattttaagtgtacagtttgatgaattttggcatttgtatacaaggtgtaatcactgctatcgtcaagatacaaaacagtcccctcaccctgcacggtctgctttgccccctggtactccattccctctccccatctctagccttaggcaatgcagctctgcttagcgtctagcactgatttaaaataatgatcataggggcaggaatttttaaataaaggataaaaaagctgacagaaggggaaatgggaataagaaagaaattggtaacatagctagatgggctgtagcctcagattggactcagcttcacttgctggtgaattagcccaacttggagagactgagggctccaagaattttttttacaaataacacagttagacgttttcatgattacagaaaaagaacacaagagttgtaatatacagctcagatataaacctggcaactgggtttctgaacatagatctggattcatttttaatctgacatcttgaggaactcctcagcctcagaagattctaaatggccacactgcttgaagaccaagcatttgagcaaataaaacttctgcccctgagaatatattctctctcaagctattaattaaaagatgcatagtcccttgttcttgccaggatttattagccgaaagtaaaatatgggaatggtagtatgtctatgagaaattaaatgcggtgaagacaagcacacagggactaatagttttatatggagttgttttggggcttaaaacgttttgtctcctcgtggggatcaggcactgccttggtcgtggggctaccactaaaaaatacgggcaagttcctgctgcctcctgtaggagctcacggacatcaagcgcagggttcaggaggactgaagtggtggggggaggggagcactttaggtgggctggtcagggaaggccactctgaaaatgtgacctttgtgctgagaccggaatgacaacaaggagccagctttttctagagaaagcacttttggtgtcaggaccagcatgtgcaaaggccctgaggtgggaaagaggttggtgtgttcaagaaagaaggcaagactggcctgaacacagtgactaaggtggagagggttacacgcagaagccagaaagacaagaagttttgccccaaaaatggaaatctaagcactcttgcagtcataaaactggccatggcagtgccctggtgcccagagagatatgtcatttctgagcagtagttgggaattcttccagttacaaagtcgcttcctacttactcaggtaatagtcatagactcagagctggcagggagtgtagagttattctagccccaccccttcattttacaatgaaggaacagaggcccaaagagggtaaagttcatacctgaaaaaccattctaagtgaggtcaaaaggcaaacgataaactggggaaaatatttacagttcatataaggttgggagatcaatttccatactatgtaaggagcagctggccagtggggttggagcagagtgtagaatggagagagaggcacaagaaaagggtgacagaaatccaaatgtgtgatcacatacagctgctgagctgtgggaatacagcatgctcactcatggcagctggcagaagtacatccagtcttgtgcaggctagcagttatggtaaaattatagcacatggctcgtccaacactgaagaggactcagatgtcattcagcaggtgcatggataaataaatcatggcctattctgtcaatggaatagtactcagcaataaaaaggaggaaactactgacccatgcagcagcgtgggtgaatctcacaagcatgctgagcagaagcagccagctacaaaagagaaagtactataggcttccatttgcatgaaggtccagagcaggacaaactcattgacagttttctaggacttggagtggaggttgactgcagaggggcactgagggaacttttgagggtgaggaaaatatttgtatatcctgattgtggtggtcacatgagtgtatacatttgtcaaaactctcaaaatgagtgagtcctttttaatgtgtgtaaattactgtcaataaggttgattttttaaaaataaatttttacaaggagggaaaaaagaatagatgggaaacaaaagcttctgattagattgctattcattcactaactgtttatcaagcaccatttgtgtgccagcacgataacagatcccgaccagctgtttgtaccagaacatggtgctacatgaactgtgagcccctaggctccctccacaggatttacctacagacgatcttcccatcatctgctgttcccaggccatcagctgcccggagactcataatcagaatccaagatagggcaggggcagtgtcagctaaggagaaagtggctctcccttcttggtctaagagcacttaatcaatcaagcaaagcaaatgggaaggagattgggcttgtttgtgaaccagagccctactctgacatttgtacaattctgtttaataaccaacccccacctcacttgcttgatactgtttgctcaggtgttttttctaaaccccaatctgagataatagcattgttttgctctaactttccaaattcattgatataatatgattatatctaatttctgcaaatgtttttctagcccccactaccatacgtacatacatatgtatgtatgtacgtacgtgtgtatgtgtgtatgtgctgggcatataaagcacccagggcaagggacagcagctctttgcagataaatgtgtctccctatgatggatggtttctgtgtgtagactttgttctactgtcatgttgagaaaaggtgtggtggttactctggttgttatttaatactgctcagatgggatatctaacagcatactgctcaagacatctagaatgtggtatagtgttttcaatttgtagaaaaattaataatccaaacaagaaacacatgtcagtgaccagctggcagcatcctggttctttttcattgctaaggtcggaactgtcattttgcaccacccttcttctcagaaaaggagggaaggaacaaagttgtcatagaggacatcctctctgaaccagattggggtcggggaccacagcagtttgcagacctaaatcatcctgcttacttcattttccttccttccttcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattggtaagtagacacttgtgagctgtttgacaatgtcttttaaatgtctctacacctccctgactgtctttcccatgctaagtcagtctctaatgctagagagctaagatctattctgaaactctacagttttttaatttagctctgatgtggccagttagagttctaaatgcgttacacagcttaatttgtttaatctttaaaacagccctatgagaagttcacagagagaggaacttgcctaagtgggcacaactagtaagcagaagatcaggagaagaacccaggtactgtggctttcaagtctttgcacttagccactgtgcacataggctcttcaggcagcactacagaagcccacaagctacagatcttcaggtctgtgatgctcatcctgtgtgctaaaaatatctggctgatacggaagacaaaagaatcagaaggttgaggagaggccgggcgtggtggttcacacctgtaatcccagcactgaggaggctgaggtaggcggatcccctgaggtcaggagttcaagatcaacctggccaacacagtgaaaccctgtctctactaaaaatacaaaaattagctgggcatcaagaccagcctggccaacatggtgaaaccctgtctctactaaaaacacaaaaattagccaggggtggtggcaggtgcctgtaatcccagctatttgggaggctaaggcaggaaaatcacttgaactcaggaggcacaagttgcagtgaacccagaacacaccactgcactccagcctgggtgacagagcgagactacgtctcaaaaaaaaaaaaaaaaagaagttgaggagataaagatagagcaattgatccataagacacagtggaagagacggctgctttggagaatgatggagttgggtttggcttcaagctccagggctactactcatgtgacgtgatcacatgactttaagcaaattattcaactgcgtaatgccttagttttctagtctataaaataaggattattgtaccaaacaagagagttgtgaggataaaataaaataatggattgaaaaatggatgacacataatacttaaataaactatagatatttggttttattattcataatttgagcttgggatagaagattgacataggaaataataataattaggtagggaaacatgcatttataatttctcaatcattttaagggggccatgtcaaataggatgaatagatgtattaacaagaataagagcactatttgtcatccaatcaaagccataccttaggaagaaggaattcaaaagtaaaaggagaaattgaagtattagaaatcaattttaaaaactacacttaatgactaataccaagacctagttctctgcagactaattaaatagacaaatccctgactagtctcatggaaaaaagaaagaaaatacaaatatacagcattaaaggtataaaaatggacttaacaatatatacagagactatttctaaaattgtaagagactgtgtataacgttttcatcataaatgtgaaaatccaaaggaagtggatgattttcaaagaaaatttaatgggctggattgactcatggaaaggtaggaaaactgaataaataaataaccaaggaggggattggaaaaaatgcccgagacaggggagaacagtttgggttagttagagatgattttacaagtgagttctataaaacttcaaggagcagataatttctatgacattcaaaccattctagagacaggttggcaaacttctttcagataaggtccgatagtaggtgtcttaggcccgtgagccaggaggtttgtatcatgtcacagctcctcaactctgctattacagagtgaaatctgctgtagacgatatacataaaccacctggcaaatcagttaatgtgatgctttgcattattaggttagagaggaaaaaactacatatgattatctcaatagatgattttaaatgtctttttttttttaacggaacactatggctcctcaactcttctattacagagtgaaatctgccatagatgatacataaaccacctggctaatcagttaatgtgatgctttgcattattaggttagagagaaaaaactgtatatgatcatctcaatagatgactttagatgtcttttttttttttttttaacagaacagtatgaacatagattttaaatgtctttcataaaacactcttagtaaatcaggaatggaaggttattttcttaattcaataaagagcatctatcaagaactgatagcaaataccatatttaactatcagatatggcagcattaccaataaaacaggcaataacataaggaggcttattatgcatgcccttggtcaccattattcagaatctctaattaaatatatagagattatcttaataagtacataaagtatacgaagcaaaatataaaattctgttgaaagacaaaagagaagacttaaataaatggaaagatatgccatgttccttgataggaaaaataaatatttttacaaacaattagccaggcgtggtggcatgtgcctgtagtcccagctactcgggaggctgaggtgggagaatcactcaaacccaggaggcagaggttgcagtgagccgagattgtgccattgcactctagcctggatgacagagtgagaatttgtcttaaaaaaatttaaaaaaaaaagaaatactaagtatttttaaagtgtaaattctcccctatattaatttatcaatttaagtcaattataattaaaattttaatgaagcttttacagagttaaagagaacgttgatatatttaagaacgcagtggaatggtgtgttgctactaagagaatgaagtaagtttgtgtatttgacatagaaagatgcccaaaatagttttgttccattaaaaacaatgcagcttatagtaggacaatagtttatatagtttgatgctactctattaaatacacacatgtgcacatgcacacttacatacatgcacacaaacatgcacacacaatcatacagaacccaaagtctggagggataaactccaaaactccaaaattctaactttatactactctataggggatggcagaggggaacaggtgacattttcttctttctacttttctgtacttccccgccccaccccaccccacccccaccttttttttttctgtcacccaggctggagtgcagtggtgaccacagctcactgtagcctcaaacctcctgggctcaggtgatcctcccacctcagcctctggggtagctgggcacacaccaccacacccacttgtctttttgtttgtttttaaaacgactgtacattacttttataatcagttaaaccaataaagtgacttccactttgaaaaaggaaaaatgtaacaagtgacacatttcacaagtcaagcctttgaatgcattcagtctctcaatcctaggatgcccacatggcttactatgtagtaaaaacccatgctcacaacttttgaaaatgatatgaaaatatcaatttctaaaataataaatctagacactgaatcaggtccagtggtccacctgcccttcattgccttttctgaacaatcattctgaaatcagcatcagataaaatttgatgtctccattctcatctcttcttgaatagttccatgagaactaatgaaagttggctgagcatggtggctcatgcctgtaatcccagcactctgggaggctgaggcagatggatcacctgaggtcaggagttcaagaccagcctggtcaacatagtgaaacccctactaaaaatacaaaagaaattacccaggcatggcagcacacacctatagtcccagctacttgggaggctgaggcagaaggatcacctgaacctgggagacaggttgcagtgagccaagatggtgccactgcattccagcttgggtgacagagcaagactgcatctccaaaaagaaaaaaaaaaaaaagagagttaatgaaattagaaatctgctggggaaaatgagtttatgaatcacttcagaaataatacttctccatcctctggacaggaatcattttagttatttaaaatgttttcactggacagagtacaggagaagattccgaggcatgccaatcattttgactactcttacctgtgtgttcatcctaaaaaacaaagctcttagcatcaaatgaaaaattgctttcataacctgactctcacagtgtcacatggctgctgacagagctgaggctgggagatggggctttttgactccagattttactatagaattaaatcagaatccctgggatggtccaggcatgtgtagtttttaaacggcctgcaggtgagttgtaggtagaaccagagctaagagtcactgccttactagagttaaatgtttccacaagagtacagaacctagccagagccaactgatgttgccctgggcacactggaggtgtgcgtggaaaatcacttgaggtctgcttttgaaagaaagaggtggcttgatataaacattgaagtttccatgagctcctaaaataggaactacctttactaacacgcaaagtctaattttagtcacgttagtcaccatgttatctaaccctgtgttattggttagacagcatagcgcattggcaagaaagggctgaccaaacacagcctgagctttcgtcctgggatctggaattgccgtgtacttgctgcaagtgccagcccaagtcacctggatccacagctgctttgcaaaaattagaggtctggcttggatgacctcagagatccaagactgatctgaaattctccataattctattttgagtggacaatactttcaaataccccaatagaacagcagtaaagattcacaaattattattatggaggccagagtctatcacacctttcagatgccccctgctcaaaacaacaaaaccttaatgttacattgcctactttctgtttcgtcccctcactttcctcttgttttctctttgataatatttcttgctttgttttaaaaggcttaggaaacaaatatatcaaaggatgttattagctgttagccttaaaaaaagaaattcaactgcagtggttataaaatatcagcattaaggcagtgcaagaagagaaatggcgccgccagattccagctgtccaggggagttgcacgttcagagtatatttgctatgttgatgaatgtgttgatggggaaaccagttttaaaggatggatcttggcactgtgctctacaaattgtgaaatcgtgactctcttagtacaggagaagtaggagatcccaaagcacagactctgctacaaatgccttccttctggcttcacccactggaccccaggaacttaatctggaaatcacagtagttaagagatgtctcaagtctggtgacctggaagcagagcctgagacaggattttttgtttaagtcagtgatcaagaaagtgctctcagaagtgaggaaagcaggatagagcagggcacgtagctgaatgcagatgcggttttagctgaagagtagcttcagcctgaccccatggggagctctggagtatgaatggcatacccaggttacatcacttgaagcaaggaggtcagactttttaattcctgcaggaggccattattggctgtagacagcacctctcccttgggatgggcatgaggggctgcaacacctctcaggcttttctggttcaaggcagctcccccgagctgaggcacttccccgaaggagggtacatctgtgagccattggccactaagactcacagcagttggggcctgggtgcccctgcctggtaaaggccaccttgggggagccccaaagagtctactacagggggctgagtggtggaggaggagtggtgtggggccttggagcatctgtgatcaaaattgcttctgtgactgtttttcagactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtgagaaagcccctccctgctatctgattaggttaaaacacacaagatcatcattgttctaggtcagaaatggtcaaatgtcagcaaatctctaatactcaatataaaaaccataaaggaagatctagctctcttataagtgacatgggtcatgcattcctagtgtgaaccccctcttctctattaaacaaacggggtgattctctttgtcctttttgcatgtgatacttgttttcaaaaaaatgacaagggattggttctacagacccaccttgattgcttcatttctaacttctttgtcttccatctctttcacattttctgtaaacgtatcagtgatgtgcagagctcactcacactggctcataaaagctgttttttgtttttatttttgtttttgtttgttttgagaaagagtctcagtctgtggcccaggctggagtgcagtggcactgtcttggctcactgcaacctctacctccaggttcaagcgattcttctgcctcagcctcccaagtagctgggactatagtcgtgcgccaccacacccagctaacttttgtatttttagtagatacggggtttcaccatgttggccaggctggtctcgaactcctgacctgaggtaatcctcctgccttggcctcccaaagtgctgggattacaggcatgagccactgcacctggcagagagctgactgttaagtgttcaggcattttgtgagctgatgtgaaacagatccgttataaaaaaatagaattaaattaacataattaaataaattatttttaaaacaaaggtaataaatactcaaaactcatcacttcctaattattttactgttgcctgtgctttcagggttatttgtgttgtcgtatctgtatggagggaataatataaaggtgtgctactgcccaactccacattcagtcacctggtgttggtagcttgaaatcaaccgtggtgggattatttacatccactatggaagtgggcagacgctataagtcagggctctcccctctaccactggaccggtttttaatatttactcgcacaccactgatgtgtctgcattcccaatctctgccttgagtccaaatatacagtatctagacccactgctcaggatctgagaactgcagtcatttttcctacacccccacccctcggctgcagacaaccaggacagggtctaatggctccctattctttctggtttgggttccactcccactaggtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaaggcattgaaaggtcatttttctagatcttatgtcttgaccctgcaatgtgaatgaggatgtcacccgcaccatcagcgatgatgatgggaacttacagttttatggctcagcacccctactatggacacatactctgcatgtcatcttgtgttaggcacgccacttacacaatctcagctaatctttattgcaaccctgtaggggaggtgggaattatctttatttactaatgagaaaccagaaggttcagagaggttatggaactggcctgacatcacacagcttgttaagagcagagcaagctcagaaccctgagcctgtgctctggcccacactgaagcccagttaggatgatgagaattaggttggacatcattccacaaaagttgctgagatgccatgaacatagaaaagcggagttaaggccaggactagggtaaggcaaagtgcccagggtgcaatatataaggaggtacccactctcagggtcatgtacctgcaaggtcagcccctgagagtgagcacctccttaaactttgctccctaggtgcctggcttgcctcaccccagtcttggccctgaggggtgtcgtgcagattttgagataaaagatacaaaattaactcagactggctcttcctgggcctcatgcatgatgtgaaggagtgagttgtggcaagtggtctccaaccaggacatttctgatgtgtgttgctaaggatggacgctgttcagagggctgattctcattcttgtttttactattatttacttctaggaagtaggcagagccaggcagaaaaattaagtgggagtgtggaatggcgtgctgctgttttttgtagggctgataagcatctgaaaagtggcagtgtgggatccactagagggattgcccaactggtgctgccctggaaacgtccatatgtatgtatgtataatgtgtgtatagatatatatacaaggggccgggcacggtggctcatgcctgtaatcccagcactttgggagaccaaggcaggcaaatcacttgaggtcaggagttcgagaccagcctggcctacgtggcaaaaccccgtcctacaaaaaagtcaaaaattagccaggcatgatggcgcgcacctgtaatcccaactacttgggaggctgagacatggaaattgcttgaacccagaaggcagaggttgcagtgaaccgagattgggccactgcactccagcctgggtgacagagtgagactccatctcaaaaaaaaaaaaaatatatatatatatatatgtatacatgcatatatatatatatgtatacatgcatatatatatatatgtatacatgcatatatatatatacatgcatatatatgtatacatgcatatatatatatacatgcatatatatgtatacatgcatatatatatatacatgcatatatatgtatacatgcatatatatatatacatgcatatatatgtatacatgcatatatatatgtatacatgcatatatatatgtatacatgcacatatatatatagtgtgtgtgtgtgtgtatccattgagacatttttatgattccactgtcacaactgtacaatcagaatgttgaaaacagccacaaaaggatttagaaatggagtgggcttggggtttagaagacagggggatttgtttatcacctcagtcatggtggaatgctgcttagaagctctgattaattctgctaactgtaacatcagctgggttgatttctaaaactaatcaaattgttaaacgtgctataaacagcatcaagaaggacatggatttagtgctgagattaaagggcaataactgccgttgagaggtgtttagcagtgtcaagccctctaactttgcactgtttctagcggagtgagtggacttggcggcagaaatatctttggggataaatttaggttgggctggactgcctgagaactctgatctctgggcagcttcatcttgatcctctgaacctctatgtggaccctaaatttcaagggctagcccaaggaagccagtcctgtgcccctacctgtttgtctgacccattctttttttttcttttttttttaggcagagtcttgctctgtcacccaggctggagtgcagtggcgtgatctcggctctcagctcactgtaacctccacctcccaggttcaagcgattctcctgcctcagcttcttgagtagctgggattacaggcgcctgccaccacacccaactaattttttgtatttttagtagagattgggtttcactatgttggccagcctggtcttgaactcctggcctcaagtgatccacccgcctcggccacccaaagtgctgggattacaggtgtgagccaccactcccagccctcattctttattctctctcatttgctaagtgtttgtaggcagcttgtattgctggcagcatagccccattaaggataatgacctggagttggcctgcatggatttgaatctggttcccccacttactttgaccatgggcaagtcacttcacctctttgtgacccagttgctcatctgtaaagtggaagtggtaagactgtcctcatcggggtgttgtgaggacagtgtgaggtagcacagtgcctggcaggtagtgagcgctctttaaatgtttcctgcagggttctaggtcaaggcaggcatgcagggttagaaaagacacaacacgggccgggcgcggtggctcatgactgtaatcccagcactttcagaggccgaggtgggaagattataaggtcaggagtttgagaccagcctggccaatatggtgaaaccccatctctactaaaaatacaaaaaattagccgggcgtggtggcaggcacctgtagtcccagctactcaggaggctgaggcaggagaatcgcttgaacccgggaggtggaggttgtggtgagccaatattgtgccactgcactccagcctgggcaacacagcaagactccatctcaaaaaaaaaaagaaagaaaggaaagaaagacacaacacttgttcaaacaaagagattagactgtggctccagaaatgattggtaggatgcagcaagtcactcatggaaggaattccaatggcatgtggtgaggttggaggcaggagagtggaccgcagctggtaggaatactaaggggagactctgggcagagtctggcccttctcaggctgtgcaggaggccccatctgtgccaatggtgtgtgccgctcatgatcactggaagagctctatgtgctgctcctgctttcttagccttggaggtgagaaagaagctgagagaggggcctcaaggtgactgagttttgggtcagagcctctgcccttgcttctcctgtgagtgctagaggaaaatctcctggggctagtttccccctcgaccccttcactgctgcacctctctgagtccaacccaggctttgccctaacttgaccttcctttgtccccagaagcaggggaacaactacccagaccaaagccactaccccaggagtgcacttgtgggtggtttgcattcttcacacaacatggatttatctgtctccacgtctgcatcttactaaactcctcccagtcaggaatcttgtcttattgctctttctattcccaccacagcttccgacacattccaggccctccataaatccgtgttgcaccaatctcaggagtcagcatcttttccaaagtggctcaagagccagttgcaccataagaacccacagcccatctgaaggggcaaggcagatacagtgaagtggggcacccatgagagcagctgcttggtggtggggcagacaaggagaagggcatcagaaataagagcaaaggcagagcctggagaccttctcaaaccaaagtgcaaccatagaaagccagagcctcagcaggggtggagaaagctgtgagaggcaccagccagcccaaacccctcattatctacagcaggacctgagcacagtgggcccaggctacaaaaaaacagacaggtgttaccttgaacctaattgtccaaaaaacaagataaaaatatctaccatcagtcctctctactttgctgagaaacatcaggtaggttcaaactagacccagagaactcctgtagggagtatttttccatggcttgaccacaaacatcctgtgttttgagtcatgtacaattacccaggaactgaggaataactgatgtggccatccgtgaccacatctgtaagcagtgatagcttcagctgcccacagtgtgcaaaccacgggtgtctgagagctcagttcatgttcacctctaccacacaaatcttgtttttaagtgctccacaatgcaccctctcctttcttttttgatatcacaagattaccatgtcatgcctgatgttattaccactttcaccaggcagcctgtttctctctttgtataatttctaaaggttcaagtggccctgctgataatgattatgtgagttaatggtacagtattctacccatctatattatattctacccatctatatatctacccatctataaggctttagggagagccttctagcctactagcctactgctttatgcatcctcttctagcttttggaaaatctgtttgctttcctgaaaataccaaacaaactattatcttcaaaacccatgggcttctgggtgatcatgagtcacatacgacaagcagatgtgcatttccagtgtgttacacaggacgctttgttaaccactctgggtgaatgctggttgtggaagcagatacattgctccttttttggcttttacaacctccagaagccacctggaaccttaaataattattggatttgtttttgcttcttgttttttgtttttgttgggtaacttgtgttccatgagtcttaaatttgtcctgctgagctgataggtattatggcctttgacttactcccattgagtccatttccaaaaaaaattgtctatctatagataccacaaaaatgattaggggcctttatgaaacatcagtcagtaacccaatcccttcaaaggtccccagtgtggcttttacaacagtgtcaataactattaaatagtgaagggttttcttttggtggcaggtgggggttaaacatcaggctcaaatgttttgtttgtttgttttttgagacagagttttgctcttgttgcccaggctggagtgcaatggcacgatcttggctcaccgcaacctccgcctcctgggttcaagcgattctcctgtctcagcttctcaagtagctgggattacaagcccaccatgcccagctaattttgtattttcagtagagacagggtttctccatgttggtcagactggtctcaaacaatcgacctcaggtgatctgcccacctcagcctcccaaagtgccaggattacaggcgtgagccaccacacccagcctcaaatgttttttatatgaaggcatctgcaatgttgtagaaaaactatgggattctttcaaggcaggaaactgtgtccagatcacagatctgcccctttattagggaacattgagcggttaatttgcaaccttctcagctgtaaaataacaatagtcattcctccttccccccatgttgtgagggtgagataaggcaacttgtcaaagcacacagacctcactgagtaaagatctgtcttgtctttccatagatttatgaatgttaataggtaattttacatttaaaacacccatctgtgagagataagggctgcacatttccaccctgttttgcctgctgaagccacatatgaaaacattctgtaggcagcagggaaattaactgtgtctacccctcaggttcctcaggttattttgagatccaaccaaaagaagtgtggaaagaaatgtgtaaaatgactaatgaatgaggtgcaaatgcaaaatagaaagtggaatgaagtgtgatattacagagagcctcctcataacgggcagtctgtcttgcccccagaatcaataaactgggcttctgttttagctgggacatgaggtatctcaccacagtccacctgattattatacagtaattttcaaaagaaatataaactgtaaaaccacaatagtgtttcacacccactagaatagctaaaacaagaaaggctgagaacatcaaatgatggtgagaatggacggcaacagaactcttatggagtgctcctgggagtgtcaaatggtgtgaccacctgggagaattgtctggcagattcttatgaagttaaacttacacctactctcatagtccatttagtgttgccataacagaatacctgagactaggtaatttataaagaaaagagatttatttggctcacgattctggtgactggaaagtccaagaagcatggcaccagcatctgctcagcttctggtgagagcctcttgctgtgccataatatagcagaggagtggcaagggaaacgggcatgtgtgaaaaagatgaaaacatgagaggcagcctagctttataacagcccactcttgtgaaaactgatccactcccatggaactaacccagtcttgtgagaaagagattaatctgttttaacaacctaatcacctcttaaaggcaccacctcccaacattgccccactggggaccgaccacacctcaatatgaatttgggtggggacaagctatattcaaagcatagtgcttacctatgagacctaggtatttactcaagagaaaggaaactatgtgtctactcaaacacttgtacaaggatattcatagcagtcttatccataaaagtcaaaaactgaaaacaatctaaatcaccaacagaggaatggataaacaaatgtgatatgctcgctcatggagtactactcaggaataataagggaaagaacgactgatacccacagcaacatggatgagccctaaaaacatcattctgcagagagaaaaaaagccagagacaaaagagtatgtaccgtacaattccatttctatgaagttccagggcagccagaatctgcagtgatagaaatcagaaaatcgttgccttttaggggatgggaagttgggggaaactgactggaaaagagcacaaaggaaactctgggatgataagaatgttctagatctttctttgggtgattgatacaatggatataacaaaattgtacagactcatcacactgaacacttaagatctgtgtattttattatgtgtaaattatttgtcaaaaaaaaaaaatcaagaccaagtatggtggctcacgcctgtaatcccaacgctttgggaggccgaggcaggcatatttggttgagcccaaaggagtctgagaccagcctgggcaacatggcaaaaccctgtctctacaaaaaatagctgggtgtggtggcatgtgctactagggagtggtcccagctactagggaggctgaggtgggagaatcgcttgaggccaggaggcggcggctgcagtgagccataaactccagcctgggtgacagagttgacagagtgaaactgtctcaaaacaataataatttttctttttcttttttttttttttttagtagaaacagggtttcaccatactggccaggttggtctcgaactcctaacctcaagtgatctgcccagctcagcctcccaaagtgctgggattacaggcatgagccaccatgcccagcaaataattttctttttaaccaagggaagatatatatcgaaaggttaagaccgtatgtttggatgttgggtcctacccactagctagctatgtaagtttgggcaaattacttaacctttctaagctttaaatttgtattttataaaatgaatatatgccaggcaaggtggctcatgcctgtaatcccagcactttgggaggccgaggcagtggatcacctgatgtcaggagttcaaagccaacctggccaacatggtgaaaccccatctctacaaaagtacaaaacttagccaggcatgatggcaagtgcctataatcccagctactcaggaggctgaggcaggggaatcacttgaacctgggaggcagaggttgcagtgagctgagatcacaccattgtactccagcctgggtaatagagcaagactccatctcaaaaaaaaatgaagataataaaaacagtattacctaatgcaaatttaaattgcaaccttctgtaaggaaaagcctatttattgtgtgtaccaacactggagcatagtgttgaaagtagaaacaggccctctgtacatatttgatgaacggtgaacggctgttgaactaaaccaagcatcaccacattttttttttttttttttgagctggagtttcactcttgttgcccaggctggagtgcaatggtgcgatctcggctcactgcaacctctgccttccagattcaagtgattctcctgcctcagcctcccgagtagctaggattacaggcatgcgccaccatgccaagctaattttgtatttttagtagagatggggtttcaccatgttggccaggctggtctcgaactcctcaccacaggtgatctgcccacctcggcctcccaaagtgctgggattacagacatgaaccactgcacccagcacatgaccacatttaatacacttctacagcacattaaggaacagcttcactatcatcttgaaactggatggcagttggcagagtttttccatgagtgtgccatctataagtgagctgcatgaagccagtcccagggcccacacaatttcttgtctcctcagtgcaaccaccaggctagaggagaggcagttgggtccagggaagcagtgaacatcatagaaatagcacaggctttgtaatcaggaagatgtcgacttcattgccagtcttaccacttcctagccttagtttgtctgcgaaatggtagtgataatgcctcctatgctagattgcatttttgttctaaaatattcaccacccctgctgagggaggattagacttggtactgcattgaccacagccttggccatgtgggtttgctttggccaatgagatgtgaacagaagtgagcctgccacttctgagagaagcctcagcactcatcatgtggttcacattttcaaactctgtcgcaagactgctgtgtcacaaatagaggcttcttcaacttggatctggaattcagaagacataagccagagctgcagccaactcacaatgaatatgtaaagtgaacaagaaataaacccttgttatactaaccattcagatttggggatcatttgttgctgcagcataatttagcctcagctgatttacacactccctcaaggatatcatgaggatgaacagcctaacattgtaattgatcctctaccatataccagttatgtggagccatgaagttcacattctggtgggaaagatgaacaagtaaaaggaaaatcatgacttcctgttaaagatggctttactcccttcatacaccctactataatgggttttcttagaacatttttaaagcattttaaaacatttttaaggtacaatttttttgtatttttaaagacataaaattcaaggaagaaagagaaatagaaaggaaaaaatatcgtataacatttcatagagtagaaaggtggtaactgatccagcagatgtgaaagggcagaatcctaagccaacagtgggaaaaaccaagaagaaatctgctttatcctgcaaagcctcaagaattggcagcaagtctcctccagaactgggggcaaatgtggggctaaggtgggaagagccactagagccccagatggtctccttgccaacaagcagccaaacaactgttcttccctgagctgacagaagagagaagtttcttttcctgagatgagagtccctgaaccaaagatcccagtcacactgaaggtggaggtactaagctgaacacgggggattgagtaaaactgaagtactgagcatgaggctccatccttccttccctggtgcccatgggtatgtttcttcccttcggtagagaatgacttcttctctgggggcatctgaccaatctaagagaaaagacccaaagatattgatgttatgggctccccaggaagcaatctggccatatcaccctactgagaagcccagtcaacaagcagagctattccaaatagcattagtgcctcactttaaataagagcagtatatagatccccagacatctggtgaagcctaatgaaaaatacaaagactaaaacaaatgaatagaagaaaagccacttgcaggaaacagagactatagagggagaaaaaactaaaaatcagctatcaagactctcaagttaataagaagagatgctgcgtttatgtaaaaggaaccggttgtaatttttaaaaagggctttcaggagaaagctcgtttttaatctccaagagttcaaaggaactcttggagattaaaaatatgttagcagaaatgaaagagtcaaaagggctgaaagataaagttgaggatatctcccagaaagtggagtgaagaaaaagccagcgcgatagaaagaaagagaaaatataaaactcaaggaccagtcaaggaggcccaatatccggatagatggagttttacagagaaaaaatagagggaagggaatcatcacaaaatatttcaggaacatttgccaggactgatggatatgagttgccaactggaaggggccaccacacacaatggatataaatagacccacaccaaggcacagtattgtaacatttcagaatatcagggacacagagaccctacaagcttctagagaagaggtaaaaaagttttatacggaggaagaagaaaccaaatggcaacaaactttatcagcaacactgggtattataaaacaatggagtaagatcttcaaagttctgaaggaatattatttccaacctagaattttataccaagccaaacaattaagtgtgaaggtggaataaagacatttttagacctacaagatctaaaaaaatttacccccatatatactttctcaagaagcacctgaaggctgtaatccacctaaaaagaaagtaaaaattaaaaaaaaaaaaaagaaaagaaaagatggatccaggaagcccaggatctagtccaagagagaagcaaagggaatcccatgataacagtgaaggagatccaggatcacacctgagcaccaggcatcaagagcagcccctttagattagagcattgaaaaggctctggagagatttcttaagaagttgaggaagtacctaatgttttcaaatttattgaaaggagatttatacaagtggaagagagtttgggtatcaaattattgataagtacatagaaactaaggaaatgattaaaatgataataattcactacagggaacacaaaattttatgcagaaaggaaaaatcattatagcatgcaatatagtgtagctacctaaacactgttaatattattacatagtcacgattacacaaacatagaatgaagatctagctgaaaatatgacgctaactatcaggaagatgggagaatgggaatgggaagtgtgtgtggtgtgagtgttcgctagtctgtgctgtgttgtgggggtgtggggtgtggagggggtgtggggtgaaggaggagaaatccacatcttcctgagtgggaagccaatagacagtgcctgaaactgaaagatccataggcagcaatggaacggagtgtgttattgagcaatggaacagagcatgttttactgcggttatcccaggctcctcccctggggtaaccacagtcacggatttgttatatttctctccatatcttttttctcttcatctgcatacataaatctgtacatataaatagctgttttgtttcacagatactcaggaggctaaagcaggagaatcgcttgaacctgggaggttgaggctgcagtgagctatgatcacgccaccgcagtccagcctgggtgacagggtgggactttgtcccccaaaataataataataataataataaaggctgagaatctctgctttaaagtatgtgcatgcatggctttggtaagatggaaatgagggaagagcgggtggggagaccactgcagtgtgtggcggggccttggtaaaggtaagcagggactgcagaagcagaggggcttctaacacggctttggggtggggaggtgtcctgcaggtaacaatgaaggtgagttttgaaagacagtaagaaatgagctggatgtggggccaggtgattgaaaagctgactattttccaaatcaaattatatttaagttagcagcattagaatatatacttcagctctagacatggcatctctctaattaaagcactattggatgtgatgtcaaaatttacgtggaaaatagacagcaagaactacagcaggcaattaacagatatgacagccataaaacattttcctaattgtgctactaatttgacaccgagcttccctgcagccagttcaagaggagagagtccatcaattatatggttcctgttatgaggaagaaggaagtttagcaggcctttttggaaatagagctttcccagttagaattgaactcattcgccggcgctgatgggtgatattgtcaacacccttgaattgcaaagttagcaccactttgcacaggcgccttcctaatctgatgggcttttttttttttttttttaaacaaaagaatgaatgaaattcaaaagcaactcagtacaagttgatccccaggcatctgtggtgtagagctttctagggataacattaaaaagtgaaatgagtcttttataaaccaatctggtaatctattctaaagagttgaaaaggtatccctattctttttttcttttcttttctttctttctttcttttttttttggagacagagtcttgctctattgcctaggctggagtgaaatagcgggatctcggctcactgcaacctccacctcctgggttcaaccgattctcgtgcctcagcttcccgagtagctgggattacaggcgcccaccaccatgcccagctaatttttgtattttagtattgatgaggtttcaccatgttggccagactggtctgcaactcctgacctcaagtgatccacccgcctcagcctctgaaagtgctgggattacaggtgtgagccaccatgcctggcactgttcatttatttctaatggcaaaattatagaaatcacctaaatgaccaataatccagcagttttccaaatgatgcaagaaataggtaactatgttcttgttagaaatttaaatattataggcaaagctaaaatcctccttgaccactcagtctgtctttactcccaggcccctcctctggggtaaccacagtcacggatttgtcatatttctctccagatcttttttctcttcatctgcatacataagtctgtatatataaatagctattttgtttcacggagagattttaccatctgcattgtatcatactctacatattatctacaacttgctgttctgctcaatatttatatttaggttttcaaatctccctcttttttttttttttttttttttttgagacggagtcttgctctgtcactaggctagggtgcagtggtacaatcccagctctcaacaacctccgcctcccgggttcaagcgattctcctgtctcagcctcccaagtagctgggattacaggcatgtaccaccacacccagctaatttttgtatttttagtagacacggggtttcaacatgttacccaggctggtcttgaactcctgacctcaggtgatctgcccgcctcggcctcccaaagtgctaggattacaagcgtgagccactgtgcccagcctccctcattctttttaacagctccgtaatattccattggtgaatgtccccatagtttatctattccagtataaggtggtctctagtttcccacaatcacagtgctgcagttaaacgtgggcactcatggccatgtcacactgtttggttcccagaagagacaagagttcattcttttactaattcccatgtttctgtaacagggtgttccaggctcccactggccgtgtgccaaagggcctgtttcctgtagcctctccagctttcagtattgccagacatctacatttccccccatctgaggagtgggatacagtaacactttgttttaacttgcattttctgattacaagtgacattaagaactttctatattttaaatatttagtcatttatatctcctttcctgtgagctgctcaatcattctatattgcaaacactttctcccgacgtgtcccttgtcctttaaccttatttgtagcacctatcatcagacagatattttaatctttttttcacttttataatttgtgtttatgccacatttttaatgattttctctttgtttttattgtagtgaagtccattatttttctttttaactgtcttttatagttattgtaatgttgccttaataatacgttttcccaacattatccatccatggtctgatatgccattttcttcctcaggagaggttttctaccaatttttgccatttcccgtgttgctgctgatccatgcttcatgcctgttttctgtttgtggtttcagataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagtacgcccctgaatcagtgcatttgtccctggccatggatagctcttctctccccgccttgccttagtggggttccctgggtaggttgtaaatcatatcaaaaaggcccatctggccgggcacgatggctcacgcctgtaatcccagcactttgggaggccaaggctggtggatcacttgaggtcaggagttcaagaccagcctggccaacgtggtaaaaccccatctttactaaaaatacaaaaattagctgggcatggtggcaggcgcctataatctcagctgctcagaaggctgaagcaggagaatggcctgaacctgggaggcggaggttgcagtgagccgagattgcaccacgcactctagcctgggcaacagagtaagactcaaaaaaaaaaaaaaaaccccacccacagtgcaggtgagcaagggtgaccaggaggcaagcagagtgggtgtcaacacgtccctttggaccagcctcaggtagagcctgcagccctcagaactgtgtcatactgccccatgttcaggcttatgtctctctgcccagccttccaatcttcctcttgtgagatcctctcctctcttgctcagacttccccagcctctcccatccccatccccccacaccccacacccccacttccacactcactgccctcttgtcttctctcacacaagactgtgattcctgaggtcaagaactttgactcgttctatttttcatccagttagcccctaccggtgctggacatgcactagtcacttgaaaaatgtttgattggccaggcacagtggctcatgcctgtaatcccagcactttgggaggccgaggcaggcagataacttgaggtcaggttatcaggcagataacttgaggttgggcaggctggtctgccaacatgtctgcccaacatggcgaaaccccatctctactaaaaatacaaaaaattagccgggcatggtgttgggtgcctgtaatcctagctactcgggaggctgaggcaggagagtcgcctgaacccgggaggtggaggttgcagtgagccgagatcgcaccacttcactccagcctgggcaatagagtgagactcggtctcaaaaaaaaaaaatgtttgatgactgaaggccagtaaaccaacagccacctccttgctgggctaccatgacttctgatgtgtgctcttagttcaaatgcaggaactaaggccacaagaggcaaagtagcctgcccaagaacaccctattaggaagtggcagagccagaagacgaactaacatctccccaacgccactcacagctccaaccactgcccagaactgcctcctgagcaacacgtctgggtggagtgaaacctgtgccctgccccatgacacttagcatctaagacacagatacacagaagaaaaacttaagcaaaaaaggagaggaaatttcaaccctgagtactacccagaagtttgtttgccagcttagtaaacagtaagaatgtttactaagagagcagagggaccgctagaaaaggaacacagaggagccagaagcagagggcagggtgggagaagagagaccgaagggaaacacagggcagcatgcagacacccaacctcaggctgacgggagagctggggagggtgcacttctggtctcctttgtgcatggctagcatgccccacttcttccaggctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaaggtaaggggggtctcccctatctccatgcccctttagtttaagcgtttatttgattttagttttgtgatcaccttaattaagttgccagtttggaaagaagggatagctcaatatgctggtccttgcacaagaaatttgaaagatagtgagtcctaatcctgactttaccattaacctagcatggaaaattcctgagattagaaataaaaaatgtttctgacagtgagaggcgatggttggtaggcagcaaaaacattatcaggtttgagtcttttttggaagcaggcaggacgtaaatgagaaatagccagatattccccagtcccggatttttaaggtagtgacataaaaatccttaggcagacatttttatgactctgcttttacaattcagaatgcagtgccgagagcacagagggaggagcgttgggagggagacgagtctctggagccagagtccagcagcacggctgggcagacccgaccctcctgggaggctggcatgtggtctccatgttctgaggcagtaaatgaggtctaaatggctcacaacgtgacttctacatggttgactttaaaagtcacagtcaccattacaagttgctccaagaacattaagttagaggccattttaaaattgaccaagacctttgatgtttatttcctactcttattctctgaggtgtgagtgggagggagaagaatctttggtcataagattaaggtgggtccaggctgcctgatatctccaaggttaccagagaaactccttctgaggagtctttgcaaataagacacattctcatcagtgtggaatgtgtgggttttatctctcctgaaggtaaggaagggattagttgacgtgtcaggagctctttcagctttgcagttccggaactcttcccagaacctgaagatattttaatctctgaaacagaaatcaggctataccagccccaccccggagagggcaatagatgaatatagtagctacgttgagagcatttctgaagggaagctgagataaccaccagtttgggaaacttgcctggtttttatttgcctgtttgttttgttttttttcaaaagtcctgagtacctactctgactgagactgatccagcactgaccaatacagtggtgctagccacatagcaatgatttgaatttaaattaatatgaggctgggcacagtggctcatgcctataatcccggctctttgggaggccaaggcaggcagatcacttgagctcaggagttcaagagcagcctggccaacacggtgaaaccccatctctactaaaaatacaaaaaattagccggtcatggtggctcatgcctgtagtcctagctactcgggaggctgaggctggagaattgcttgaacctgagaggtggaggttgcagtttgcagtgagccgagatcgtgccactgcactctagcctgggcaacagagtgagactccctctcaaaaataactaataataataaattaacatgaaacaaatttaaaatgcagttctttggtcatgctgggcacatttcaaggctcagcagacatatagctggtggctaccctatcagatggtgcagatctagaagatttccatcatcgcagaaagttcggttagacagcgctggtctggacagttggacttcgtctcctccaccactccctttcctctccatgttgactgaatgaaacatctgtctggatctccctccctttcctgcagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtgggtaagggccttcagggtctttggggacagtgatgaacaaaaaattgtcagctggaggatagagagcaagcctggagacaagtcagaatcacagattgagtcctgactgtccatgtatcagtcagctattgcatcaatagtgctgagtaacaaaccatcccagaacatagtggcttagtagcagccatctattattgctccaacgttggctgggcaattctggtctgagctggacttatcagggctcagtcattcatgcacctactggcagctgcaggttggctagaggactttgctgatcttagcttggtgctttcaaaaagctgaggctcagccaagatcatctgagacaactgagattacttggcttgactctacatgatctcttgttctccagcctgggctgttttcatggcagaggcagagagatccacaagagactggaggaggcatataaggtcttttgatacttttaggttaggaactcacacaccatcccttcgactgcattcttttggccagcctagattttttttagtcaatctaccagcatcctttaccattcatctctcttttacgtaggggaagtctcttcacacctatgatcttcctcatctacagagagtagataataatagccacctcataaaagtatcatgggattcggtgtcatgaattaaaatatggggacctgaaaagtctgacaggtacatggttttttgtttagtctcagtgaaacgttggaatccatgaaataccctcagtgggaggccttggagccaggatgatgagtttgcctttattcctcaaagtcatgggcaccactaaagggtatcaagcaagggaatgcaggtgtggcagggcaggctgtggtggggccatgtctgccctttactcagtgaaggcaccgagcatcacagtgtcagaatcagaagggactgtggaggctgcttttttccctttccctttctgggggtcagagtgattgaaggtccatccaagccacacaactggttagcctcaagagaactggtgggagccaaatgccacaagtgaaaacctctccacactcatagattatatcctgggttttcttcctctcttagattcattttctgtcatttctttccattcctctttcctttggatctcaccttttgttttcttggtgaataagcaagacattctaattcgctgtttggtacagggttccccctctgatttattttctttttcctttgtgcagctgcaggaaaaggacagcacaaaggaaacaaccctccctttagctgcctcacttctgacttttgactccctgctttctcctaccctcctctgctcttctcttctccaagacaggctgtggcaatcagtggaacacacctgttgtaggccaggagtagcctttgaagttgatctggtaggtccctcagtttgtttcaattgttcattgctatatacaaactaccccaaaatttggtggctttggcaatagctattttgtttacccacgatttatggatcaggaattcagacagggcacagcagtgtatcttatctgtgctccaggatatctggggccccaaccagaagccttgaacaagtagagaggatggcttggagaattcaactggagacatatgtctatggcctttggttctcactgggttgatttttttccccggtggaatctctacatggctagcttgggctttctcacagcatggtggtctcagcatagtcagacttcttacatagtagctggctttctctcagagagaaagtgcaagctgacatcctcttaaaagttaggcccagaactggcacagttgccttatattggctgacccagatccaagaggaaaggaaataaacactttgtgatatgaggagccccatgtgcacacaaggagccacatgtatggcgctccacctttggagagatggcagctgcttttggagatgcctcaagttcattgcagagctcaccccagctgcctcttcatctgtctctttatgtctctgctcacagacttgactgtcatcctcatcgcagcggtgggaggtggagtcttactgctgtctgccctcgggctcatcatttgctgtgtgaaaaagaagtaggtggaatctcttactctctttatctgatttgatgcctcctcagatcacacagactgggtggattgttcattattgactttgttttcttgcttcccattttttcccccaaagatcaatgttaaacaatattgccaggtgtgagtcatgctttcaggagaaaaaaaatcccatgcctgggggtgagggggggataaaacacacgtgacattttcacctgtatgtagttcatggtgcagctgcctcagcacaagtcccctgcaagcagagtgctgtttgctcagtagattgatcaagcaggagtgatcttggcaagaaaatgctcacgtaggctctgccagactgtgcctctgaaaccactccctccgtcaccctaaggagaacgaatgtgtgttgtcccagcttgttctcctgcagtttcttaagcaaactgctttatccttgcctgttgggctccaggtatgtaacagaggccaggcctgtggcccagaggaaggaaggcccagttaactgcctcagtctctctttccatcccctcaggaggacaacttctgttttatttatttatttatttatttttgagacagagtcttgctctgttgccagtggtgcaatctcggttcactgcagcctccgcctcctgggttgaagtgattctccttcctcagcctcccgagtaactgggactacaggcacacaccaccacgcccagctaattttttttgtatttttttgtagaaacgggatttcaccttattggccagattggtcttaaacgcctgacctcaagtgatccacccaccttggcttcccaaaatgttgggattacaggcatgagccaccgtacctggctgagcttctattttataaaaggaaaatgttgacctttttagacagagtccgtgctgccgccaaactgtataaattctgctcatatttctgactaaagtcatgggagagagaagagagctattttccttaacatggtttgaccttccaaaaagccaatctgaaaaaattctttttttttttaagacagagtctcactctgttgccaggctggagtgcagtggcgcgatctcggctcaccgcaacctccgcctcccgggttcaagcgattcccctgcctcagcctcccgagtagctgggactacaggcacccgccaccacgcccagctaatttttttttgtatttttagtagacacagggtttcaccatgttggccaggatggtctcgatctcttgaccttgtgatccacccgcctcggcctcccaaagtgctgagattacaggcgtgagccaccacacccagccaaaaaattcttttttaaaaattaactgtggacctgagcaaagaactgaaattcctagtctacaacaagactgtctacaaatgtctctgctgatgaggaaggactggcttgcaggaggtcttttccccatgagaagtggctgtacctataacacatgggggaaaaaggactgcttttaaggaaacatcatgttactgtttctctcagggaattttcccatctgcggtgcacggaatagcccacccagttggggaagcatggcattaacactgggccccaggttccttatcaggagggaattggacaaggaacgagatccagcacttgcctcatcttgaaacagcgccagtttaagcctgagaatcgtcagtccagccttgctacaggccttgcttgtgtgaggctgctggctggcaggtttgcataaggcctgtccgtgcccaagctgttgtaggaggatggacaggttgtgcagtgagaatgaggagagacaatgccatctaacatgttcactaagcgggtacttcctgagtgtctcctgggcactaggattcattgaggtactggggacaatgatgagtgagacaatctcttctatgggggcagggggactgaaaagacaggcaaataaacagtcagtttcaggatagcatgagaagagctttagtggggacaaacattacagggcttcaggcaggagccttaggaacccatcctcctggccaggggctcagcgttacaagctgaaggtaccaggtttatttttatctcagcaaagtacagacagcctgtccaccattatgaactgccagcctgtgccttatatggcccattacgctaattgagctaatgtcctccatttgcatcactggtcagctaaaaagtcagcattccctgctgtttggttcacaaagatggagagcaaagctttgttttctgtggcagcaagcgctaatgcccatgcaggtccaagtaccaaagaacattataaaccaaatgctaatggtgttattgaagaactctggcactgcagcctgaattttgtcttctttttagctctttcctctgttgggggtgactactgaggcactgggtctctctgctaatgctgagttatcctctccccagctcatactgaaaactaagatacaacctggcctcctgagtctcttgtatcgccatttaaaatctagatggtcagagcttttcccaggcaaaagagagataaagcatgagctacgggaaagtactaagagtgcgggaggattgacctaggcatgactgagcctgatgtggttgagaaggtctgggacactgcccatttctggtagaatggaggggaaagagattgtcagatgtctccaccattggataccgcatatctatcaaaaacgaattgagcacagatagtgatagaggtgccctctctaaaccactcttctactacctgtgatctctgtttccactttgaaaactggagacaaaatcaggtcccttctaaatgttcactgaggacagtagtttcagtttcaaatgctgagcaatctgagggatttgggggagacatggtcagaaccctaaagaatccaagctctagcagggccatagcaatggtacccatcgaagattcttgcctttctgacttctgtcttgttccatttttccaaataggaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccaccactggttttcaagtctccctgtatgcaagtggaaggaatggaagctatgccaatgggtagctgagaggccagggcttgttctgttctgttctgttcttgtgggggctacatgggccccaccctttgtgacctttcccaatacctaacccccatagaggcccagggccaccctaatcactgaccacagttgatctctaagccccgtggaggtcaccagccaccagaacaaaagttaagggagagcagtgagagagggaagttcccatggcccccaccatctgccatgcactaggaggggagacccaagcacattggattgaatccaccgagaaaaccagatgttgctgtgtaatgagccaccccaaaatttagttaacaattagtagttttgctcacaaacctgtaattagagcagggttcagcagggactgtatatctctcctccatgtggccacagcttgggcagcataattagaatcctctttcaagtgggctccatgacactgctgacaagttagtgctggctattggctgggagctttgactcctggtcacttggaccactgcacagggcttcttcacaacatggtggctgggttccacaactgagtgctcccagattctaaaggtcagaacagccagtctctcagaggctggaactggacactggcatgacattacttccattctattcctttttttttttttttttttttttttgagacaggttctcactctcttgccccagctggagaactcctgggcttaaagcgatcctcccacttcagcctcccgagtagctgggactacagccatgcactaccatgcccagctaaacttccattctattctatggggggcattagtcacagaacctactccgatttacatggaggaagcaaagattcccccaccccatctcagtgggagaggtgtcaaagaatttgcagccatctgtaataggcttcagtggggctggggagatcacagccaagtaccatgcctgtggacagcactgaccaccttcactactgcgtccttgatcaccatgaccacatctgggctgcatcccacctctgactgccccttctcctggatcctgttcccaggactcaaggttcagtctttggtcttctggccttttctctctggacactgccccatagggagggtactgtcttagtccatttgtgttgctataaagggatacataagcctgggtaatttatgaagaaaagaggtttatttggctcatgattctgcaggctgtacaggaagcatgaaacccagcatctgcaactgatgagggcctcaggctacttcccctcatggcagaagacaaaggggagcctgcatgtgcagaaatcacatggtgagagaggaagggagagaatggcaggggaaggggtggcgctaggctgttttcaacaaccagctcttgagagaactaagagaggaagaacttgccgtggacccaggaaaggcattaacctattctgaatggctatacaagattacatcttctaaggtcacttcacgctctagaatgctttgattcctccagtcacccaggcccagaatattggacctaacttcatttcatccctgtcactcaccctgattgttctagattctcctcccatccaacatccccctctattccaccattcctttttcatcatgtgactccctcactctgaaatctgtgcctccagacttggttggcccttagaacagaatccttggtcttttgctggtggtgtggcacctccagtccactgcctggccctcctaacctcttcagacctctctccgcccacttcatccatgacttcaaaactctattccagtggggctctgaatccactcctgcccacaccttgctcttgcccacaccttgctcttgcccacaccttgctcttgccattgttcctggacaactcacagcaaaagctgcccaccttccatgccttaccagcacttcagagtctatcacagagcccattttctccaggaagccctccaactctgctaagctctccttctaaatcccaatagtccttttgattcataattcttctgcatgtagctgtattagtttcataatttaaaaagcttgtgcttgtgtgtcttttgcttaaccaagatgctacttttttcagaggtagaggtccatgtcttgtacttagtccatctgtctcacattgtccaatgcagtgggtgccctagaaattatgtctgttacatttaattgtcagaaacatgttgtacttcagctatgacttcaggcaggtgttatactggaggcttccagatggcaaggaggaagtagatgtcaggcaagtgccctgtgttttacaaaccttatctcatgtcaccaattaatatcctagcagcaaagcttattttcagcttactggtgaaagaaggcccagcaaggtgaagtcacgagcccagggtcacagagcagcaagaggcagggcagcaaccatacagcctttccacagtgctctgctactcagctaggccatgagactgggttctcctgggagccacagtcgggagagtggctgccgaggagtctggtggaccccagggcttcctagatagtgtttgtctctttttctttccttcaggaggccacaagtttgaggtggaggaggtctcagggacactgaagcacaatatctagtcctaggcacaagattaaatattctaaggccacttctaactctagaatgctttgattcctccagtcacccaggtccagaatattgaacccaactttggttcatccctgtcactcatcctgattggcatttctgcttccacctatatgccctgccctttctggactttgtgttggcagctcctcccccaggtcagggatacttggggatctgatgttaaagccacagggcaaagcacctatagccctccaggctgctgccaaacctgtctcctttaccctcgccctgcccttcagacccagcctctcatggacttctgttccccacggaagaggggagtcctgttcacatctgtgtggtctctgggatcatctctaatcagtgccacatcaaggcatcctcagccagtcctggggagcctgcaaacgacacccaacctcacagctcactgttctgtttgggcggttcacaaggctgtttcttggctttaaacgtgcttatgacgaaatgagaaaggtggaactcagcctcctgctggccaattctctcctagcctcaggcttcataagaacaatttttttttttttttgagacagagtctcgctctattgcccaggctgaagtgcagtggcatgatcttggctcactgcaacctccacctcccaggttcaagcgattctcatgcctcagcctcctgaatggctgggattacaggtgtgccccaccacgcctggctaatttttgtatttttagtagaggcaggcttcaccatggccaggctcaaactcctgacctcaggtgagtctgcctgccttcacccagcaaagtgctgggattacaggcatgagcccctgtacccagccttaagaacctcctaatgatcccatgagttatatggatgaaccagcacggcctcttctctgccctttaatgtaggtgtattagtccgttttcatgctgctgataaagacatacctgagactgggaagaaaaagaggtatagttggacttgcagttccacatggctggggaggcctcagaatcatggtggaaggttaaaggcacttcttacatggcagtggcaacagaaaaatgatgaagatgcaaaagcagaaacccctgacaaaaccatcaggtcttgtaagacttactcactaccatgggaacagtatagggaaaactgcccccatgattcaaattatctcccaccaggtccctcccacaacatgtgggaattatgggagtacaattcaaaatgagatctaggtggggacacagagccaaaccatatcatcccacccctggcccctccaaatctcatgtcctcacatttcaaaaccaatcatgccttcccaacagtcccccaaagtcttaactcatttcagcattaacccaaaagtccacagtccaaagtctcatctgagacaaggcaagtctcttccacctatgagcctgtaaaatcaaaagcaagctagttacttcctagacacaatgggggtacaggtattgagtaaatacagccatttcaaatgggagaaatttgtcaaaacaaagggattataggccccatgcaagcctgaaatccagtggggcagtcaaatcttaaagctccaaaatgatcttctttgactccatgtctcacatccaggtcatgctgaaacaagaggcgggttcccatggtcttggacagctctgcccctgtggctttgcaggatacagcctccctcctggctgctttcatgggcgagcgttgagtctgcggtctgcggcttttccaggtgcacagtgcaagctgtcagtgggtctaccattttggggtctggaggacagtggccctcttctcacagctccactaggcagtgccccagtagggactctctgtgggggctccaaccccacatttcccttctgcactgctctagcagaggttctccatgagagccccgcccctgcagcaaacttctgcctgcacagccaggcgtttccatacatcctctgaaatctaggctgaggttcccaaacctcagttcttcacttctgtgcacttgcaggctcaacaccatgtggaagctgccaagccctgggacttgcaccctttgaagccacagcccacgctctacattggcccctttcagccatagctgaagtggctgggatgcagggcaccaagtccctagactgcacacagcacaggtaccctgggcctggccctcaaaaccatttttttcctcctaggcctctgggcctgtgatgggaggggctgccatgaagacctttgatatgccctggagacatttccccattgtcttggggattaacattcggctcctcattacttatgcaaatttctgcagctttcatgaatttctcctcagaaaatagatttttcttttatactgcattttcaggctgcaaactttccaaacttttatgttctgcttccttattaaaactgaatgccttaaatagcacccaagtcacctcttgaatgctttgctgcttagacatttcttccacagataccctaaatcacctctctcaagttcaaaattccacaaatctctacagcaggggcaaaatgccaccagtcactttgctaaaacataacaagagtcatctttgctccacttcccaacaagttcctcatctccatctgagactacctcagcctggactttattgtccatattgctatcagcattttgggcaaaggcattcaacaagtctctagaaagtaccaaactttcccacattttcttgtctttttttgagccctccaaactgttccaacctctgcctgttacccagttccaaagttgcttccacatttttgggtatcttttcagaggcaccccttctgctggtaccaagttactgtattagtccattttcatgctgctgataaagacatacccgagactgggaagaaaaagaggtttaattggacttacagttctgcatggctggggaggcctcagaatcatggtgggaggcaaaaggctcttcttaacatggtggtggcaagagaaaaatgaggaagatgcaaaagcagaaccccctgataaaaccatcagatctcatgagacttattcactaccatgcgaacagtatgggggaaaccaccctcatgatttaaattatctcccaccaagtccctcccacaacacgtgggaattatgggagtacaattcaagatgagatctggtggggacacgagctaaaccatgtcagtagggacacagatctaaaccatgtcagtaggtaactgcaagagctagactatggtcatttgagacccagccaacaaacaagcctaggaaaagattagctatagtctacaggactcagaaagagggaagatctgaaactgatgtaagaaaagagctccccaccccagccttctgcccaggccagcagcagtgcagcagcagcaaacgctctcgcctttgttccctctcccattttcaacactctgactgcccagcccgcatcctcaagacccaggaggcagcttcgtggtcatgtaacctacgcgttacacagagcctgcaactcggaagggccccacacttggtctctgctgttgccagctcaaaattcttaataatttttgaacaagggacccagtgtttttattttgccctgggctctggcaaattaagtagccaggccttttcagaggatgaggcagtctctgagaggttaaacaacctgtctggggcttcacaactaagagacagaccgagatttgagtcctagtgtgtcttaaactccatcagcctctttcttcagggtgctggcctctgcttgctcacccaaactttccactcctgtgcacatgatttttaaactctatcaacgggccttctgtgccacacctttataagctggctaaaactcatttggctgatcatctaaaaagagaacgtttgtaaattggcctatagacagaataggtctatttagacaggatggactacagaactgcttatgttcaagacagtagccagcagctacatgtggctatttaaacttcagtatttatttaattaaaatttcattaaatttggtgctaacgaatacatcaaaatacactgggtttcctttttcaaattaagtgtgcatgattgtatatggaagagactaaggtcccagggtaggaaaactaagaaaagggatatggagttcttacttgacttgaatatgcatctgagggtgctttgtgtgaatacattgcacactacagcatcttatttctttttttgagttgagtttcaataaaatacaattcttcacccttctaaaaaaatgtaattcctcagttgcactagccacatgttcaagctttcagtagctatatgtggctaagtggctactatattgaacagcacaaatatagaacatctctgtcatcacagaaaatgcaattgaacagggctaatatagcaaatgtgtgtgtgtgtgtagtgtgtgttccatgtattgaatgattactatgtaccaagaactcttctaaaatatttatacgaacagttttattgaatcctcatatttaattttcagtccttatcttacttgacacagtatttaacaccatctctcactctctcttccatgagacatttccttctcttggccaccacggcctcagatttgttggttgtcctccttcccctctggcttctccttctcagtctccgtggctggctcccccttttctcccaatctctaaacatcagagggccccatggttcagtgcccagattcttctcttttctctccacacttactcatttggtgactttctccagtcccatgacgttaaataccatccatgtcccaatggctcccaaagtggacctatgccctgaattctgaccatgtatccatctctgctcgagatttccagctggtatctaatggccatctctaatttgaaatatacacaactgatcttctgttgttcccctcaaacctgttcctccggttggtagggaggctagaggaaacaagtttgctccaaatcagttgatggcagctccgtccttccaaaaactttagagttctctctgactcctctctctctcacatcctatatccagtccataggggaccttaacggttctccctgacatgacgaatcccccttcttcctacttccaccactttcacttggttcacaccaacatcctctctcacttagatgatgcaggctctgtgcttccacctaaatcagtctctgtgcttccacctccgccctcttcagcctcatctcaagacagtagcacagtgattctctttgtatataaagcagatcttgcaacttccctgcccagaacctgcctgtggccacaactcactcacagcagaagccaaagttcttcctatggtccacaaggccttgctagtcctggctccatcgcctctttaacaacagttcctgccgggtactctgtcaaccatcctgcttcacccagtccaagcccttgactatcctcgaacactctgacctcacagcctttgcatttgctgttctctctgccgggagagaacagcttgtccaccagataccccctgactctctcttactaagtctttacacaaatgtcaccttaatttctccagtgaaatcccatatggcttcgctggtgacactctctaaaatgtcaagcctttccctgacctccacacttcatatccatcttccctgctttatttttactccttagtatttattaccatgtaacaaactatatattttatttatttatcttacttattgttggtcttccagctgaattacaagcttcatgaggcaggaactgctggtatgttttgctcatccccatccccaggacttgcaatagtacctggcacgtggataggttcaggttcatgcaacaaaaaccaatagtgacctaaacaagatagaggctatttttttttaacatatatgccactcaacagtggaacctaggcccctatctctttctccttcaccatcctgactgtgacaactaccatgaaaattgcctcgtgatctcattattgatgccagagctccagctgtcacacacacattccaggcaggaagaagagaggtgggggcaaaaggacatctacttttcaactgaagctgtctccattaaaagttttcttgtagtccaggcacactggctcacttctgtaaccagcactttgggagccaaagtggatgaatctctagagcccagaagttcaagaccagcctgggcaacatggtgaaaccccatctctacaaaaaattaaaaaattaggagggcatgatggtgcacacatgtagtcacagctactcagacactgaggtgggaggatcacctgagcccaggaatgttgagactgcagtgagccatgatcgtgccactgcactccagcctaggtgacagagtgagatgagatcctgtctcaaaaaaaaagaactttcttgtaagccccactcagtaactttgaattacacctcatctctatctttaaggacaactggaaaattagctaggtacattggagactgtggcaaggtcgattgcaagaggggaatgagagaaggaatgaagggatacgggtaggcaacttggcatctttgcttcagtccctgtttcttatgtttgtttgtttgtatttaagtgtgactgtaaatccttccaagtcgtgcagcatttgtttccagcataatgcaaaaatcatatttgcttagatgtctaaactcccttcattcaaacatgttttcatacaactaatttttttcctcagttgcctgccttatcaacttaaagagcttctaaagagatttgccccacatctcacttttctaagctgattagagaccactaaatatcactgtgtgtttctgatagttttgtcctgttttttatatactagtgcaatgtctccactaaaagatagtgtcattcagcatttaacaattttttcaggctgggtgcggtggctcacgcttgtaatcccaacactttggagaccaaggtgggcggaacacttgaggtcaggagttcgagaccagcctggccaacatggtgaaacctcatctctactaaaaaatatatatatataaaaaatagccaggcatggtggcagagcctgtaatcccaactacttgggaggctgaggcaggagaatcacttgaactcaggaggcagaggttacagtgagtcaagatcgtgccactgcactccagcctacgtgacagtgcaaagctctgcctcaaaaaaataaaaattttttcaaacgtgaaaatgagcgtgtttttggcaggcttcaaatgaggaccatcgtttaatacaaacacagttcatcataacatcataaaatgatcttgagtcgcattgtaacatggtactatttcattttgtttcgttttattattttacaggcattaagtaccccaaagtacaatctgtcactgaaagtctatggatgatcaaaaagagccatggtcaccaatgagacccaagtgagctcactggacaatgaacaagctaattagaactgtttatctacatgagagctttcatcagattactgagttaacctttattttactcaacactgagcagggcctgagtccatggagactcaaggcctctttaaggcttacttgagtgcaatgtttgtgcttcagtaggaaagaacagcttctagatgttttctgtcctaaaccagctggtatcccattccatggcctggagtatctcagtgtcgtttctcaaacctgtgtccaaattacctgggtttcttatataaaaggcaaattcctgggccccacacagagtcagaatctctggactggagtccagacatttccaacaagcttcccatccttggacaactttcttcagaaaggggaccctacagggggtgcccatccaggatctcgtttctcatctgaaactatccgaggcactcctcgggcatgggctgaagctacttgcaccaaatccagagccacctggtgcctctgcagagactcagtgtcacccaccaaaactgcaaatgctaaattagggaccacttctcagagagcagaggatcaatttcatattcaacctgtaagtgtctcctggcattggcctaaagcaaagtcctgggttgcagataatggcctcaagtgcagacctggaactctcatagccaaacagtgagggctgctccaagcactcaaaccatctctgtgcaggtgattggaaaccatattggactacaagaagacttttagtggaggcagcttcagctgaaaagtaagtgtccttttgcccccacctctcttcttcctgcctggaatgtgtgtgtgacagctggagctctggcatcaataatgagatcatgaggcaattttcatggtagaagtcacagtcaggatgatgaaagagaagagataggggcctaggttccactattgaatggcatatatgtttaaaaaaaaaaaagcctctatcttgtttatgtcactattggtttttgtttcatgaacctgaacctatccatgtgccaggtactattgcaagtcctggggatggggatgagcaaaacataccaacagttcctgcctcatgaagcttgtaattcagctggaagaccaacaataagtaagataaataaataaaatatatagtttgttacatggtaataagtactaaggagtaaaaataaagcagggaaggggctggacaataccctgccatttgcctgagatcagtcacttttccaaagttttaccacttaaatatgaccctataagatcttcaaagtgccctttttttcctttttcttttcttctaaaaaaaaaaaaaatttccagctgggcacagtggctcatgcctgtctgtaatcccagcactttgggaaactgagatgggtggattgcttgagcccaggagttcgagaccagcctgggaaacgtggcaaaatcccatctctataaaaaatacaagccaggtgtggtggtgcagcctgtggtcccagctactcgggaggctgaggccgggggaggcctgggctggagccaggttgcagtgagccaagatcacatcactgaactccagcctgggcaacagagtgagaccctgtctcaaaaaaataaaataaaaataaaaatagtaacaatttagaaaaatttttttcaatctttcagaaattgtttcacattcaagtatggaaatcttctaacatacactaaagtagagaaaagagtaaaatgaacactaatatatccatcactcagcctcaacaattatcagcactttattatccttggttcatctgaggttctttttattttcagaatgaatacagtataattccatttataaagagttcaaaaccagttaaaactaaaaaagtatattttaaaaataacagtgtattgtttagggaatcactcataggcagtaaaactataaaagagaagcaagggaacacttactgcaacggtaagagcagtccacctgggcagacgaagaagctagatgcaagcagggagggacacacaggtgtcttctaaagttgtttcctaacaggttatgggtaaatgttgttcattttgttcttcaaatattacatatacgttatacattctgctgcataattatacatttcatggtaaagcaaatgaaaaaacatatcaaatatctactctatggaaaggtactgtggatgttaaaatgactcagattccatctccactctgctaaaattactttcactgaggtcaaagacttcaatgtcactaaagggaataaacattttcaattctcattttctttggtgtctcagcagcattcaactctgctgaccattattctccttgaaacagtatattcccttggttttcataaaaccatattctcctgaccattccttctgagtctccttcaaaagcttgtctcctaccacctaaaccttaaatactggagctccttaaggtacatccatgaaaccccatttttttcatatgctgttctttctctctagacactcacatccatgcctatggcttcaattatcatccatacatcaaagatttagacctccagctcagacctctcctctgagtgatatatcccattatcttgtcaacacctttacttgaatatttcaaaatatctcaattttaacctgttaaaaatgaaactcatgatttccctgcaaaacacttcttctagtactctttctcagtgaatggcactgccagtcatccttgacaatttcacttgatgaaaacaaataggcatttgtttttctttctatagaataaaatagctcactttcttttcttcctaggaaaaggttgaaaatgaggaaagtaattttggtgatgactctaagttgaaataaaatctgtccaaaaaaacaaacaaacaaacaaacaaacaaaaaccccacatcatctggtaatttaggtttcctacatagagggagctcaataaagttagttcccttccctctagttaagagtttttccaaaacataacagtaatttattttcctctctccttcttctaacccctttatgtacattttcttgtctcttctttctacttcatttttgcacacaatagagtattaaattgtttctgattttcttcatttcctgtttctacttttttccttatttccctcatggcccacctctctgtcactgaatcggaagacggtccttcaatcaacaaatatttatcgagcactctgggatacagcgatgagcaagataagggtcctgctctgatgtgttttatatctggagtggggaacaaacaattacaaaataaacagcatgagctaattaaggaattaaaactgaatgatatagagagtaactgggtggctatctttgagtggtcaggaaaggcctttctgaggaggttatatttaaatcttttttaaaattattttagtttatttttccatgagttattgggatataggtggtatttggttacatgagtaagttctttagtggtgattcgtgagattttggtgcacccatcacctgagcagtatacactgcaccatatttgtagtcttttatcccttgcctcctttccactctttcctccaagtccccaatgtccgttgtattgttcttatgtcatctgaggttcttttaaccacaactccatgcctggaattgactggaatctcagagggggaaagaccttggcacaccagtcattggtcacctctactcacctcctgccccaactcctaccatagagcttagtagtcacggcatccctgggacctcaggaaaatgtagagaacacaaattacaataggcttccagaatcttggaaaagttcattcaccccatgaagtcagcaagcaatgtggattcaaactatgtgacacttcatcccaggcaacaggatgacctgtgacaaaggatgacatagattaaaccttcattcacagtgtacaatcggcctggtttcccccatctctcatcaccataacaaccagcattctataataagtatccagtcacctagagacatgggaaaacaatgcagcaaatgttgctatgttccaattatgaagccttgggttccgagaggtcttatatggcaatctcatcctctgcttttgggttcttgatctcatgacatgtaacacccacccatgagcacagaaaaattcccaggcaggtttttagatgcccctgacatcttgaaagaaagatagtatccagagccacatgtgacttcccgaataatcagcatcaaaagagaaagagagtaccaaaagcacttaggtctggcaacctccgtagaaggaggatgaggaatcctagttctaactcttgggattatattaatgtcataaactgaacagaaagtacgctatggctttattaccctatagaacattaaccaggtttgtgtacaacttaaaatgtttattttggtgtgcctttcccaattcttcatatgctctcagaaccagcttttcatcttactgtttccctcattgcttaatgaattaaataagctctgtggctcatgttcatcctattttgtatgagtcgtatttttgactttttttacttacactttgacacaagaactgtccactgaacctgctgccacagtaatgaatgagccttgtcctcagccccctcactcaaaaccccgagtcccccaagaggatgtcttgttggctgagtctagctcataaggtccacccctgattgtgccaggctggaaagaggggtgatccaacccctttagcactcacagtgggaaacaggtataaatgcccacaaataagccagaatgccattaggaaatgagaatagttactaagcaatccaaaatgacaaatttcagtgttccttccttaggcctctagtttacaaaggagggagctaaggctcagtcctagtccagctgtgtcacagtcaccagtttgctgctccttgagaagccacagagaaccagtggggaggggactggcctttgagggcatcactgctgctgggtggcttggcccctcatctaagagtgttccagaagcaaacccacagaaacgggcatcagacagtcatccaccattgtgtcaaggagtttgtggggtgagaggcccatgatgtttgtgtacatgggtatgtattgttggggctcaggaaatgataccccaaagcatggtgctttggcatgctgagcacttagaattaaaataaattggaaagccttagaagttgccccagaatcaaagtctatgatcttcccttgtgtcttcccccaagcacagggagggctctctctgaagttccctcacctaactgagggaagttcttccaaaagagacacaattgccttcaatttcctgtctgaaatctcattaaccagagaagattaatcactagagaagaagctaaaggtcaccaccacactcaactggacagattttttttgctattctgagagatgctacctgagagattttacagtgggctctccatagccacagattccacattcacagattcaacaaccatagatcaaaaccacagatacaaagggtcaactgtacatattttccatccacagttggttgaatccgaggatgcagaacccacagatacagagggccaactgtactatgccattttttatcagggacttgagcacccagtgattttggtatctgcaggggatcctggagccaatcctctgcggatatggagggctgactatatctgcataataagacaacctttgttcacagggcagttccaccctttactttctcataacttgtcaccacctcccccagagcccagaggaacttcgttccaggttattgtatggttttcaggcctattaatctcccctaaaaattgtttgctctttgtctaaaattgcctacaccttccacttccctttcccctgtgaagaggtatttaagcttcaaccctctggcccttctttgggttttataccttgcatggttcctgtgcacttgtatgttaataaatttgtttacctttctgctgttaatctgtctattgccagtttgttttacagactcaaattctctaactttcaatgggtagaaggacagttcctcttgccccaccagtatatgaaggccagcctgccctcatttttaggaaacagatgtccccagactaaagaagatctcagaattgctgagatgcagctgtaatactagctgtgtgatcagacaagcaatctaacttttctggaccaaaatttcctcaactatagaatgtgaatgctagcacctacctgacaagatcatttcaaggatgaggagaggtgattttatacatgtcaatgaatttagtagctagtattagttaagtctgcactgaagaggaaaaaacatcaccaacagtctgctttcgggggcttggtctcttcatcttcagcaagctgactgtcttttcctgtgaggtgactgttctctagatagttgtgtcaaattcaaatatgctgtcctcctcatcatctctaaactcacttagcagtccactccagcaagctggcatataatcctacagcatttgcacagccctagatgctcctgggagaagcagtatcacagtgtgagccatgtgggctcagcagctagggaacaggaaagagcagagcagtcctaggcatttgggccttcctggccagggcagccagaccagagatcacttgggctggggctggacatgtatctgagtatagtgaagggatgcagcgttcccagtatggtggctggaggcaaccataacaactgtgctgtctttttgtcagaggtgtttgaaccagagtgactccatcttgaatagggactgggtaaaataaggctgagacctactgggctgcattcccaaaaggttaggcattcttagtcacaggatgagataggaagtcagcacaagaaacaggtcacaaagatcttgtgataaaacaggatgtggtaaagaagccggccaaaaccaagatgacgatgaaagtgaccgctggtcatcctcactgctcattatactctaattataatgcattagctgctaaaagacattcccactggcactaagttcactaacgccatggcaacatgaggaagttaccctatatgatctaaaaaggggaggaactctcagttccgggaattgcctgccccttcctggaaaagtcatgaataatccaccccttgtttagtatatgatgaagagataactataagcatactccatcgaacagcccacgctgctgctctgcctatggagtagccattctttattcttttactttcttagtaaacatgctttcactttatttcatggattcacctcgtattctttcttgcacatggtccaagaaccctctcttggggtctggattgggaccgttttccagtaacattttctccctactccacccccacctcccccacggacaccttcctcaatgacaccaggctggacgaacagcaccactcctttagaggaactcatcacttcctctccactgtagagttaagttggagcaaagtcagtatctctaaatagcttctaagaatttgggaagctttttattttattttttaagtttgaaaaaatcttgttaaatagaaactatgaatagtgtgtgacttcaaagaagtctgtggggctggaaaacttctcacagtatacccttttgtaacttttgaatttgaaccttgagaatgtatctccaattttaaaataaaatgaaaattaaaacctcatttaaaaacttgttaaaactctgctgggtgcagtggcttatgcctgtaatcccagcactttgggaggctgaggcgggtggatcacgagatcagaaattcaagaccagcctggccaagatggtaaaaccctgtctctactaaaaatacaaaaaaaaaaaaaattagccaggcatggtggcgggcggtaatcccaggtactcgggaggctgaggcagataattgcttgaacccgggaagtggaggttgcagtgagccgagatcgcaccactgcactccagcatgggtgacagagctagactccatctcaaaaaaaaaaaaaaaaacttgttaaaacttggctgggcatggtggctcatacctgtaatcccagcatttgaggaggccaaggtaagcggatcccttgaggccagcagtttgagaccagcctaggcaacatggtaaaaccctgtctctaccaagcatacaaaaaattagccaggtgtggtggtgtgtacctgcagtcccagctacttgagaggctgaggtgtgaggatcacctgagcttgggaagtcaaggctgtggtgagctgagattgcaccactgcattccagcctggtcaacagagtgagaatctgtctcaagaaaacaaaaaacaaaacaaaaaaaccttgttaagactcaagattctgtggttaataaatgtccccacaaagtatttcagtcttgccagcatctactgagtccattgttttctgagtctccctaacaggctcatggatagaatggattagaagatgtgctgtagaaattataaaccaagtggcgtgcagtggctcacacctgtaatcccagccctttgggagtctgaggcgggcggatcacctgaggtcaggagttcgagaccagcctgaccaacatggagaaaacccgtctctactaaaactacaaaattagccgggcgtggtagcgcacacccgtaaccccagctactccggaggctgaggcaggagaatcgcttgaacctgggaggtggaggttgcagtgagtcgagattgcaccactgcactccagcctgggcaacaagagcagaactccgtctcaaaaataaataagtaaataaataaaataattaattaataaaaaaaggaaaagaaattgtaaaccaaaaagtatctgagacaggtctgaatcaatttagaattttattttgctgaggttaaggacaagtgctcaggaggcaggtctgtgcctttctccaaagatgactttgagggctttgatatttaaaggaggaaagcaggctggaggaaaaaaagggaggatatggtcatattactgaatccacatgttgtgagaaagggagcaggtaggggaatagtcaattatatattcatcttttgttcagtaaatctgcactttacgtaagataaggtgaacttagaatagctacctgtggaaattctgtaacattttatctgtagctgtctgcttagaaatgaaaggaaaggcagcttcttccacaactcagctttcagcttaattttttttcctttgccatagttgttaccagaaacaggtcccaatcaagaccccaagagagggttcttggatctcacacaagaaagaattcggggcaagttcataaagtgaaagcaagtttattaagaaagtaaaggagtaggccgcgcaccatggctcacgcttgtaatcccagcactttgggaggccgaggcaggtggattacctaaggtcaggagttccagaccagcctggccaacatggtgaaaccccatctctactaaaaatacaaaaattagcagggtgtggttgctcgcctgtagccccagctacttgggaggctgaggcggcagaatcacatgggagtcagaggttgcagtgagccgagattgtgccactgcactccagcctgggcgacagagtgagactctgtctcaaaaaaaaaaaaaaaaaaaaaaaagtaagtaagtaaagcaataaagaacggttactccataggcagagcagtgtcgtgggctgctcagctgcttatgtttacttatttcttgatcatatgctaaacaagggatggattattcatgactttccgggaaagggaccggcaattcccataactaagggttcctcccccttttagaccatataaggtaacttcctgatattgccatggcatttgtaaactgtcatggtgttacagaaaagaggtctgatccagaccccaagagaggattattggatctcacacaagagagaattcagggcaagttcatagagcaaagtgaaagcaagtttattaagaaagtaaaggaataaaagaatggctactccagccagtcatggtggctcatgcctgtaatcccagcgctttgggaggccgaggtgggtggatcacttgaggtcaggagttcgagaccagcctggccaacatggtgaaaccctgtctctactaaaaatacaaaaattagccagacatgatgccacactcctgtaatcccagctactcaggaggctgcagcaggagactagcttgaacccaggaagcagaggttgcagtgagccaagatcgcaccactgcactccagcctaggtgacagagcgagactgcatagacagagcagcccctagggctgctggttgcccatttttttgtggttatttcttgatgaaattataaacaaggggtagattatatatgcctccccgttttagattatatatggtaactccctgacattgccatggcatttgtaaaatgtcatggcactggtgagagcatagcagtgaggatgaccaaagttccctctcatcaccatcttggttttggtgggttttagctggctcctttactgcaaactgttttatcagcaaggtctttatgacctgcatcatgtgccaacctgtcaaattctgtgacttagaatgccttagccatctagaaatgtagcctcattttgtaggtctcagcctcattttacccagcccctattcaagatggagtcactctggttcaaatgcctctgatatagtgaattggggtaccaagtttttattttcctttcacaaaacactgcaaatattttcctttcacaaaatactgctggaagcctcttccacaccacctccaggtgattctggggctcccatcctctacccgacactcagaccttggtatccccaggccttgatacccccatcctcaggggctgacaaccagccctgggagaagaggtgctgggctccctccatctggaaagaggagtcctggcaccagctggtgaaatgatttcaggccctttcccagcctcttcacattgcccaggactttcctatctgacccctccaggatccagactggagatgcaagaaaccactctgactagggactggggtctagggactggggttgtgaggggtccagctgctccttcgaattcagggagagaaacccagcatgtgagagggactactcagaaaattcttttgtggttgctatgtcatttgaggggaaaaaatatttttagccaaaatccacatccatggctctgcaggagaaaagtaaagaagcactctgccacagacgagaattcagtctgcactgtggaccctgggctggctcactggctctcaggataccagcaggggccaatttcattcttgattcctttcttttcacaaaacactaattagttggctgcctgacacccacagcgttccctgagcttgtttgcagtcctagcagtggcaagattattttatattcctgggttaagtcttttcccctaccttccacctaagggactgccccccctacccctctattaagacttccaccccccaccccaccccatgcccacccctggtagctgcagccaccatgaggccagcctgcaggcttggtttcatgggtctttgatctcaatgggatcaatagtgtgggtcaataccttctcttttgatttgcaaagcactttcacaagcactcttttaccccaatcatcactgtgctgggcacacaacaactcaataaattctgaattgaatcggtccttataaccacccagtgaggcaagtgcagcagaactgattattttcctcctcctctctctctcacactttctctttctttcttttctttctttctttcctctttctttctttcttctttctttcttttttgatccattataaggaaatccaaagaatgtgtgattctgacactaaggccacacagcaagaaagtggcaaactgatgggagaagtccagcctcctgctgcccggtgtgagggaagggggcccttctgctatacccatgtgactccaaggtgtgttctgtggctgctgatctctcttttttttttttctttctttttttttttttttttgtgagacggagtctcactctgtcactcaggctggagtgcagtggtgcgatcttggctcactgcaacctccacctcctgggttcaagtgattctcctgcctcagcctcccaagtagctgggattacaggcaccatgtctggctaatttttgtatttttcatagagacagggtttcaccatgttggccaggctggtctcgagctcctgacctcaagtgatccgcccacctcggcctcccaaagtgctgggattacaggcgtgagccaccgagcccggcctgatctcttgatcagtatttcagtgctcctggtggcataggcccttcagagccagcgcaggtgctctcccaggactttggtgtagggattcatgtgatctaagatcccgcctgtttcctttcttttgctcagatgtttttctgtaagtaaagtcactaatgggccaaaaagcataatttaaaattgccaaaggaaaacaaatcagtctttttactctgagagcccctctgggaaagccaaacattcctaataaatgattctttctattccagaaagacaccaaaaagggaactgcaaaaataactcattcatcaaaatagtagtttggcagatagttctgcgatatcaccaacaccccctctccaggttactgagaaatctggggacaaagagaacttagatagcagtggtgccatcagctgcaacagtttaactggccatgaaggagccacttgtccctttggtctaagcaggtttggctattattttgcgggagtatggttaatcatattaagaaaaattatccagaacttgaaagttagacaaaatgatgactaaaagttatctccgagtctccttgagcactgtcctaacaatcacctgagggccagttaacaccctggggaaatgaaacttttggttgacttacaattgattgggacctagactctaagagcatgtgttcatttgtagacaatttgataagttgctatgatgattaattttatgtgttaacctgactaagccatggggtgctcagatatttgactagacattatttctggctgtgagggtgtttccaggagactaatatttgagtccatagactgagtaaagcagatggccctcccagtgtgggtgggcctcatccaacccattaaatttctgagtagaataaaaggttaagtaagaaagaattctgtctctctctgcctgtctttgagctggaacattgatgttctgccttcagactcagattcagactggaagttatgccatcagctcttctgggtgtggacttagccttcataatcatgggagtcaatctctctctctctcttttcttttttttttttttgaaacagagtctcactctgtcacccaggctggagggcaggggcgcaatatccgctcattgcaacctctgcctcccgggttcaagcgattctcctgcctcagcctcccaagtagctgggagtacaggcacatgccaccatacctagctaatttttgtatttttagtagagacgggatttcactatgttggcgaggctggtctggaactcctgacctcgtgatccacccgccttggcctcccaaagtgctgggattacaggcatgagccaccgtgcctggccgagtcaatctcttttaatcagtcaatctctctctctctctatctctctctctctctctctgtctctctctgtgcgtgtgtgtgtgtgtgtgtgtgtgtgtacacacacatcccattgctgtgtttctctgttgaaccctaatacaattgcaaataaattttgtcagagatgcccatgacatctgtccagtagaagaaattacggttttattgccctctaggacatgtgaaaggaaaatatcttgggccccttcaagctgggaactgctcagggcaaacctgcctcctattctattcagtcttccctctgctctctgagatagatgcatattctgattgcctcctttggaaaggcttatcagaaactcaaaaaaatgcaaccatttgtctctcacttacctgtgacctggaaaccccccttcctgcttccagttgtccccgcctttctggatggaaccaatgtacttcttacatatattgattgatgactcatatctccctaaaatgtataaaaccaagctgtgccccgaccaccttgggcatatgtcgtcaggacttcctgaggctgtgtcataggtatgcatcattaactttggcaaataaactcctaaaatgattgagacttggctcatcatttttctcaattgacagacattaaccagttttgcatctaattttgccatcttattctaccattatttttcccactaagtaaacatttattatggctcttcagaaaaataagtaaataattctctttgattttgttgttgttgttgttttgagacagggtctctatcacccaggctggagtgcagtggtggatctcagctcactgcagcctcaacctcccaagctcaagcaatcctcccacctcagcctcccaagtagctgggactacagaagcaggccatcatgctgggctaatttttgtatttttagtagagacagttttgccatgttgctcaggctggtctcaaactcctgagctcaaacaatctgcctgccttggcctcccaaagtgctgggattacaagcatgagccactgtgccaggatataaataattcttgtgcactggatgttctttctaaaacaaactactgctgtctagagaaggagaacaaaggaatctgaagcactcagcaactctattcctcactgtcactcactcagagctccagggctggcaccccacgctatagcagaaaaaaaaaccagaacagaggaagactcccttaacattgaactgcagccaggcacagcaggaacttcctcacctggcgggagagtgatctattctaagggaaggattagagacacaggctgtggaggccttaaagagacccatgggaagggataaggagtttgagggaagtaggaggcccccatgtgggatatcctctaaaggtccaaacagagtctcggtatccagtagcggagatgagttagctaaagtggagcttgaaggagctaaaggattgcttacacccccagcactagcatggaagcccatgaccacagggaccttggtttgttcacctctgtatctttaggaaaggcagcaaatgagccgccaaaggaaggtgaatctgtactgtagagccagcctgatgaggatgaactaccaaaggacatgagggaattttctgggttgatagaaatgctctgtatcttgatgagggctctggggtgatggaaatgttctgtatcttgatgaaggtaaatgtttgtcaaaactcatcaactgggccaggcgcagtggctcatgcctgtaatctcagcactttgggaagccaaggcaggtggactgcttgagcccaggagctccaggccagcctgggcaatatggtgaaaccccgtctctacaaaaaaatacaaaagttagcagagcatggtggcgcatgcccctggtcccagctactctggaggttgagagaggagaatcacctgagcccagggaggctgaggctgcagtgagctgtgttcatgccactgcactccagcctgggcaacagagtgagaccctgtctcaaaacaacaacaacaaaaatctattcagctgtacacttaaaatggatacactttattgtatgaaaattataattcaatgaaactgatttaagaagaaaaaactgtttgataaattaattcctaatttcctacatttttaagatggtttgtgactcattctaagcaattcctggtgtacagaggcctgacttcactctcttaccacattcagaggtaacatttccatttcgaaagcaaaaactgacataagtgcaaatactttgggagacccagtggaggcagagtctttccttatgtgggagacgagaatttgccaccccaaaatatgcctctttggcatgaggattgttgagctgaagataagacgaggcagatgcaagaaagctctttgcccttcctctatttgcctaaaagtagacacaaatttacaaagacaaatgggatcccacccccacccccttctcccagggagcacaaaggtctcccactgatgacaacgttagaccctcagtgacctgaagatggcaccagaggaatctacatgaacaagctttacagaccagccttcatctcacttgcctttcctcaagttgctgcccctggagattcaaaatcctcttcatcttgtcacatctctaaaaatctactgttctttgttgaagatgctatataagctggaattcaaagccaccactatgagaatgactcattccctgggtagctcctgtgtatatatgaaaggcacatgttaataaactttggtttttctcattaatctgacttttgttacaagggtccgttccaactaagaattcgtgacgattgaggaaaaagttatgtttcctcttcaacacttatataaaatcacctttaaaattagaaaaaaactaagataaatgtacaatttgacattagctgaccaagtgtccttcacttcagctggcgaaaagcaaagaactgtgaaaaattagaattagaaggaatgttaaagatcatctagtggccaactcgttcactgatgactcatacagatgaggtaactgaggcccagttgaagaaagaataattgggaaattccttccttttccttccagaatcacatctctcagaaatcttcctcacttcctcttaaaaagcaacacagtgacatttctgcaaataagagtctgagaaacacctgcaacacaggtccttctgataatgaagataaaaatgccttacacttaaaaaaaaagtctagtgtcaaatcactccaatatatccagtgtgaagttgtatttttaacttatgttttcctcaagtaacatggataataagtccttttgagataataaagcctttgtctttggtgttaaaaaaaatctaatttattttctccaagtcagggacattgatgtttaagattaaaatctgcagttgctacagctgctgctggcatagacttcttgcacaaatacatcaagatgtttctatttgtcttcagatccttgccaagagttgagcaatggctgaacatggcatcacatctgctttggcctgcgtgaagaattttaatgttagtagcactaacatgtgtggtatttacttcactggacatccaattcaattcagtcatttcaatttactctgattgaacacctgctatgtgcaagacactgtgctatgtgctgatggagaagttaccaggtaaagtgctaggagggagagttagacacatggtgagaggagatagaaacttcaggtagtagcattcactcattcattcaatgaacatggcaccaagccagggtctgatgtctccattccaatagctgctttcttgagctattaagacacctctaaactgaaaccgcctttgcaaaattatgactgagacagtgaaagagatctaacctaactgactccatcttgcttctaacctccaagctgtccttgttcattcctgggcataagctgaagtaacattgggagaaacttagtttatagtttaaacaaagacggtaacagccctttcccaaagcagacctccttcttgcctgggaactagattgactttatagaactaacattagccacaagattagaaattatggtttaggagtcatgcagctggaggctacaagattctgacctgccctaaactgctcctaagatcagtgcttgagatattttgcagcccctgcacttgatggattagctggcacaacccagatcaataaactggctcatctgatcttgtggcccccacccaggaactgactcagcacaagaagacagctgcgactccctatgatttcatctctgaccaatcagcactcctggctcactggcttcccccaacccaccaagttatccttaaaaactctgctccccaaatgtttggggagactgatttgagtaataataaaactccagtctcctgcacagcctgctctgcataaattactctttctctattgcaattcccctgtcttgatgaatcaactctgtctaggcaacaggcaaggtgaaccccttgggcggttacaaaactagaagagaaatgaatgaggggctgtggctatcagggcaataataaaatgtgatgggagtcctttgccaatctttattcagtttacctaactgtgagctttcgtttctagctctgctcccaaggcaacagaccatattacaagttacttacgttagtaaacaaactacattaatctataaactaattaaaacatattgtaatgatttcccagtgatattctttaataattttcatttggatactgaaaatgaaaatcatgcatcccaccctgctcttcaggaatgctgaaggccagagcagctcacaggttatagattttgcatctgtaagagacaagcacacctcagcattcaccttcagcccaaacctctgcatagagaactaccagacctttagcaacagcaacgtaatatcttctcacctgaaaaagagagaaaacccatattcagggcatcggggaataaagagaaccaaacaggttccactggggacggtggcattttggggatttcttgatccatctcatcatagccatggtttggggtggagagaaacaggcacctttgtgctgttttagtccacctttaagtatccaaagtgacattttccaggtcctccctcccaagttctttgaggaccccaagagtcaagaagagggttttgaaggtaacggctgtgctagggatgggcttctgcagaacaaacacgggccactgtgcttgacccccatctggacagccaccctgagttggtaaggacgtgatgaggtgaggaagggggagaggaagcaataagcaagggtttgagttggtcaaatccttccagcaagttcccatgcaagtgttcttgccacagaggcccattaaaggcctgctggtgctcaggggacattgcctcccagacatctccaggggctactccaaaaacccctagccaaagatcccagctcacctcagcccccagtctctcccagatctggtttctagtttacaaggtaaagctctcatcctgggctgttaggaagggcctccaagagtagactcacctgggcccttccctccccctcatctcccaggggaggaaggggtatggggtatgtcttgaagcgtattttacttttgtttctgggtttgttttttgttttttgttttgtttttgtttttgttttgagatagagactcactctgctgccaggctggagtgcagtggtgcaatctcgcctcactgcaacctccgcctcctgggttcaagcgattcccctgcctcagcctcccaagtagctgggactacaggagtgcaccaccaagccaggctaattttttgtattttagtagagacggggtttcaccatgttggccaggatggtctcgatctcctgacctcgtaatctgcccacatcggcctcccaaagtgctaggattacaggcatgagccaccgcgctcagcctgaggcatattttttaatcagctgtcacctgtcttcaccttgccttccacttccaagccatgattttaaactatagacaaccgggggaaaagatacctaggccagagtggatacaaaatcctccaacagtgagtgacaaagacctttgagaaagaagagcctggagaaggaggaggccacagagggtgatgcctcagatgggagtgggggagagaagggagggaaaggggagaagggatgggaaggagtccccagggaccaggggcagtcattggacagtggggatgggagtcccgaggcacggttgggcccatggttagtctcagaatggcagttcaagctcagccctgagccctgcaggcaccggcccagcccaacgcacagcccaagggtggggcagctgggctgtaggaggctgtgagctgaggccttgcctactcccctggggccttctgcagagtcctggggagaagcgaggcactcatcagtggggaaccgtggttctaattagagcccagaaaccccttataaccaggttcaagaccatcagcctgtgagtgaggaaaggtctaggaccctgactgaggacaaaggggagtggcaaatgagccccatttacccatgagactgtactaagggctttgccaagtgagttgctggctgacattttcgccaatgagagcaaaaatagtttatgccatcagacacccctacatcctagttttgaccagctttttcttttgcagcgtgcatttccccacctgggacctgacagtcctcccacaggtaaagtacacagctaaaaatgtgagccgtgtgacggggtagcgtggcttaaaggcctagagctaggcccattcttcactaagttggcccagaagtaccaaaaaccttccaggcacctttctgttttctcctcttttgagttcacagtcccattaggtctagtctctcctagaagcactggttttcctaaccggtacactctatttccacccgctagttagaagtggagatgttgactttggtctcctgcgtctctggaaggtgaccctcgtaattgttctattctcctgaaaggcctgtgtgtttctgatttggtgactgttcaggagacccaaggttgagtcttgggaagagcatcatgaaggccaccgggaggctgggacctggcccctgctgtgcagttcttacctgatttgcttccttctgatgcacaaaggaaggtaaggggagaactgtccagccatggctccctctgagtcagctctccaggcttgtggacttgtggacctcattttcgggacagatatccctctcctgtctttcttggcctctccctcaacactcatctttccaatgttgctccttatccgttaccactatttctctgctacagttcccggtgcctccccaaatctcttttcccctagcaagatggtcgtaagctgaggtacccttcaagggcaaagaactcccagttgggataatgttggtcaccaatttcctctgtctctgtgttagtccatttgcagtgctataaaggaacacctgaggctgggtagtttataaagaaaagaggcttatttgactcatggttctgcaagctgtacacaaaggatggtgccagcatctgtatctggtgagggcatcaggaagcttcctgtcatggcagaaggtgaaggggatgcagcatgccacatggcaagagagggagcaagagagaggaggaggtgccaggctccttttaaacaacaagttcttgggtgaattcatatagtgagaactcactcatcaccaagagaattaggtgatagtgctaagccattcatgtggagtccaccgccatgatccaatcacctcccaccaggccccaactccaaaactggagatcacatctcaacatgagatttggagggaacaaacaccgaaaccatatcagtgtcctaaattcctatttccagctttgtttccccttgatgttcttagctcttctctctcccaaaatgaccagattttcactctctctcagttcatctcctcctcagttctcaggaccttcggtcttctcctcaactcactataagtccaactcaccagtgtctcccacccgtgcagcatgtgttttccgtatgctggccactgtacatggcttgttctcggtcttgattggtttggaacttgttttacagccctgtgaaggttaagtgtatttccactttaccaatgaggaagaattcgtatgaattgttcaaggtcacagggcaatgagagttggagtgggaactctggtcaggagattcatccccatctgagctgtctgtcatgaaatccttttcctcctcattgtcttgtactctttaatttcttatccttttctttcataggcagaatctagcaccttgggagccagagtcatagaactggccaggacctgaccaactaactactgcctgtgccctgtagccaaagacccccaggaacaaaattggattttttaatttgttgcagtgggggagtctgtctgtgatgaggaaccatggggtgtctcagtaagacggtgttagaagggacttctaatatatatgggctcatgttaactgatttgagagacgtcttaaggaagcaggggtttgcgctggattggatgctatcaggaggcaggagcaatactatgagagggcatcttaatttttatgcagaaggtggaatgcgtgcagcagggctaaagctgtgattggttaaaaaaacagcaagcagtcagttgtgttagctggagtgggggatatttagtgattcttgtgattttcacagtgaccttgtttttgtccctactcagacgtgattacagaatggtcttgtttttgccagcccctgtctgatgctggcaatctgtgagataggctgtggttcagcagaaaaacattacagcccagccatgagcacctggccagtaagagccagctgtcagggactacttttctctttctggctacaaaggcaaagcctcagtccttaagtttcagcctgctctatatcccagactcatatcttcatgttgaataatggtcatcacatttgaagaggaagaagaagaggagggatagacaagaacaaggaagcaggtttgtttgggggtgagggtaaaatgacatcttagcttagaggattcgtgtctctgtgaactgaatggatccggggttccattcctctatctggatagaatggaatccaaagccacgtcaggaaaaaggattatgataccattggtgtgcaggtgtcttctacattattagagaaagttccaggtggaggggtggggaaggcaattatggagtgcctgttccttaatacagataattctcttaggaatgcaatcctttcctaagagaacacatctaagggaagcaaagctaaggtaattgtacatgccgattttctggtacatctctgattttaatagtataattattccattaccttgttatagcttgtataattttattatacatattatattttgcataattttgttttagtgaagggaattcattacttgtctgttctctgagaagcagacaggatgggattagaagtgtaagagatgttttgggggcaacacctgtgaaggatccagggttcaagggagcaggaataggcagggagagccctccacaacacaggtcccacacctgtgtaaaagagagagcaggaaaggctaggtggaagaacctcagactgcagtacagttctgagaacatcttggccagattgctggggagttcccaagctaaaattctccatgagaggagtcaccctcgttgggtaggaatggatcagcacaaacgctcctacgtactcagtcactgcccagaggcagccggggtaagtctggtctagtgtccttaggggtggcagccaaggctgtcagtccactctgctccttgcagcaggttctgttaaagggatctgagtggtgccctccatggccatattggcttcagctgccactaccactttttttgagtctttgaatccatttaagttctcctagaagcggaggccaagaaggaattaaacatacaagagattgattaagggaaatacctgtgaaggataaaggcggaagagagcagaaaaaaacccctatacaaatgtgccttaaactgtatactgctggtgagtaaatacattcgtacaagagtctttgtttttgttttttaaaaaaagcttttgttgtgcattctgaattttgctttgggaaatatggtttctttatgtcatgttaagtaacagaattgcaattagaagcatcaaaaataaataaattctacttcaactactacattttcatggcacctttctgtgaggaaatttgcagctaccctctacctcagtggttctcagcttctcaactgggggtaatttttccccccaggggacatttggactggtctgcagacatttttggctatcacagctgaagcagggtattgctggcgtctagcgggcaggggtcagggatgctggaaaacatcctacaatgcccaggacagcccccacaacaaagaattatccagccccaaatgccaatagtggcgaggttttgaaacactgcccggctgatcctcttagtcctcttgcaaggaaaccagcagcacaggtgacttaaatgggcactgaggggcattctagataggcttagtggggagacttctgagactgggagctctcatatggaaaggattatccctgaaccagccccagagcaacagggcaacatacagccatctcctaatggtagaccattcatggaaatcaagcattctgcagaatagcaccctctgtcctatttaaatggtaaactctggcttaatgaatgccccaagtccccagtagatttccaaatatgtaactaaaacactcacacacgcacgcacacacacacacacacacacaaatcccttatgtaagttacagaaactatcatgtcagaaagtaaaatgccgtaaaactcgattccaagcactacacttcctatacagcaacatctgaaagaggtgtacccacacctgccctgccattctaaccattgtctttgggatgtaatctgaaactttcccagcctatcttgattaaaatccactgagtcttgtggactgtcaatagaaatttttcttaaaaacactggatgaaaaacattgagagatacattttgtggggtttgagtattaaaaatccagaagcaacacagcttgccaggacaaaagaaaaaaaagccagaggtatatttgacatggaaaatgttcactggaaacatgtgaagcatatgcttgtattttagagccccaaaacacttttggggggccaggaagaaagattttgttgacatttttttcctcctcattgacctctaactctgtgtgttgtcctagtcaagctggtaagcagctccaaggggatgctggatcactggagatgttaggagccctacattgagagcatggaaacctggattccacctctgcttactttgtctttatcagtggtactcagagatgcagatagctttgtcctcaactgcaggacatggacataaacacgaaggtacggccaggcgcggtggctcactcctgtaatcccagccctttgggaggcaggcggatcacctgaggtcagcagttcaaaaccagcctggacaacatagtgaaacactatctctactaaaaatacaaaaattagccaggcgtggtggcccgtgcctgtaatctcagctacttaggaggctgaggcaggagaactgcttgaagccaggaggtggaggttgcagtgagccaagattgcaccattgcactccagcctgggtgacagagtgagactctgtctgaaaaaaaaaagaaagaaagaaagaaagtacaatgttaagtgtatgtaagcccccagttgggctccatccacctccacccagctctgtgccctgggagtctgaccagactgcattgcccggacccacggctagctggcttccagctggcttcccccagtggaaagcacctgcaagagttaagaggttgtacagaggcaggtgctgggctctttcctcccagtctcctctgtgtgctttgctgcattttctgtctatggctatgtcctccaccgagagatcgcttattgcgtggaccggctatggctccagcagcattatttcctcctgtggccttctgcctgacagggtacttcccgctgtggccagcctctgaatgccttaatatcccttgtcgttttgctgaatagtacccagagctgtgtaagtatgggaagcactcactttgcacagtagtctaggactgtaaaatggccatgtaagctgaaaccatgcaaaacaatcttaataatcgatggggaagaggacgattgtcctctgacctttcaaaaatgtttgtcaaaacattaaactttcttactgtcagtaagagaaaaagtcgcaaaaattgatattaaatacactaattgaaaacattagaaacattggaaattaaagtgttttctttgtgaaaatcttaccgagaaccgtttggacagtgcttgccacttccttcccattatatatagatttcgattcagtgggtatcttttctattcccggaaaattgtcatcctccttctcaagcttggattagttcttacattttatctttcttgctttcaatgtcacaaaatatctctaagaattccttttcgtggttttttgctggcatcatttcctccaggacatctttatcctttttgccacaggcactgttgtcatttatgtagataagctcacggtcactacgttcctctggttgcatatccagaacttcaaacagcagcagcatccaccttcccacagtcagctttttcttttctaactccatttatattctacacaaacctcacttccatcattctcactttgcatttctttgctgcatttttatctttattagtcagttccctctttcaattatccatttttgtaaactgtcacatgaatttctcaccagaagacaaagtgcaacacaactacacactgtgctgccagtggatgagctgaataacaggcacatggtgcccagtcaccaatacactttgaaagaagcaatgtggtgggtcactgatcatgcagcatatctgttagtgatgtgtggcctgaagagttagcagtgaaattatactttagcaaggggccaggtgcagtggctcacacttgtaatcccagcactttgggaggccgagggggggacatcacttgaggtcaggagtttgagaccagcctggccaacatggtgaaaccccatctctactaaaaatacaaaaattagccaggtatggtggcatgtgcctgtagtcccagctattcaggaggctggggctggagaatcacttgaacccaggaggcagagtttgcagtgagccgagatcatgccactgcactccagcctggatgacagagcaagactccatctcaataaataaaaaataaaataaaataaaattatactttaccagtataacaatgtagctgaaatttgaactatctggttgggggactgtgttatttaactaaaacatgatcattgatatttaagcatatcagaactgtataaattgaggactgcctgtaatcctttcagtctttttttttttttttgagacagaatcacactctgttgcccaggctggagtgcagtggtgcgatctcggctcactgcaacctctgtctcctgagtcccagtgattctcctgcctcagcctcccaagtagctgggattacaggtacgtgccaccatgcccagctaatttttgtatttttagtaaagatggggtttcagcatgttggccaggcttgtcacaaactcctgacctcaggtgatctgcccaccttgtcctcccaaagtgctgggattacaggcttaagccaccaggcccggcctcattacagtcttttgaactgagttggaatctgtttcctactgggacatgactggtaaaagggtgcaactaactctccaagggagtgggagaataaaaaagctgtgcaaagtttagtcaagctctgccacagagtcacagagccagcaatcaatgatcctaccatgcaggaataggcaggtaggaagctacttaggggcatagcactctcctaggttcatgctctttaagaagaggcctcttgagagggctaattccaaagcaaaggctgagaaagccatgcttaggaactaggaatttgttgaaaaggaactaggatttaacccagccgcacaattgaaaacattcttcctctactgaaagactcataggagcaagcttttgggaaccagacggatgagtcatcatttagtcttcaagatcttttaattctcctgccccctagtttccagttccctccaacattcaggctttgggtctgcaatggctccatgacacaaacttctagttgcttcccatttgccctttccttaaagagtttaatttaatttgggtgtcaaggtaactacttaaaagattgcacttctcagccttccttacagctacacactggaaaaagttctggcctatgcgatagatataaggaaaagagaacactccttaaaggaagctgactggaggccaggcacggtggctcatgcctgtaatcccagcagtttgggaggccgagccgggcagatcacctaaggtcgggagttcaagactagcctgaccaacatggagaaaacccgcctctactaaaaatacaaaattagccaggcatggtggcgcatgcctgtaatcccagctactaaggaggctgaggcaggagaatcgcttgaacctgggaggcagaggttgtggtgagctgagatcacgccattgcactccagcctgggcaataagagtgaaactccatctcaagaaaaaaaaaaaaaaaaaggaagctgactcgacctttcttacccattcttcctttctgaagtggggataataatggctggagctccagcagccatcatggaccctgaggtgacctcaaagatggaagctccatgctaggatggtagagtggaaaaatagaaggaactttgatctccaatgaccatgaagtggccagaccagcactggactacctggctcaagttttctgtcttgtttaagtctctgtttttatttttttaatatattttattttattattcttctttttaaagatgagagtcttgctatattgcttaggctggtctcaaactcctgggctcaagcaatcatcctgtttcagcctcctgagtagctgggattacaggagtgggccatcatacctggctaagtcccggttattctggattttaaaccaaatctaatcctagctgataagcatgcctacttcctactgaaattaactgattacactaagttcttcaactccaacctctgcttcttgttaaaatcaatttaaaacgaccaatctgattgtcaccaaacctggttagtgtgcatggtaccattgctcaatagctagagtggtaggaatttcttgaggaagactcaagaaatgggaagagatattctagggctgatgagtttttttccaaaagcctaacctaggaggcagctggcttcacataagtctggttcccaaccactacatcttggaatcacctggggagctttaaacactaccagtgcctgattctgctccccagagattctgatttaaccagtctagagtgtagccagggtattgggttttctagaaagtacttcaggtgattttactgtctggcatggcctgagaaccactgacctaactttcaatttggccagatccttattagttcagagccaactgcattgccagactatcttccctagagaattgtctttcttgtataataaggaactaggtcacagctgagctcactgtggttttttcctacccaggtaaagtcatgctttttgttatctcttatgtaggggagtttcgtttccaaagctttttcatcggtaccattgttccacaatcttcataattgtgtgccaagcagcagggcagagcctttacacaggtgtagtccacaacagcagcgtgagggagggaataagcccacctgccagatgggaaaacagcctcagaaagagtgatcctaagcctgggtcactgtggttcccagtggatgatctgttcttcacctccccgtgcacatctctcatcatagaaagctagcctggctcgtggaagcagagtatctggtagctaaacagatgtggactccaggcccttctctgctgccttcactaatggccttggagagaatcattcataggtgatttgaagtgatacagtaaccacagataaaccagccatggctgacttgagaggctaagaaacttgtcttcagctttcatgtctgtgaacttggctctgctgctcctcccatttcaaatcatgcagatgaagaaaccacagttcaaacagtgtgacttctccaaggccacaagactagaaggtggcagagctggaatctaaatctagagtttctttctgacctagtgtcactgccactgacaacctggtttaagaaaaccctagaggttagaggaagccctagtttcctaatttgcctttggcctagctgtgtggcttgcctgtcctcatccaaaaagcattttcctaccttattgtccaattttctcaacagtgcaaaccaggagagctactctcaaaagcagctccatccatttgtctttgagctcttaaaaatgccgagtgtcctgtcaggtggtaaacaacaactcaagagcaggctccaggcagagtgcttggtgcatagtaggcactcaatacttaccaggtgttgacttggagaaatggtttgcaaaaagctacttcctactaaaaaagtgagactcctgggctcattctctagcaaggtgtgtgaccatggctggtcatttagcctccctgtacctcagtttcttcttctaaagattgcattgggccagacactgtggttcatgcctgtaatcccagcattttaggaggccgaggtggatggatcacctgaggtcaggagttcaagacaacatggtgaaaccctgtctctactaaaaatacaaaaattagccaagcatggtggagcacgcctgtaatccccactactagggaggctgaggcaggagaatcacttgaagccaggagacagaggttgaattgagccgagatcacatcactgcactccagcctgggcgacagagtgagactcggtctcaaaaaaaataaaaataaaaaaataaagattgcattgatgtttctcccctggctgtgttctcacattgcatgaaacaacagtgccttctagtggagaaaaaggttagttgttttgtgggttgtgccatgattttcagcttgaaagattcataaaccatgctcatagatgagtcacccatgaaaagcaggtgagctagagcttaccattaggcctcagaatagccctaaaaaatctgagtggaaaatgtgtttttacaggaggctgtaccaccaatcacaaatacacatcaatacacatcactatcaactctcctttacacatctttcacaatcacatcaagaaaatcttaaaactttcttcaagatccaggaaggacttgatttatatagcagatggcatgtgggctttggaacgcaacagacctgtgctgaaattccaggcccatcactaaatgttctcacaaaagttatctttatacctcattttcctcaattatgaaataagtttagtaatacctccctgctaggtttatgaatattaaatgttgcccagctcatggcgaggggctttggggtcagtgcaaacattgttagttttgtttttattaatatctcctttttatctgtgcaaagccaaaatcaaaggaaaaagtgtcacctgggggtctaaggcattagggccacatcagcagagcagtgttttcggatgaggcaaagatgtgcatgtttgcgcatggaagagaagattgctttccatgggccagctccaaccgaggcctgaaccagcctttctctcccatacaactagtgcttatgcagcaaaggtcatggtttatggtgggtgggagagacctgggggagttacggaaacagtaagactgttatttgcaatggttcaagcaggagacttgagccccacagcaatggaattggaggagagggaacagatcagagagttctttgggaagcaaaaatcatagagtcctggtaattacttggatctcaagtgtctcaagacagacactaagtcacctttgatgccccacaggtttggcgtttgggtaactgggcaggtgaggatcttcacagagatggtaaactcaggaagaggagcagatttgagtggaaagaccctgagttcccttttggacatgttgacataggtgcctaagggcttctaggtggtggtgtctaccaggcatctgaacgtgtacacatttgggattcaagagatagcaatggccaatagtcactgcagaaaatgagacagtcagtgaaggggatgagccttgatgggcagaggaaacagccaccatttccattctacaaaatagctttcttatctggaaaggattctacaaaaactttcctgagaacagtgggtagaatcttgaactcaggagtcttagagatcatctaatccaaacttcattttgcggatgaagaaactgggggccaagatgccccacaggccttctccagggtcccacagccagaactgccaggaccagcctcaggtctcccatgcacccctttcttcacacggagggtctccatctgtactgcctccttccagctcttcctccccttggccgggatgggctggggtgaggaagggtgaaggaatgaccagaagggaaaggaggaacaggaacaggcacagcagaggtggtggagtgaggagaagagagcaagactcagccaggtctgtgcacatggctcccacacactagtgaaggccaagagctgacagaaggatccttcccagaaaccacctcctcctgcttggccatcctcacagatgccgagggcagcactgttctccaagaaagggcttaggccagtgcccctgcaacttagttttctagcattcccctaacacaattaccattagcacaattgatcaaatcagaacaggtctatgacatatttttataaacacaattaaacactactcttaatcagatgaatagagttcttaaaaattggctcacatatctagcagaatacagcaggattcagcatcaataagattcctatttttcacttttagagttgttaatgttgagaaactttgttcagataagtaagttggtgagactgaaaggagttttgttatagcagtgtcacttagtccttgagcttctaaggtaaaggtcaaaagtgttctgtcaggagggagagaattaggacaaatacctaaggcatgcggggcttaaaacctagatgatgggttgataggtgcagcaaaccaccgtggcacatgtatacccatgcaacagacctacacattctgcacatgtaacccagaacttaaagtaaaataaaataaattgttaaaaagaaaaagtgttctgtcattggaaattacttcgtatggtctatcagctgagaacttgattaagctcatcttggaggttaaaggcaaaggattagaaaccactaagtttgcaaaacgatttttcacatggccttttacttaacacctaaaccaagatttcaattcgtcttctgtttggcatccccaaggatttttacacaccaggccacaccccatggtaagagcaggaagggtgaagagctggcctttcttttgtaaaatggaaaagggagattgcaaaacaggaggtgggaaagaaagcctgttccccaggcctgcaccaaggtagctcaattctagtaaggagtaatacaaaagaaaagagtaatagaaactgagtcacttaaaacgatcattgtttgtataacccctgggaaattctccaaagtgtgtacctctgaggcagggcagggactagtgagatgagtgaggcattcacctggggcacaaaatttaaggggataccaaaactcagtaagcaagagaaataatacttgaatgcaaatttttttaaaaatcagaattaatgttcaaaaaatggtgaacaaaatgtcagaattttaagtaaagacaagattgaaggacaggtatactcaattcgaagtatgcagatctcagcagcccagatgtaagcacatgggtggtagatgaaagatgggtgatgatactcttgcccatactgccacctgctgctggaagtggaaaatgccgactgtcttcccaaagagtgtcacagcagtcgaccaggttccacactcacacgcagaggcatgagtgccctcttgtgggcagccacccagttcaggaactttaaaaaaaccctgttcagccgtgcctggtggctcatgcctgtaatcccggcactttgggaggccgcggccggcgtatcacaagatcaggagatagagaccatcctggctaacacggtgaaaccccgtctctactaaaaatacaaaaaattagcagggcgtggtggcaggcgcctgtagtcccagctactcgggaggctgaggcaggagaatggcgtgaacccagcaggcggagcttgcagtgagccgagatcgtgccactgcactccagcctgggcgagagagggagactccgtctcaaaaaacaaacaaacaaaaaaaacaaaaaaaaaagcagaacaaaacaaaacaaaacaaaaccctgttcacctatatcccgctaggaagctgagtgagggatgaaaagaatccaagactcggagttacaagatgtagatttcagtctaagctttgcctctcgcttgctgaggggtctggaacataccacatcactcttctgaagcagtttctgggcttatgccaatggatctcatcacctcctccaacaatcgttgaaattgttgaatttcaagaggtcctttctgtgatgatgaggaacaggctgcctggcatgaagtacgtacataattctctgtaagctgcctcccccaaccaccccatctcaatcgatcaaatcaaactatcatccacttattattactgaaggcgagacacactagaagacaaccagagagaaaaagttactgcagaagcccagacagtggagcactggcggtggctgaaggataaggaagactcccccaggaggggtcactagagccaggcccacgatggctgggtgggccaggtcaggccaagagctggccaacagcctctgaggaccactgggccacttctctgatgttttatttcagtgacgttctggccacacgaagcaagcattgcagtggtggtggaaaggccaaggcctttggaaacagccctgggttaaatcccggctctgctacttaccagcttcaggaccagtggaagtccccaaacctccctgagtttcaactcactttgcttattttaaatggtgataatagcacagcttgtcctgggtggatcacgtgaaataagacaacgtatttaaaatgcctgcgcctggacccctgagcagctttctgtgaagagtgggaaggaaaaggacgcacgggtcgggcagtgctggccgtcgtatttggctcccgggatgtcctgaggaagaaggggaatgcccagctccccactccccgccgaccccatagcaagagtcagcatgtcagtgcctcccagaaatagatctacagcaggagaggtcagcagtgggggcatccccctagaaatggggcggggggtgggggcgatgctggattccagcagatggaaacgattctacaaaaagaagcctggagctttgaatagagctgtaacgtaaataaaatatcgtgtcagtgttagtttcctggctttggtaactgtgctgtgcttagcagcagaccggggcgttttcatctccctattctttccctccttcctctcctcagtcctccgctcattcccaccctcctgtggcatgaagcgcgtgtgctcagctcgccctccttcacctcctcccttctcgcctacttcatcacggagggagctttcgaaccggctcctgggacctcctccccgccccgcggacacagcacagactgcagcgcctctcctctccgcgaagctgcaccaactttatttgcaaaaagaggctccaagcgcacggagaggatgggggctgcaaggtccccaccctcctcccggcctcccgcggcccctgccctcctccaggccccccacggcccccgccccgccggctacacgatcccgaactggcagatgtagggcagctgatcgcggcagcgcttgtcgaaccacttgccgttggccgcgcctgacaggaccgcgcagttctcggtcttgccgccatcgggttgcgcggtgatctcagtctcccagttcttgtaggcgatgcgggcgccggtcatgtccacccaggtgccctcggccgccatgtcgttgaggcccagccagatctcggcctcgttgcccacgctctggcgcaggtactcatacagggcgtcgttctccgagccagtctgaggggtgcccagggtgcccccgcgcgagatgcagtcctcgctggcctcgtggaaggtcttcgtctgggtgaaggccagaaagcatttcatgtgcaccttggtccccttcaggcagactgggagtggggagaaatggctgtcaccgaaggtccccctgttccccaggcaaagagccaaccgcccaggccaagcccaccgtcctccatcccatcccgtttatcccatcagtcctgacagccccttagacccaggcaaaaggggtcctgatggttcatgcactttgaggacctggctgtggtggccactaatgtacagatccagatccccactcaggaggtcttggtgctcccgcggctgggagaaaaggcagcccttgtgctacagaagcacccagccccagctgacaccccttcccaggcctccacctcagtcatttctggcctttacccaccccatctccttgggtcacagaggctggcctggtgcctgcactgcagctcagctctccctctgcccacttcctcttccccccgcccccacatgtgtggctcctagggctcaccctaacaaattagctctgtctcagagtcagcttcccagggagcccagccacagccacctgctctggttctccttcctccatgcccctccctaagatcaagcagcttgcagggccagggcacctgcccacctacagcctaggccacacttcatgtacccagggccccaaatccctacccaaacagcccaagcaagcttccagggcctgccaagtgccttttgcagggtcagttctcctgagggctggtagggtggggctgagtggatagagctgagactgcaagagagaagacaggaagtgctgggcacaggctgtggtcagaggccggcgatcaggcaagggactctgaggtgtccacaaattctcagtttgagcctggccccaaaggttgtgatgaaggcacatatttggtcaagttaggaggataaaatctatttttgttttgcagtttgcattttcagcttgatttctagctgaaatatctagacatactctgatttctcctgagatcgtataaatcgttcaccttttactaaagatttctgtggaaaggaatatcttgacagacaggtgtatgtctgcatttgtcctcttgctggtgaccccaccactttgggggatgtctgcactcccctctatccattcccactcagttacttccatttcactcaacaaatatcaatggacagcatcccagtgtccccatgggcatctgacaccacaaccgactttaaacatggggcctgaagcattacagaggtgtctacccacagactctgccccaagtcagctgtcctacctcgtgctatcctacagcttagccaagcggccttcattgcctttccttcctgctggtaacactgacgtgctacctagacttttgttggggatgaaggattcactgccctggctgccaggaatgctgcaggaagaaagtcctcagctttcagcctcctgcagggactgcctcagcagaagacagccatctcttccaaggccgtgcccctccctagagcagcctacacccaagactgacccataagccctcttgccccgactcaggacagtgccgaagggtcatcccgtcatcagggctcctgaagtcagctgaggctttcgtggcaccacagtacagctcgacttctccttctgcccactcctgcttccttccatcccttccctagcacaggggttgatcctgagggtatctcctgataagtctcctgtgggttaaactccatctcagagttgcttcctaggaccctcacctgaacctccctccaacacataggtagtcctcagtcaatgctacttctcgtgatactatcattgctgccaacattttgttgctctggtctattcatgatcctgtcgatttatgctagtcctccacacctctgctcctgccctgccatctgcttggaatcaaccctctttatcttctctgattcctacacagctttcaagggctcaagtgattccatgaatatattgaggttcccagggagcagggccctggctgcatcacctctgcctccttgtgcctggcagagatgtaccaggtgggaacctcccatgtgtatgctggttggaggagggaaaggttgccccctgattccttcaactctggttaggtcaacagagctctgcaatgctttgggtgggtttattgaaaaggtgatctttgggttgtgaggacaatgaacaggagaaggccccaagaagcccagcagcttcctagaaatcagcagacatgggggctttcatatgtcatgctttgggcctccatatgtcatgaacttttttcagggaggtccccacctcattacctcaccccaggtggcagttgatgcctgggttacattgactttgcacagcacagagcttagacatgagagagaccttagagtttaccctgcctaccttacagatgaggaaactgaggctcagagtggcactgggctcattctaaacatacccgctgtgccaggcactgttgcctccaaatcccttctctcttgtccacctccactatagaggctggaaaagctacattcttgcattctcagatgttcttaaagctgcaggtggccatatgatagatttcttgtcaatgagatggaagtggaagactacgttccctataaatgagacagatgtggttgggctactcttcctccttcttgccttgaatgcactcatgatgcctggagttggggcagccatctgaagaccatgaggtgaaacttctgaacaaaaacttataactacctacttgcagacttactttttgtttaagccactgataggtttcctattacatgaagtcaaaaacacctctggagatgctccctttctcgagcactctcttcctacctgccatgccaagcaagctgtccaaagttacatgtttgtccttccttcaacagagattgactgagtgttgctatgtggcaggcactatgctgggcagggtagtggaagagacaagggcaatgaaaagcaaacatggcccttgtgttctcagggcttactatagtctagtggaggcagcagacacaaatcaggaaatgagtgtatcattacagactgcagtcagtgtgataaaagaaaggacactgttctgggagagcttataactgaggagctgattgagatgagggattagtgactcctgagaagataatgctggaggcatttattaggtggatcttgggggagcaattcaggttgcccaaacagcacatgcaaaggccctgtggtgggagtgcagaaggatggcagtgtgaatgctgaaggaaagcatatgaatgggagggagtgtgtaaaaccatccggtgagaaggctgttgggggtttctgaggaggcaggcggggaagggaaggccttgcagatggatgggccttggtcacaaaagcaacaggtaagagagtggctgtggacacagggtggtttatagatttgctgaggagtcaaggtgatttcccagctgataactcgaggggcagcatagcagagctaagtgaggctctgctcctttcggctgtcacaaggtccttctcggtggaaaataagggtgaggatgtagtaacaggaccactgcacgggtgtgctgtgaatgagttaacgtgcatcaagcatcaagaacagtgccagaatgtagtgggctcacatgtaaatagtcatcagtattgtgagtctgcatcaagcatcaagaacagtgccagaatgtagtgggctcacatgtaaatagtcatcagtattgtgagtctgtgttctccatagaatggaaggtgaggtcatataaaggtaggtaaatcggaggtatgtggaaaatgcagactatatgacaggaacatggggagtgagaaacaataggctgccaggtatgctggccagagggcatgaccttaccatgcgcctgggccctgttcttggtgattctgtgcaccctccctcagctggctagtgcagagccaggaacaccaaggcccagcttggcactgggcagcctgcctccattcaactcttgctcttccacgagtcaactaaccaacgaggtgagtatgagccaggttcaggacctgtctatgcctcagttgctgctgacacatctttaaaatggagctgacatttcatggagctgacagctcatctttaaaatggagctgacaaatcccacctcagcagagttacgattaagagagacagggtcagcaaagctgctgacacacaggagtgtggagctctctggggctgcagaggccagctgagtgaggggctcctgggagctttgctagggtgggccactacctctgccccatcgagcgctccagggtcacttctggtgggcagtagtggattcttgttggagaattttttgtcctcttgggacatccccacttccacaccacccagctgtggccagagatttggccgtacacatccaggtgagttttgcagacacgtgtcaggggatctccccaagagaaagaggtggggctccctgaacctggtgccttcacccataggcctggactaatggagccaggaccctgatgctgaacggaggcgagaagagcattgctggctgctggcctgggcccttctctcagacgctcctgcccagagaggctactgcctgcactcacccgtctgcagggcctgctgctccttcagcagggccacctcctgggccagggtgtccagacggctcttgagctcctcaaacatctttgtgttcacaacatctgaagcaggaggaaatatgtcagggtggggcagggactgagcaggaaggatcctaccttagctgcagagggatgagaggaaaagactcccctcaaccttgatatcttgggaaactttctctctctctatccttgctggtggtagtctaattaaccacttgtgacttctgccagggggcccatccttcacttgctcctgtgctgcatttgtttgggattgttgctggggatcagatggggctgggattagcagaggcaggggtgagggtgtaggcacaggcttcagtgatcccccaccacccagctaccttttcagctccagggaagaacagcacaggaagcacagcaggagccctcaagaagcccccaggttcacttccccaggctggaggaatgcgacacagaccagcaggcactccagcctggggcacgcatatgcagggcttggaggtgccacagacacgggtggcctgggcgagctgctcagcctctctggatttggttccctcatgtatgaagtggatgatgacagccccacctcctaggactctggagaagactaagagaactgaaacgcagagctgcctacctcagtgcttggctgagtgtgtgcccatcacagctactaataagatgagggcagaaggaacccaggttttccactcttacagaggaggccaggctctgggctaagccgttctacatgtcaccccatgtgatgctcataatcaaccctatgacacaggtaacgtgtcattctgtaccaccagcatttcaccatgaggaaacccaggctgccctaaaccaactggccgaggatggcagagccccagctggcagggctggcctggaacccaggtgcacatggctctgaagccatgctcttccccaccttccccatggcacacaaacggattcctaacaggagctgtcctgctggcagccagtcatgtaagagtcagcaggggaaggcggggaagcatatttctatgtgtgtgtaagttgagggtgccgggaagcatatttctatgtgtgtgtaagtttagagctcctggggcggaccctggtctttctgaaacaccagggcttcaggaaaggctgcactcagcttggggaagtgggtggggaaacactttaatggtccatttggctgtgtctgcatacattccacactcacaaagagtgagatcagagccttcgtccacccataaggtgcctttgcagaagaatcacaggcaagacacatggttgtgtatatagaaattagcgatgtaacttaccaaactggagcaaaaacaccctgatgagcaaggcaaaaaaagggagagtttggggctggcaaaccagcctgaggtcatgtgtgcctcacacagagactgcctccaccagttatagcagcactgtacccagtcacgtgatgtaccagcatagggtgccatgtgaggctgtgcaagggggcactgaagaagggcattctgctgagggacacatgaaggcccatttgtctcctaagccttgccctggctagagtgggtcagaccagaaaaagagatgcctttctataatttgtcagtttagaggaggtaccttttgtaatttgcaccaaggtgcccatatgtgcaaagtttcctccagggactgtccaaggtacaggaagctactctcattagctccacctgaggaagctgtgggagtaggtgtctctacggccctgggcagagtcaggaggcctttgtgctggcccactctctgagcctcaggttccttctgcgtgatgttagaatggatgccctccaggttcccccagttccctgttctaaaggcctgtgactcctatgaggccatccttccctccggagcttccctgccaggtgtgaccatgtggccccaagaacagatgagctcccagaagtactctaggctccccgcttctcacccaccctgagggccaggacaaggacttagcatatgctggcattcccttcctttgccagtcctgccacttgctctccccctcttggccctggcaccaactggtctcctctggcatgaccgtcccttctttggactttctcccgtacttttgggcaccagccctgcaactagattgcccctgagattctcattcctggctgctcctaggaatccctgaagacctgtggaaaaggcagatgctaaactcaccaagatccctaaaccagcatttccaggggtggggcccaagcacctgaattcttaacttttattttatttattgatttatttttgagacggagtctcacttactctgtcacccaggctggagtgcagtggtgcaatctcggcccattgcaacctccacctcccaggttcaagcaattctcctgcctcagcctcctgagtagctgggactacacgtgtacaccatcacactcagctaatttttgtatttttagtagagacagggtttcaccatgttggccagacttgtcttgaactcctggcctcaagcgatcctcccaccttggcctcctaaagtgctgagattacaggcttgagccaccacgcctggccaaggcacctggattctaatgtatctcccagatgatgttgatgcctgagtgagaaccaccatggttcatgtcttaagagcagagacggtgtttctctgctgtgtgtccagcatatagactggtgcctacgtggagaaagagctctataagtgcctgccatgttggtgggcgggagactgccatgggtttcagcgagaggcagggcctgggtggctgttctgttggcctgtagccctggaactccaggggccccttctatggagaccacatagggccagggttcaagtgtgacagctggagagaaccaaggcatcacgtgctctgacccttttttttttaacatgagtttaaaaagatttacataattatattaatactgaatctttggtaaacttgagaagctggcgatggttttccacattcaaaaattctatgatttgcctttggagctgcatcttttacaaaggctctcccttggtggcgattttggctaatgctcatagacgtaactatgcacggtattgtcttctctttttaaatgaacattttgtggaaggtaatatacacacataattttttaaaatccaaacagttcaaaaagctggtttctttcccagttgagactgcgcccagcccctggtttttcttcccagaggtaatcactgttactcactcttgtggatccttccagaaagaacttatgcacatacaagtaaaaatgtattattatataaatccctttttcaaagcaaatgtcagcatcatactcattctcttttgaatgtttcttttttcactttgtaaactgaatcttgaagatgatttttttatcagcagccagatttgccccattctttgtcacagtgttgtgaggccccatggccccgatgtccctttatgcactgcactagttcctggccagtgggcaactgtccatttatgaagagccccgggagggcctaagggaggcccccacagccccttctttccttttctgtgcccttggtcctagctgcttgtttctctgcctcagtccccaccctcatccccttggactctcttctagcctctgctccctgggggggtgacagccccgtccattgccatgacattccactgatgttgtctcaacacagcctggggtgacctcactgcaggcggggctgcaagggcaagtcttgctgtagccaaagcaaccgagggacaccccaatccccagaggctacaaagcagagcaaagctgcttctggtggactagtctgagttacatttatttcctgaaggctgtgatatgctacagaaatgagaattcatttcttcttctttttcttttccctgtgcatcaagcaacaagtgaggtgcctttatatattttgtatcataaaatcttcatgagaagtctttgaacaaataccactgtccccattttacagttgagaaaacaggttggaagactccaaagcccagcctgtgcagctctccctggtaagggctgagcgctgccagactcccaggccaaaggtttggtttctttaaaatattggggatgaggggaggagagaagagcaaagatcagtttggatgatctggaaggttcttcccaactctaagggtcagggattcttatgattctgacaaccaactctgctatgagagaactcccccaagccccaaagcccactttactcaagttccctagatgactcaaaaggaggaaaatgaaggaaaggagcatgaggacacactaaggagagggggacctgctccctggaagatggcacagggctctgtccccctccttacctttcttggcatttacaatcttcttgggcttctgggttggtggctcggtggtgacctgggtcaggagggagaagaggcagaggaggaggtaggccccccagagctccatgctgctgcgcgggcgggggctgctgctgcctgcagcgggtctgggtccgaacgcagtgacagccacggcccaggctgcacgtcttaaggcagcagccaaaggacctctgtccaggaaaccctccccaacttggctgcaggcgtgccaaaaaaataaaacaaacacacaagcctgcagaaggatgaagtcctgagggccacagagcctctctgccagggaacacccacgcagcatcctggccctgccttctagaaagaagcccttatttcctaggattctgagaaacacacggtggttgtcatcacatctgcggagcagctaccttgggtaggggctgaggctggctgttcactaacattaactcacagaagcttcacacccaaaccacgagggaagcactgtcctttccccattttaccattgaggaaattgaggctcggtgaggttagggaatttgcccaggctacccagctgtcacggggtagcaatgcccccttatagggtgatctggggctggctgtctgattggtttagaatatttgttatgattattttgtggctctgtctccatgtacttgatgcattttttggttaaaaaatccaagggattccttcccttcttgtcttccctttctcctgagtcctgtcctaaagccacaaagtggggcatagcaaaggtggcggagggagaagccatcgtgccccagaggtaccagagaggatgtggggagaatgtgccctcaaggggtggactggtgtggggtgtgggagcccagcagggtggagggagcatcctggggaaagcaaaggccctgcctggagtgctggagtccaagtgaggcaaggaggggatccatgtgggagagaggctggtggcagagacgggagattggttacacacagggatactgatcaaataaatctactgaagacagtgggagttaggtttcctattgtcagagaaggaagttatgtatatggagagaaaactggaatgaatcctgttgtgtgggattaaaatcggaatgatcagtgtacccttgtggccttgaatacataaagataagtccatatatatagatggaaatgtgtgtgtgtctagtccccacagtcactggggggcctggagcagccagccccgcatagcctggagcactcctagcacctgaatactggcttctgaatatgactttccactaaaggaaccagagcaccttgcagaaacggctgattctagcactgggaagtaggagtggggtgcagaaaatgagcccggaacttgttgttttgccagaaaacaaggaagtgcttaatgaataatgggaacacgtcagtaggacacagagccagcttgaaggagccttcagtggtcagaatcagggacaatttgagcaccaacatagtgacagtaacagatgggaaaccaccagtgcacacagatataagtaagtaagggaacgcattgaaagtctgatgttcttcaatgggatgtttacatagcctcaaagtatctgcccacaaaacacttatccattccagagagaaaaagagcaacttcatggtgaagaaggctggcagacatcacctcatctgtgaccaaagtaaacatcaacagggccaataaaaagcttgcagcacctggggggctgcagtgagaatgtggcatcactccataggactccggccagagagacatcagacaatcccaaatggaggagcattctgcaaaatgactgccagtaattttcaaagctcctggctgaggaagtgtttcaggctgaaggagactgaagacacagaactaaatgcaatatgtgattctggactggaccctccattctcaaggatgcagttgggacaaccagagaaatctgatggggtctgaggagcacacggcagtgatgtgttgtcacatgctgcatcatgacagttcagtcaacaacaggccacatatgtgatatgcttccataagattataatggggcagaaaaattcctaacacctagtgatgtcacaaagggttgtaaagtcatagtgcaactcattattcccaagtttgtggtgatgctggtgtaaacaaatttactgccagtcatatcgaagtagagcatataaggtcatgttagcacataatacttgattttgttagtccgttttcacactactctaaagaactgcccaagactgggtaatttagaaaggaaagaggtttaattgatttacagttccacacggctggggaggcctcaggaaatttacaattgtggcagaaggtgaaggggaaacaaacaccttcttcgcaaggaggcaggaggtacaatgaatgcaggaggaactgccaaacacttataaaaccataagatctcatgagaactcactatcacaaggacagcatgggggaaaccacccccatcgttcaatgacctccacctggtctctcccttgacacatgggcattatgaggattacaattcaagataagaatttgggtgagaacatagtcaaaccatatcattctgccccacatgattgtgctttgaaatgtgagagcatgagatttgggaggggccggggtggaatgatatggcttggctgtgtccccacccaaaatctcaccttgaattgtaatcctcataatccccatgtgtcatgggaaagaccaggtggaggtcattgaaccatgggggcaagtttctcccatgctgttctcgtgatagtgagtctcatgagatctgatggttttataagcatctggcatttcccctgcttgtactcactctgtcctgctgccatgtgaagaaggtgtctgcttctcctttgccttccaccatgattattagtttcctgaggcctccccagccatgcagaactgtgagtcaattaaacctctttcctttctaaattacccattcttgggcagttctttatagcagtgcgagaatgaactaatacgatgataataaatgaccgtgtcactggtttatgtatttactgtgctatactttttatcattattttagagtgtactctttctactttttttttaaaaaagttaactgtgaaacagcctaaggtgggtccatcaggaggttttccagaagaaggcactgttatcataggatatgatagctccatgtgtgtgactgtccctgaagacctcccactgagacaagaggtggaggtggaagacagtgacactgataatcctgaccctgtgtaggcatgggctaatgtgcgtttgtgtcttagtttttaacaaaaagtttaaaaagtaaaaaagtaataataactagaaaaagcctatagaataaggatatagagaaaataattttgtacaactgttcaatgtgtttgtgttttaagctaaatgttataaaagtaaaaaagttaaatgagttcaaaagtttacaaagtaaaaaaagttatggtaagctcaggttaatttattattaaaaaagaaaaccattttttaaaaaaatgtaatgcagcttatgtgtgcagtgttttatagagtccagagtagtgtacagtaatgtccacgttcactcaccactcactgactcactcagagcaacttccagtcctgcaagctccattcatggtaagtgccctataccagtgtatcattttctttatcttttatatcaggagtccccaacctccaggctatggaccagtactggtccacagtactggtccgtggcctgttagcaactaggcccatcagcaggaggtgagtggtgggtaggcgagcattaccacctgagctccgcctcctgtcaggtcagcagcagcattacattctcatgggagcacaagccctattgtgaactgtgcatgagaaggtctaggttgcacactccttatgagaatctaacgcccaatgatctgaggtggaacagtttcatcctgaaaccatcaccccaaccccgcatccgtgggaaaattgtcttccatgaaaccagtccctggtgccaaaaaggttggggactgctgttttataccatatttttactccactttttctatgttgagatacacaaatacttaccattatgttacaactgcctacagtattcagtgcagtcacgtgctgtacaggtttgtagcctaggagcaacataccatacctgagagcctaggtgtgtagtaggctatgccacctaggtttgtgtaagtacactctgtcatggtagcacaacgatgaactcgcctgacaatgcatttctcagaacgtattcccattgttaagcaacgcatgacggtatccctgttatggtcctacttgatggtgtgctgtgattatgtaggagagtgtctttgtctgtaggaaacacacatactgaagtattagacagcgatatggtactgtgttgacaacttacatagttcagggggagaatgttctttgtactgtcgttgcaaattttctgagtttgagattcttccaaaagaaaatacaatactatgtacttcaggcttttccctgccttctagggaccccaccttcccctgtctgacttagggagggatctcttatgtagtaggccagggaagcaggaggccagctgggctggcccagtgcacagtagtcctgccaagggtgggggccctgagcacggagcagagcatttgcacggcccctcaacgacactgggctccacctctcacattctcagagtgggaagggttttatattcacagctgggccctcgggagacaatttggagcctgatgattacataacctaaaaggggccttgttcctggaactctgggtgggtagcagatggtaaaagaaaattaatatttttgttaactgctttgctttcttggttttctcaccttggcccaactctatcttggcccttcagtggtaggaaaatgaacgaagtatgctttctaaacatgaggcaaccagaggccccatgttttccagggctggctgatggttgaagctatggggactgtggtggcgtctcacagggcaccgaatgcagccagggcagggcagaaggaaggtggccctcaggctgaggaagggacacagagggtgtggccagctgaggggaggaaggaatgagcacagggctccaggtggaaaacacacaagcagagtcttggagccaagcaaaagcaccttgcattccagatcccgagccaatgaggacagggtggggaagacataaagctggatatgtagcttagaggagccatcaagccatcttaaaagactctggatatgagcctggagaccacgggagaccaatggagaaccacgctgaggagggctgggatcagagcacactttggagggagcactttggctgctgagcatggaatgcattggggtgcccagtgaggtagcagagagatattaagcatgtgttcaacattagcccccaagcaaggggggacacaccttcactggggggagtgtgactctcctactagcccggcaagtgaactattcacacttcaggaaggagacatgcttaggaatttccattaagcagtaagcaacgtctttgatcttttcacctgcaggttttcgaggtgtgtgtgcatgtgtatacgtgcacatgctacacagagctcctcgacaagcacctgggagtccgcctgtgctgataaaatgacttacgtagaatcagggcagggaggaagtggcttttgccttggagcctcttcaagtctaggtttggcttgtctctcgagaagggtctatacagctgagagacacatggacagttctgacaggaggcaagttcatctcacaactttaaacatacccatatgttctcatcatttagctcccacttataagtgagaacatgcacaaagaggggaacaacacacactggggccttatgaacggtggatggtagaagaagggagaggatcaggaaaaataattcatgggttctagacttaacctgggtggtaaaataatctgcacaacaagcccccatgacacaagtttacctgtgtaacaaacctgcacatgcacccagaacctaaaataaaattaaaaaagaaagatacaaacaaaaaaaacccccaaaatcatggagacagaaagtaggatggtggtttccaggggcttggggtggggggatgaggatacacatcctcatcctgtgtttctggatacacagttgtagataggagagatgaaaaagttctggagatagacagtagtaacagctgcaaaacaatttgaatgtacttaatgtcactgaattgtacacttagaaatggttaaagtaacaaattttttttgagacggagtctcgctctgtctcccaggctggagtgcagtggtgcaatctcagctcactacaacctccgcctcccaggttaaagcgattctcctgcctcagcctcctgagtagctgggacaacaggtgcccaccaccccgcctaattttttgtatttttagtagagacggggtttcaccgtgttaaccaggatggtctcgatctcctgacctcgtgattcgcccacctcggcctcccaaaggctgggattacaggcgtgagccaccatgcccggcccaaaatagtaaattttatgttgtgtattaccacaataaaaagttgtaataatgcaaaaatagaatcacccaaggcaattggtaaaataaataaataatgaattctctcttgtgaatagaatattgtcctgtgtcatatctgtgggtgtgaaaagtgctatttcattaaatgtaaacatttaaagtacatctctatttttcgtaacctggtttgggcatttcatcatttttttattgcttcagtggtcctcaaaaaatgcaaactggccagaagcggtggcttatgcttataatcaaaatcccagcactctgagaggccaaggcaggaggatcaatagaggccgggcattcaagacctgtctggggaacatagggagaccccatctctacaaaataataataatttaaaaaaagccagatgtggtggcatgcacctgtagagccaggtactctggaggctgaggtggaaggatcacttgaactcaggaggttgaggctgcagtgagccatgatcacaccactgcaccactccagcctggatgacagagggagaccctacctttaaaaaaaaaaaaaaagggcaggggttcaataactcttgatctctgagttaataagcaggttagaagaggccatctagtctaaccacccctcgatgtgggatgtccctttccattgaccctgtcagatgtctccatatgttgcttaaacccttccaggaacaggaagctcattacctgaaaagcaactagtttcatcgttagacacttggcttgtcctcaggatccccctgtggtggggcaggttggcctccgggaaaccaccccatggttcctagtgctggcctgtggagcagtcacatgagaggccagcctgtccttctttgactgtcctttctccatgttccgttccttttttcttctcaatggatcctctacaatatggttcctggatgctacagatttcaatctacttcaatcttccagagaatcctcactgcataaaactgtgcttgttatggtcttcattgtggtgcagatcccagaacaaaacttgctttcacgggccttcctctgggccagggcaagtgcctcctgtgagcagactagaccctctattcaggaagccacagattcatgggctctttgtagcacctgggcctcatttgttgccactgttgagtttatggccattaaatatccagatcctcttgtccacccccaactctccctggccaggtgtggactgccattgcagccacctgcaatggattcaccgatagccctggtggagccaattttaccttctacatatggaagatgatatcagtttcatcttccttgcattaaagatctgctgacactgtccacaagacctcaactggcccatggcgcggcaagtgggggtggcttcagccaagacagtgatgctgcattaatgttcatgagcgaccccaaccctcaaggaagtgtctgttcactaacacaccactctcacagcccagtcttttcatactaatctccctgtacaaagaatgatcttaataacaaaacaggcaaaaaaaatcagaggaagagagctctaaaggcatatttcagctttcaaggtttttttgtgtgtgtggtggtgttgtttcttttctcaaagctgctggaagtctcagttatacaaaacaggctttggtcactccacccatattagcccgaataacatgcaaacttctggcccaccatggagccattccagccccctaccccacccgcaaccctcacccggcacagatgtttccttttagttccactggccccatgtcaacagaaatgtggcccggctataacagaggcagagaactttccacatgcccttcaaaggtaagagcatatagacagcctggtgcaggggctcacacatgtaatcccaactctttggcaggcagagctgggaggattgtttgagcccaggagatggaggctgccgtgaactatgatcatactactgcactccagcctggaaaacagagcaagaccctgtctctaagaaaaaaaaaaaaaaaaactttgttggcctagtactctgtcattcattcaagtattggctctgtccctgtgtaccgggccctgagttaggtaggtcctaactcaaccaaatcttagctctcaaggggctcacagtccttgttgttttatccttaaagctctgtagtgtggcagtggaaagagaatggagtcccgagttccaaatttggttgagatacctggcacttgtgtcgttttggatgagttactcaagaccaaactcctcttctgtaaagtggggtaataatctctaccctgcttgcacatgggattctttcaaggagcaaactgaggtctcgcatgggagacagctgagcaacctgcaaggttgtgggaaggaggaggggtggtctgagccaccacgctgtcccagtgtgtcaaggagcttgatagcctctttccacacctcgattccttccactccaagggacagtaacttaatcacctgatttgtaactttgggaataataaactgggcatgcacttacctgatgccctcagctataatagttcacacaagaggagaaaaacagatagccctatagaatgctacaggagatttcaatcttctttagctgaaactccctgacttcccatcatgtctgagaatttggcaaatataaacccagctgtgtgtttagggatctttgagtttctaaatcatcacactatccctacacagctttgctggaggttttgcaggtttccctttccccggtagagttcctctatgttcccaagcctgattcttattccacgtccagaatctgcaaatgcccccagggaaggaaatgccagtgacagcctgctcacttcagaaagtctcccccttctctggaattttaggccatgaaatcctctttacttccagagcttcccaaaatctttaatgatatgactcttgaaatgcattcagcatttttagctgcagcagcatgaatggtggtccaccatgacctacatatcctacccagaactgaagtcaaaacacttgttgaacacctcccttggaaaatgtcctctgatgggcattaacacgattcccgactatctgcgctttttttggcccattcccacaggtccatacaaatcccttttctctgatcatcccatcttactcctttcaggcccttgtccaactagccaagttactccctactatccgggaatccacgtgtacccttatccctttgtgcaaacttaacaaccaagtgcactggctgcactcagttctctcactgctgtcctgcagggctgtaatgcaggagcagtccctttggggcacacatcaatatagagaaccaactcatccacaaggcagacctggggttttcctcttccagtagctggctgcaggagtcccctcccccatgaggtcataagtgtggatgagaggcactggcgaacaggggtgacagacgaatctgggctacctggtatattccttggttgtgcccactgaactgctcaggcctaatcctgaatgtacattttcatgttgcatggattgttgctgcacccacccaaacttatgacctggtgggtctgacaataaccagcatgatgggtggctcaggtcacttgaggtcccagggttgggtattcagtctctaattgggcccagtggcaagccagaaacttcttttcaaactcactcatttggaggtgaatagctttccaccacatggccttgctccagaatcctagggtctgtgctacaacgttcctgttgggcctgccagaaactacacagcacccttacctgccccagatagcactagctccgttggaatttctgggtcacatggagcaggagggatgcttgtaatgcagcttaaacaggcttcagagtcctgtcttattctggactcccattcacaactggtaggtttgtgaattactcaataaatgcattgagacagcattctcaagtacagcattcttgtctccaaaatccagaggcccaacaagtgctgtacttctcagtgagggtagtggggatgagggtgggtgcaaggttcaaaatctaccaccttagagggggtatctctcagaatgccccacaccactggatacctaaaaacattatcagtgtggtggtctccttaatcttcatggggtttatttcccaccctctcaggcatgtgtcttttactaggacttccaacggctttccacgtcctatgtactagatctaataaacatgattttatcaacataaatagatcagcgcgatggccctgaagatatcactgtgacaaaaagtaggtgattaacatagaccgctgacaagacactgaacacattttgcagtccttccacataagagatctgcttttgacccttcttgttaatggggattaaggaagaattttcctaacttatagccacatacgaagcattggaggctgtgctgattaatcttagtgaagatacttcatccaacaaagcagtggaaattggagctctctcgtgtgtttggtggtcatctaccatgattcacctggcttttacaggggccacagagataagataaatggcaatgaggcggggacaactacccttgcatccttaaagtctttgatgttggtcctaatctctgcaatttctcccaagatccaatattgtctctgatttattatcttggccagggaagggaggcagtttccaaccttgacccttcttaccattgtggttttcattccatcccatttatgacatctcaattgtaccacatccatcccacctacacatttggggaaggaaattatcccaggacctaatgaccattgtgagccagacttacttgtaccatccatttattacctagcctccatcccccatcccctttgactggagagccttggtggcatttcaggtctcctaatacaggcatcaagtcaaaacccagattcaaaaggcttcaaatcacctttcctcaatgctggtattccagactggagaactattattgtaggtgctgatggtgatattacaggattcttatttaaagacaccaacctccctcctgtcaatggactttgatctgtgaactggcttacggaaactgggtgaaggactggaatttcccattatagtggttgacataagctttttatgctccaattattattatttttaattttgacaagttgagtaaaatcctgattggctgcccatgtcttaaccctcagaacacataatctattagctacggtctgactgccgtagaggcagaggcgaggctgaggacagaaggtaatccatcagaggcatctagcaatgcatggaacattgtttccccactaactagcagttactttatggccattatttgggatgtataaataacactgggataaactcctctgtattaatgtttccactccccttgtatcataaattatttactttgattacatgcccagaagtagaattactaggtcaaagggcaaacatttttaaggctttttgttgagaaggagtctcgctctgtagccaggctggagtgcagtggcgcgatcttggctcacggcaacctccacctcctgggttcaagcaattctcctgcctcagcctcccaagtagctgggattacaggcgtgtgccaccatgccaatttttgtatttttaatagagatgggtttcaccatgttggccaggatggtctcgatctcttgacctcatgatccgcccacctcagcctcccaaagtgctgggattacaggcgtgagtcaccacacccggtcttttaaggcttttaatgcacactgccagattgttttccaaaaagtctggaatagcgaagacttattctctactggcagtttgtatgttagacaactggctttactgagcaaacaaactactgttaatattctaaactcggccaggtgctgtggctcacgcttgtaatcccagcacattgggaggccgaggcaggcggatcacaaggtcaggagatcaagaccatcctggccaacatggtgaaaccctgtctctaataaaataaaaaaaattacccaggtgtggtggtgcacgcctgtagtcccagctactcagtagggtgaggcaggggaatcgcttgaacccgagaggcagagactgcagtgggtgagatcacgccactgcactccagcctggcaaaagaacgagactccgtctcaacaacgagaaaaaaatctaaactcatgtcccagtgcagtggctcatacctgtaatcccagcactttaggaggccaaggcaggaggattgcttgaggccaggagctcaagaccagcctgggcaacatagtgagaccctcattttaaaaaaataatttgctgggcatggtggcatgcctgcagtcccaggaaggtgggaagatcacatgagcccaggagtttgaggctgcaatgagctatgattgcaccattgcattccagcctcggtgacagagtgagaccctatctctaagaacaaagaaaagaaaaaaaattaactcgtgatttggaagactaaagaatcagagacaaaaacccacttgaatattatttaacattgcatttcttatactccgcccttactttgaccaacttcaatgttcttctacctaatgtttatttaaagaccactaaagacagctgtggctctgctggatcaaacaggtctgtcccaggataatatttttccaagtctttgccagtctctgtcttcagttttctcttctctcactctgacagttgcaacaatcagatctttccaataaatgcctctcctggagagtccctgctcatatggtgttttgtttcatttgcaatatacgtatattacatgtaggggtggccttcagggaaaggtatggggtggctagaaacagattccaccatctttttctcttctttctccatttttactggaagtgcttagccagccatccaagctggtagctgcttgtcataccactggcatggcaaagcctcatctgtctgtctgaagggaagtgaagcagagctgagtctgacatatatgacagtacccattctaatttatgcatctcaaaatgatccactggaatcaaccatcaaaagcaaatgcttctaaactttattcacactcgagttgcatctctgcgccaccactgccaatgttttgtcatgtcacgggcagtcaaccaggagcagggaaggagagaccaggctgatttctgccttgttgggaacactgtcatggtgcctgtagatagtcactgaagaaacataaaagatgaaaacccaggctatgctctcaacagggcagaagctcccccattaagcccaagtctaggcagctgcttctctccacagggatggacctggccttgctgggaggaacgcccacaccaggacctctggaagcagtcccaagggcttcagctcacattatgttctttccatttggtgataaattcctaacgccttaccccatttgctaactggaatgcagagagcaaatgccacggttgaaacgctctccttcgtgaatcagctccttccccagggtgttttaagatttaggagtttcagttcccctagaaaaaaaaacaaaggctgctctacacatgaagagacttaattttaacacactgcacagtgagactacaggcttataggaagagccttctgggccagcaagcatagtcttcctttcaatgctgagagcatgaaggcagctgaattatcaaatgacaacatcttgaaagctgccttcttaatgctgacaaaacaaaatcttaggaaacaccagggagtggttataaaacacaaagcaatttcaaaacaagagtgataagaaaggatggctaagggccaaagtggctgccactaaagcccctgaacctagggaattccattcggatctcttggagggcaggaagtcagagctggactttcccaggatttgggatggctaaccagacagacagacgccctgggtgtgtacctgcagcagagtgcctcctcttttttcctctcccagaaccacccaaatacacaaggtgaatgaacttttctttgtgattcttatttttaaagttcttcaaggggaaaaaaattcacaaaatacatatcataagcatttcctgtaaaccagtttctgtcaggtctttactccagcttgtgggggtctcccttggtggcagagctctggatttgtctgccactcactagataagggccagacccagatgggtcactgaatggtgccttggcttcaactgaagaactctagacataccaaaccagaccagaaaatagcctttaattttacatgtacaaatgctgctgtaaattcgtaacagcgaagaaaaatatatacgaaccggtttaaaaggaaaagtaaaaaacaatccacagttgagcagttgatgtgcaaatcatcccaggaatccaactttctgtctcttgggccccaggctttcttccttgtgcacaacactctgcaaggaggcatgcagtaccttgcccacacgcttgccagtctgtggagaagggacgggagagagcacacacccccttgtaaggcacacacactctgaccagaaaagcattcctttctgccagctagtctttctgacattgtacacattccatctgccttagaggacttttatttaattaaagcaaattaaaacaaaaaccacagaccccaacaacataataaattttgtaaaaatcgtcatatcaaaaaaataaaaaagagagacaaacaccagcccccaccaggcaacaaacagagagcagcaaagcctgccctggccattagctcatgcttcactatcctgctgccactgcaacaagcaacaaagttgtcaatcaaatctgggcttgggtacagccaggtgacactgtactatagggagaccacagggaatccagagtctgtctggagaagaaacagatgatgccaaggacattttagtaagcagcttctcattcacctcccatgaagcctctaagcagaactgctcaggtgtgaccaaagtcagtacctggatgggatctttggtgtttactgccatgctgagatgctaaaggcagtgaaatgttagaatcgaaacacatcaagagggacaacccacaaaattaataatcagtccctacagagcagacacgagaggtaaaaaaaacaaaaacaaaaacaaaacaaaacaaaaaaactcaatatggctgggagtagtggctcatgcttgtaatcccagcacttttggaggccaaggcaagaggattttgcttgaggccaggagatcaagaccagactgggcaacagagtgaaaccccatctctacaaaaaactaaaaattagctgtgcatggtggtatgcgcctgtagacccagctactcagggggctgagatgggaggattgtttgagcccaggagttcacggctgcagtgagctgtgactgtgccactgtactccagcctggataacagagcaagaccctgtctcaaaaaacaaccaccaccccaatataaaaaaatatatttttctttatgaaactgttattctgtctctgggcccaagaatcattttaagaatacaaagaaccaaccacaaatctctaccttatcaggtctttcacattcccatagcagtgtggattcaactctgccactggttccattctcaacaatgttgagataaaaacatccatgcctaaatccctgcctcaatctcttcagttacaggtgtatcctccccagagtaatgacttgtgtgtcttctcccctggcccctaactgtaacatgggatgagatcccaagtatgactaaaactcttatgaaaagatgatttcgatctaaaaggctgggaagtgatcacctctatgaaatgcaaagtcagggttaaaggtcaaaaaggccttcgggggctggatgtggtggctgatgcctgtaatctcaacactttgggaggctgaggcaggcagatcacaaggtcaggagttcaagaccagcctggcaaacatactgaaaccccgtctctactaaaaatacaaaaaaattaactgggagtggtggcgggcacctgcaatcccagctactcgggaagctgaggcagaatcacttgaaccagggaggcggaggttgcagtgagctgagatcgcaccactgcactccagcctgggcgatagtgtgagactccatctcaaaaaaaaaaagggcctttggaaagattttcccataacattagaaaaagaaaaaaaagtctgaatctgtcaaacaggggtactgattattcatatacatgagggtggggagagaggacaacaagaggagatgagatggacaggatgccaggacttgagagggccttgacgcctctgaatccagatgcaggaaagcaactgcagaggctaggggtggcagcctgcacaactacccccaaggctctcagctccaccaagtcattttccagattgctgcatccctgtgtgagataaacagtaagacagggccacagagctatagtcccctgtccagagttagcagacctcactccccaaacctgaggggaggacaaagctcagctcactgaacagagctctggttctgccatctatgacagccagggcagatctggtttataaggctgacattgcacagtggctgggagcaggggctctggacgcacacagtcttggcttaaatcctagctccagtatttatgagcagggaggcctgtaggcaagctgcttatcctctgtgtgcctcagtttcctcatctgtaaaaatgaggacaataataatagttacctcacaggttgttgaggactaaatgatatatttaaagcagtgaaaacagtatctggcacatagtacgcacacaataaactccagctatttgtttactgtgcttgttgttgctgtttaaagaaattctcataaactctcctgggagggggaagagtaccttctaaaacaaggtttgacagtcccttgcctagaggactttggtagaatttatgcagcattaagtctggagaaatttgaactcagggtgcttcatggagcacagagaataagagctgccattagctgagaactgatgacatatcaggcactgtgacatgtgcttctcctctacacctcacatcatcctaataacaacctcagcagtgtctgggcagatattactattatcagtcccactttgcagatgagggggactatggcccagagccaggtttgcagccagggcagtacaccctcacagcccatggttgggaactccatgctatatacagtgctcattttggccttttaaataacatgataaagagagaaagtagatgtcatgttcttggattcttcagtatgaagtcattgtttctaaacacaaaagaagagtgcttgctattaagcaatgatctctgggcatgtgtggtgatatagaggttgcaagaaagtatgaataatcagatcctgctaactctgttcctggaagttcagtcagtcaatcagtcagaaaggtgaggtggatataggggaaagaaggtctgggaaacaggtgagcaggaccctgtccctgccctgcggggcttccaggccagtgaggtgacagacatgtggggcaaacagtacagagaactgtagaagcgccttgatggctctgctagggatgagggcaacccaacccaactccagtgggtcagatttcttaccatccctgcttgtctccatttaaacacttctagagctgtaacgaatttgggagacagccacagttcagcccgtgcttccacctttactcacccacttctagggacaggaagcagtgagccaagaattctattccctcatcaagtcacaaaggcctgcacttttggagttacgagtggctctttacattatgaaagtccaacagtcttatttagacacatagaaatgagatggggggtacttactgaggacaattaatggttactggtaggctccttacctcccagtccagagtatccacccccacaaccccccttgattaggtcagcagacccctggctcaaaccagctgttcccaaatctccaagtttggggtcaaggctgtgaatggggagaatccccacggtatgaccaagggagcaggaagcagcaggcaccccggccaggtccctgcaccttcctcagaactaaggcctcacctccatcatctcgaagatgctctctgggtccaggctgcccttccccactttcctcatgcacgtcacaactcccttgctggtcaccgacaccagcaagctggccagcgagcaggcctcctcctgaagagtagcatccaccacatgccgatagccaatctgcaaaggcagggtgcgtggcacacggtgggtcacgcaggccccagagtcccacccctgatggcctcgtggtgggaatctctacaccaggcaaaagtatttgcactggtcattccaggtcttattttagattctgctcacgaggaaaacagctgagggattgttcaacaattctcacaggccactgtgtgggtggtacaataaaaacacgatatggaaaaacagggcaaggtggtttaaaactagaattcagagaccaaccaagacaaaggccaccaaggctttccaacagaggggcacaagggagaaattcacacacaaggccacatggacgtttcactgatggcaagggggaatcaagagggtccatgctaagggacacactcaagaacaagccaaaggctgggcgcagcggctcatgcctcccagcactttgggaagctgaggaaaatggaatgcttgagctcaggagtttgagaccagcccaggcaacatggcaagaccctgtctccaccaaaaatacaaaaaaatagccagatatggtggtgtgagcctgtggtaccagctacttgggaggctgaggtggaagggttgcttgaggttgagccggggcgggtgggggggttgcagcagaggttgcagtgagcctagattgtgctactgcactccagcctgggcaacagagcaacactgtctcaaaacaaggccgggcgcggtggctcacgcctgtaatcccagcactttgggaggccgaggcgggcagatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccaggaagcggagcttacagtgagccgagattgcaccactgcagtccgcagtccggcctgggcgacagagcgagactctgtctcaaaaaaaaaaaaaaaaaaaaaaacaaataaacaacaagaaagaacaagccggctaggtgcggtggcttatgcctgtaatcccggcactttgggaggctgaggtgggcagatcacccgaggtcaggagtttgagaccagcctggccaacatggtgaaacaccgtctctactaaaaatacaaaaattagccaggcatgatggcacgtgcctgtaatcccagctatttgggaggctgaggcagaagaattgcttgaacctgggaggcggaggttgcagtgagctgagatcgcgccattgcactccagcctgggcgttgcagcaagactgtctcaaaaaaaaaaaaaaaaaaaaaaaaaaaaagccaagacccaacatcctgccatcctgttgtctgaacacttcaccacatcctgttcatgaagtgatttcagtggaattaaacctgacctgtttagctttattttgagataatgaatcctgagtggaattagctacaatcccagtcaatagccaatacaggcctctttgcacagcctggggcagcattagttatatatcacatcagcctgatgttcagctccacagccctctatgtgaaaaccactcatgatacccaagacctgctccaacctcccatttcataggggggacagtgttcgccaccctgccactactcaaccaccctagaccccatagagttgaggtaattaaaagacatggtgctttagtgaagcacatggtatgtggaaggagcttaacaaactctggctactattactacaaacacactcatggctcccaggaccacatcatatcttccaattaaaaagaaaagaaagagctactcgtggtagtggtttctagtataaccaaattattggatttgggtaaaagctacttctatatggtgtgtggtattacaacttcttaacttattaagtaacctcagcaggttgggattagaggagacccacacccacagggaagacaaaaaccataaaatacaagttataccttgcacagagtgacaatgcaggggacattctccacacttagtcgtatgcagtcataagggtcatctgacaattcaatgtccttcgacccctcttcatcctccaaaactcgaacccttggtatcctggaagcagaagcactagtaaaattcccacttggaggaggaaaaataacttctttttaagattgagaataggagttggaatccctgtgtctcacaagagaaagacacgctatgcctattctttatcatcctcatccctgtcatccctgtcaaaagcacacaggaggcgccgcagtgcaatgaggaaaggcatcttttagaaaatgatgctgggtcaatcagatatcccaatggaaaaaaaagaatctcaatccctacctcacaccacacacacgaagccataccaaatagaccatagatataaaaaataaaagacaagacaataaagcatttagaaaaaaacatctgcatgaccttggagtagacaactatttcttgaacaggatacagaaagagaaaaaagttacatattcaattataacatcatgaacttctgtatatcagaagacatcatttaaaaactaaaaatataatctggggagataaaatactacctgacagattacataaagaattcctattaaacaaaaaaaagacagcccaacagaaaaatggacaaaagactcaaacgtagaatatatttggatgtcttcataaaagaggctgtctgagtagccaataaaccaagaaaaggtgctcaatttaaatatctattaaaaatgcaaattaaaactacactgtgataccaaggcacaaccaaaataactattaaaaaaaaaaacaaaaaaaaaaaaacgccaggcatggtggctcatgcctgtaatcccagtactttcagaggccaaggcgggaggatcacctgaggtcaggagttcgagaccagcctggccaagatggtgaaaccccatctctactaaaaatacaaaaattagctgggtgtggtggtgcacacctgtaatcccagctacttgggaggctgaggtaagagaatcgcttgaacctgggaagtggaggttgcagtgaactgagatcacgccactgcagtccagcctgggagacagagtgagactccatctcaaaaaaaaaaagcaagagttgacaaaaatgtgaaacaacccggaactcttacatacactgctggtggaagtgttaactggtaaaacactttgtgaaactggcagcatctaccgtaactaaagatagccataccctataacccagaacactcctccctaacagaaatagagaaatatgtgcaccaaagacatgcacaaaatgttcatgatgcccatccctatttgtaatagcctcaaactggaaatgaaccagatggccatcaacagtagactgataaacaacagcagactggacagtagactggataaacagcagactggacaaagtcacacaatggaacaccatacagcaaaaagcaagctatgactaaggcagcaacacagatctctcaaaacacaatgcttagtgaatgaggcagacacaaaacagaacatagtatatgataccatttatatcaagtacaaaagtaatctattcttttaagatgctggttatcatcagtgagtgtaattgcatgggggtacagaaggtgtgggatgcttctggggtgctggcaacattctgtttcttcagctgggtactgaaaaacacatttaacctataaagtcaattcactccaggctgggttggaggagccaggaaggaagaggtggtccatccagctactgtaatggaaacagcattagtacttttcccagttcctctaacaaaaccccccatgattgagccctgctggccatccatacacaaggcaacatctagatcagatcaggggagcttcagccagagaatgttgacaagggccaaggagttctgtaagggtcttccccatttggagccttcccatcagaggaagttctactaagtaatatcctatttgaacaagttgtcaaccatttacacacacacatacacacacacacgcacgcacgcacgcacgcacgcacagtatctcccaatttcccaaccctttggctacaacaagcctgggcagaagggctaaagaataccctcaggtggcctttacccttctaaaggaccctgaatatgccaatagtctctccacataccagggggacttgatgccttagagtccccattccttgctgcctgcagggctgttcttggtctgaggatgagactatggctgtgcccatgacaggtgtcctcccctacctgagcagctgggttaacctttctggtatacagtttggccagcaactcccccacagctaaacagccttgtctggttcccaatctctctttttgcctgggtgcctataggaaccagctggcagatggggagtcatttctgaggctcaagataaatcagatgacagcttcctttccttccccaacagggcccgagcaccagctactgctgtgggatctggcacgcaagctcccacggtggccaagagtgccaggctcacatttcaaatagtctcaacaaggagcctagtggcacagctaggggtgggggactctacagctttcattctcagcaaatattccagcctgcaatttttgtctgctctaaattacacagggagtctaaactcatcatagaaaagctctaaaaaacaggtaaatgttatgttggccaaaatatgagcactgaaaaataattacagtgattacttgggggtacatatttccagacacattacatataagaactaccaaagtaaaatacaacaaaccaacaaacaaaaaccaggatgaggggactgcatttagtgaactattttccatattaacatgcctttaaataggctgctgtgtggacttcaatcccctccattgtgaaactcaggttgtttccagtttcttaccattacaaagcagtgtaatgtttattctaggatgtgatgaacatcctagaataaacatctttgctcatttattcaattatgtccttaggttatatccctagaagtttctaatcctcgttttttaataggatcctctgttaccttaatgtaggctctctcataggatgaacaccctatcccacgtatttactcataaatgctgcaaattttcctcaaagtacttggagcataaaagggggaaaggtcaatcagtcagaataaatgtcaactccaaaaaagcatagcaacttgtcccttctacacaacctgtttggaaagctgaaccatgtggaatagccatttcctcttcttaaaccaaagggaagcctgttaccctgcttttagaacacacatgtgtacaatcaagcaatatgcaagcacttactatgtgtcaggtactgttcatggtgctaggaatataggcaagtacaaaacaggcaaaatccttgcccccatagagttcacccagtaatagtatttggatagttggcctgtaggtggtgtctactcttcttggcttctctgtagttttctaatatttttctaaatggtaggtgtctatttataaaaataacaatacaaaaaataaatacagaatatacgtatatatgtagttttaattcacgaaatctatcttttctggagtttaacgttagatgtcaccattttcaatgttaaaaccccctgttatcttcacatatgagctacaatagaaatttcctcagtgttccattacaagtgtctgctctggttctccacaggttcgcagagctgtttctaggaagacttaccttgtattgaagagagcagcctttacagcaatggaaatggcatcaaacaaatttccaccacattccagaagctaagggagacaggaattgaaaaaggaaaaaaaaccaagcatcacttattactttaggtattaccccagttaaaggacactgcttttttttttttgagacagagtctcgctctgtcactcaggctggagtgcagtggtgcaatcttggctaactgcaacctctgcctcccaggttcaagtaattctcccacctcagcctcccgaatagctgggattacacgtgtgcgccaccacccccagctaatttttgtattttagggtttcaccatgttggccaggctggtcttgaactcctgaccaaaagtgatccgcctacctcagcctcccaaagtgctggggtataggcatgagccaccacgcccggccaggacaccgatttttttttttctttccctaaatctattctgtggtcaaggacactgatttctaagaaatgctgactgtgtgtttataaaataaagataacatgtggcttctctcctggctagccatgcagtgactgcaactcactgacacagtccttcaccctaattacaggcactgccttgtcatagctgtgcttacgtggcccatgcacacaaggtcacagttggcagggctgtggtaccaacactcagaggccatggcttgtgggtgggctcctctcacaggcacttcaggcagttggggctgccctgaaggtgggactgatcacctttattttgccccagatagctcccaattgtactccaagtgttactctaatctttgctaacatatgcctggcctccaaacaaggagaaaacggtggctactgatgttgcggctgctactaggttcacatttactagtgtaattacttctcgtatgtaatgatcaatgtatatctgatgctcagacatgaaatactacatgttttacattacttataatgaagactaaagtctctcagacaagcttctgcccatgagcgaaagtgttgagtgcacttacgtatgctcatctagcagggaaaattagagcacatttaactggaaggtggcatatccttctgtcctcattttagagaggccttggcctgaggttatggaataaagccgactgggctgccccaaataagaaaggtgagaagtcacacatagaaagaaaagtcatgtagttctgtttttgtttagagtctatctcctctgcagttgaactgtgaactcctaaaggctgggactctgtagttttgttcatccttttatccccagagcccaacagaaggggtgctatgaggaagaaggttagtgattatttgtgaaagaacccatcaaaagacaggcttgtgaccaatcaccccaccaaaggtcagctgtgtgttgttagtgcagcaaagttctaacaggtttccctcttggagtaaaaactgatgccattagagaactataaagagcaaagcaaagtgaaatttccatgaagttaaattttcactctcataaaataaccgaactgaggggaaaaaaaccaatactggaaacaggtgggtcatctgactgtaataggtttgaagtaagtaagtatgaaaacatggcagggtgcccagcaaatatctgtttgaacatgggctctgtctgaggactaaccagaccagttggtaaaaagaaattaggaggtttcttttctactatcttgcttcaaggattgcttcacagatttccaccacctcgcttcaaacatggactcaatctattcagtatatcacccatccactgatgaaaactatgtgaatgccaaaaaatggatcggcctcatcaataatacaattttcaaaaatgcttttctaattcattaaaaacttttctgaagatgacaactttttttttttttaaagatggattctcactctgttgcccaggatggagtgcagtggcaccatctcggctcactgcaacctccacctcccaggttcaagcaattctcttgcctcagtctccccagtagctgggattacaggtgggcaccaccatgcccagctaatttttgtatttttagtagagacagggtttcaccatgttttccaggctggtctcgaactcctgacctcagggaattcatctgccttggcatcccaaagtgctgggattacaggtgtgagccactgtgcccggtcagaaaatgacaacattttaaaagctcatgtcttcttccaaaataagcaaaacccttaaaacaaatatttcagaagaaatccaaatgccaggagtcttaaaaagaaaggtctacagatgacagggacacaatacacattcccctggatattcctgcgcaccatgtatccatcccctgctcactgaagagggctgcttctgagctgagataatgtcccagtagtcatcagttttgtaaaagccttccctaatagaacaggcttctgttgctttgactttaactgactgaatcaaaagcacatcagtccccatcactgggccatcctacaaaactacaagtgtgcatgaatactgaggatgaacaaaggattacaaaaggacaaatgcagtgtgccacacacttgtgtcttaactttctctagtggcggaggggaggggacataaacttcttcagacacaggatggaactggagagttcacgtcatggggctgcacctccctgggcaactatgaagcctgcctctaccatcctcagtaaggactacaggctgccaggtcccaccttctcaaacccaggacctgaaaaattgccaacttagtaggaatcatactacaaggtacatcccacttatcagagatggaaaaaaagcaaacagatttgtaatttcattatttttacctattagtggtagcattgcaacagtaacctgctagataatggttaccactgctaccttttgactatgctccatccaatatcaaattaattttaaaatatctagaaaactccaccctgtctcaatagagccaacatgcagagccaggctgtttcttttcatgaagttcaccatcagttcacagatctcctttatctgcacattcattaaagaatctatttggccaatagcttagctttttgtccttcatctgaagtggaagatgtagttgctaatctcatggttcaaaacagacccaacaagagcctatatataaacaagcaaccaactgctacgtgattatacaaaagcaaaattaaggccaggcacggtggtttgcacctgtaatccccgtaaggccaggcacggtggtttgcacctgtaatccccgcactttgggaggccgaggcaggtggatcacttgaggtcaggagttccagacatgcctggccaacatgatgaaaccccatctctactaataatacaaaaatgagccaggcatggtgacatgtgcctgtagtcccagctactcaggaggctgagacatgagaatcgattgaacctgggaagcagaggttgcagtgagccaagatcacgccattgcactccagcctgggtgacagagcaagactccatctcaaaaaaaaaaaaaacaaaaaaacaaaaaaaaattaattagagctacacagagaagttactgtcgagtgccaaaacctgggtagaggagtatttgggaggcaaagtacaagggaagaaatgacgggctggactcaaaagactcccaggggagtagactctgtgtgggaggaggcagggcctctggggcctcacccaggaaactaaaggcaggcacgttctgaggtgtttaaaagaaacaatggcacagtgaagtcaaaccaggtgttcacatcatacagacctggctttgagactcaacagcactactcacaagctgagacctcttgggctagttgatttacctctgtctgtcttagtttcctcacttataaatgggaaatataacagtgtccatttgtaacaggtttataaggtttaaatgaaaatgcatgtaaagagctaatcatccttccacacagaatgtaccaacctgcttaaattctgcccatgaactctgtctggcaccatccagagaccatctcttgttttactcttcctggacaatttttatgggcaattttaggtgctatcatgatatgactataattttatcatagaatggcattatatatatgctgcttacatctatgttgtatttaatttttaaaaaaattattataggagaccatcttttcccaactaatcccaccctataagttgaaagcatccacctgaagaggaaaaaagcactggaaggaaaataggccaactagtctttccaacaaaggtagaatgtggccagtacagcacgatgatactcaccagcacatccacatagagaacccagcagtgctcccgaggactaatgcagagggtctttaagtcgacactgcttttattgttaaatatccgatagagggtgttagcgatctcggtgccaaggtcatcacctcctctaccttcaaattcaggggtagcactggctgaactatacaaaacagaaacaaaaaaactgggtgagtctttccaagtgcaaaaagcaaagaggcaaagctttattccagtttccctgtagaatgctggaagagccagctgctcgacagaaagtcactgagatgaggaaaggatggcatctgccacttttcctgactccagacacatgtaatgaaccagaccagcactgtgacctggatttgtcagtgtgtgtgatgggatttcccaatagcatctaacagaagccatctttagtcaaagagaaacaggagagtgatggtaatgtgaacctcggccgataataattaactctcttatcttcagagtataataaatactcttctctggcaggcctaggaaactgagaggcctagggaatgaagcagtctgggttacagaggggttttgtcatatacaccacctctagtttcacagctttagaacacactacgatactctcaatataaaaaccacaatgtaagtacaataacctttctggaataacttaaaagacatgtatgatagtatgtcagagctttgtcagaaactttagatatcactgtactgaagagaaggaaaatgaaagaaagcaagggaaagattgttggcttgtaagtagtaggttacctccttcatttgatatttttcaagagaaaaactttttttttccctttttggcttcttgatatttatgcccaataacctcaacaaaactaacaggattcaacattagccaccctaaaaacactgaagtgtttaacaggacatttctgagagtttttggcttaatacaaacaaacccttaatatgtatatgaggtaagtaacattctagtaattattttactgtaacagtaaaggactagaaaggtaagaagccagtggtttcagcatggactctataaaatcacatattaaagccttctgaccccttgcccatctggaaggcacccagccctgcaccagctaccagagacctagagactaagtgaggtggatgcagacccaaagccagcagttccagtgaggtaggggagtttcaccatagggagcaaacagtgaggtagaagcgggagtaggggcacaggagtgtcaattagcattcaggtttaaaggcgacctcaaacctgggatgagcagagctggtcaggccagagaggcaggaagattccaggcaaagcaaaacctgtgtgaacgcccatggcagtgcccaccctatttgtgtaacactaaaagaaatctcacttagtaatataggtggaagaatgaatcccaaattaatcagactatgttgttacataaaattttgcctctctaattatgtactcctcctttaccactgtgagccagcagaatcccctttaaagtccccaagagagacttcattactgccatagcaacctcgctgttccctgcctttgctggactcaggcactgagccaagaaaagcagctcatttatggtgaaataatcaagtcaacagggaccaggtttttactttgcacagccagcaaaacacaacctgtttctaatttaaacactaagcaatcaatattaagtcccaggtcttaagtgcttaaaaatacatctacagagatttctgtgtacacaaatccagccagagatgcttacactcaaaatgtttacctttccctgaatgtagtgggcacatcctcctgggtgtgactaatttctttgggattaatgcactaactcttctacagccttgggagatgatttatagagcttcccaggtccaactgtctaaattaatctacctataaaaccatgcatgcccctggccaggcgtggtggctcacgcctgcaatcccagcactttcggaggccaaggcgggtggatcacctgaggtcgggggttcgagaccagcctgaccaacatgtagaaaccccgtctctactaataatacaaaaattatctgggcgtggtggcacatgcctgtaatcccagctacttaggaggctgaggcacaagaatcacttgaacctgaggcagaggttgcagtgagctgagatcgcaccactgcactccagcctggtcaacaagagtgaaactccgtctcaaaataacaacaacaacaacaaacccatgccccactggtttttttttgacactgggttaaagtggaaatttttacctatttttaaatggcttaaaacacacacacacacacacacacacacacacacacacacacacacacacacccattcttccaccatagccagcagtcagacagagaggaaggtttagagactcatgagcccaaggaactctcctgtaactggatggtgccatagctgtgcagtgactctggggaggaggctaggaaaacggaaagcaattgttcagggtgggggatggggtacaatgctttaagcaacataagaaagccacagaccccatattctgctgatgtgtgaagacaaaggctggaatagagaaatgaggattccacttcactactgggcactcacagcccaaggactctttctgacaaatttagacagaaatgtagacctggaaaaggccttagagaccatctccagaggataaaaacccaaatggctataggggtcagcaaggttactacatgtatctgaacaaagggccacatataactaatagagaatgatggaagctgtggcaaactttctagccctgatttaaggtccaccttaaaaaaaaaaaaaatccctacatgaaacaaaaatctcccaggtgggatctgacctgtgggatgacactgtgaaaccccagatggtctaactctctcattttacaagaagggagaccttatctttttttttttttttttaatgtttagcatgagctagacaccactcttagtactttaggtgtattaactcatttaatgttcacaacaaccctaggaggtatggattccattctagaaacaagaaaactgagtcacagagaggttatgtaatttgtccaaggccacatgatgactgtgcctggtaagctaaaattctaacccaggcagcctggcccttatcttctatgcttccctgtactctccttgaatctgtaatttggcaagcttggtttatagtctaacattagtcaggttcactttccttggttttaccttttgcctcagggaaatgaatgtatgctttggtcttggaacttatcactagacaacaaatgttggagtcaaggaatgttgaccaaggaagccctaaataaaaagctgctctgctctgttagagagagaaagaaaacacaggctggtaattgtagctgcctgctcatatgcatcacaatctactccttcagtggggggtgtacacacttggtcttttgggcataaaaccaaatgctttctgcatttaccaaaaccaattctgacccttcataaagcatgaccagtccctcttccagagttgtgggaaattgtttactgagctggataaactaattaagatcctgggaatgctacccctcccagctctccaccccttctgactcatcacctctaccctcctgcttggaacatctctggtttaactggggtaggctgagatcaaggccatgcctacctggaaagggactctagacactgggcccactgttgcttgcctggcaatcaatctagcctacaaatctatgaagtcttacgtccaggtcaggccaggcccacagcagaaaaagtgatctagtgggtacctaggcagggctgacctgggccttacccctccagtagtcatctagccccaacacaggccctaaggctgattcctctgagtgtacatgtgctcatgtctgagcctgtagaagcctccctgtaaatgggtaccagaccaatagtaagtatattctgaggttttcatcacaagcctttgtttgaagtgtctgcgagagttatctcatcagcttgggagactttgattacaattagcctcaaaaggcttctgcaggttgcctctctgctttgtacccacccccagcccctcagccaggaacagtgtcccctttagcagcactaagcaggcaaggaacccagatatagtgactccaaccaccaatgcaggcttgaagattctggttcaattttagtgaaaaatacaagtgttcacattgaaaaatagttaagatcccaaagggaagtgacaagtgcggagtattctgaaacatttatgaatgaaaaatgttctcctaaactcccctagttaaaaacccaagcctctctaagaggttaaaccacagtcctaaacccatcaacacaatggtcggagaactgagaagcaacttgatggctcgccgcctagtggcagcgcagggtgacacaccagctcactaaaatcttcccttcctttgggctttagatagaaaccaccttttcctaaagtttccaaattctcatttaaaatagcctactctcagctacaaccagcaaaccaaagacatgaaaaggtcagattttgctcccagtttagtgacagtgctgccaggcatctctggaacagggctcagggtcagtgcagcagtctttccaaagggctgtgagggctatatcaaagatttttcgtcattcccaagaaacagggtaaattatggaggtggcgacagtgtctatcttggctccatgtattatcatcccaagtagacaaaaccaagtgaaatgggttggcagaaaatcaattagttttctgagacctctctacccctggcaatttaattaaaactggaagttgctaacaagaagttaaatcaaactagactcagagcagcagaagaaaccctcaccaccatcaccaccaccatcaccaccaatttatttccttccactgggcagcaactatgtttcagcctgtggataggcaaatgccttgagctctccagcagaggccctatgcctggagtccaggtgggagtgggtgtgtggcacccttattgctgggcacatccacgggtgtccagaagccattcctattcactgattcagaataaaaggacacacttgtttatgcaattaaaataattatgctccttgaagactcaattgaggttctgatacaggtggcagcgatcagtgcttggtaacctctcccatctctgtaggaaatggggttttgtgactctctcatggtgattctacttgcccggctgattacattagctgagccacttaaagaaggtaaagtgtgccactttgagactgtccatcttgagaaatcaattcaggagaactacctagatactggagctcttgggcctgtggggatccttttgagacccacagaggaggaaaagagaccagcaggcagccactctaagccaggaaagataggctacttctagaagccagatcttgggaagaggcaactcaaagaatcctctcacactagagtcactcatcctttacagctgggacaagaaagggataagagcagcaggctaacttggagtcatatttagacacagagccacaatgaaacgtatcccctataccaagcatctgagggcaacaccctctctttggtgtggttgggctgaatgtctttggtctgcctaaaatgaatgaggtagaaggtaatgaaggagatgaaaaagaaagcaaattacagttcctcacacattgtctgctcctcagtgactgcttactgcattgaattaggcagatcaaggccaccagaggcattctgcttcctccaagaacaaaggaaaagataagttgggggcttgaacaaggtcaccatcatccacagtgacttaaaggatgggccaattccatgggacaactcaggctggtgagagaagatgagcagaaccaggagagacgacttgggggaccagagtaggggacaggaatgggctggaaaaaaaactgaccagaaaaatgaacatggatagttcttggactccccaagagcagccctccaaagctggcttccataggctgcatgaagtaaaatgagcaaagattcacaggttggacagacctgagctggcatttttagctttgtaaccctggggtagtcacttactctctctgaactcatttgtcatttctcttatacgagtactatgagaatcagcttccgtgtatggaagttcagactggaagactgtaactcaccctacaaaagtgggttaacatttgtgcaaaaaagggctgccattgcagtccaaaggtgctattttcagaagggtctgtttgcagggttggcccttggctggcatccgggaacctggctcccaggcaatagtaaactgatgggggtagtccactgtgcctatattgtgcaaataatatgatttatgctgaacatttgctttcctttagaaaacttcattatgtattaagcatcgagtgtctatgtgaccagctcccagtaaaaatcttgggtgctgagtctctaatgggctttcctgggcagaaatgtcacaaataagttactgcattttcactgctgtaataaaccttagctgtgagtatcactatatgctaagtctagcaaatctctgaatgtggaggtggtcttggggatcttgatacagggtcaacattatatacctacacccagcatgagcccacagagatccttacccacttcaagaaggcctggcttccagaagcaaagtaattgatagaagacgggacctggccagcaaccaaataaaaagccccgacccctagaatgtggagctaataatacttattgaacttattgacaaaataaggagaaataacacttattgaaagcccactggaagtcagtcactgtgctaggtactcactctattcatttcctcttcatcaccatggtattatttattatcctcattttttagatgaagaaatttggccacagtgagactgagtaaccagcctgagatcacaaagctggccagagaaggaagtgacattctggcccaaggctggctgcagacactgcagagccctctctcttctcagcacccatactgcctgcctagctgccacttcctcagcctgtcaggctgcttggctgaccctaggcttcatctgtcaagcaaatcatgaacagttttctgcagaactagagtaggaagagaaacagcacattttagaccaaatgatccttactgtgtatatttttcaaagcaccataacacaatcatttcatttgaccctcatcacaatcatgtgctaggctgcctggcaaatgtcctcctttatcggacagggaaaacaaggccagcaatagccaggtggttaagactagggcaggactcaagccaagagtcctgactatgtacctggcacataggaggaggtcagcaaatgcctgctggatggctgaatgataagtataaaagtgggttcaacagcaaaccagaggttcattttctgaatcttcatctttaaaatcatttatctttagaaatatctgcatagacagtactgaccagtcaacaaagaactccaagtagccttcatttggtttctccagcttcggcgtccccatttctgctttcactcccaccaagatgtctgtgtgaccctgcagacacatgcaagaagagtcctcactcagagtatgcagccaggtactccaccacctccctcctcttctggacatacacccctgggggactcttttaggagcagtgctaagacttggaaagtggtctttggaggaggtgagcagtcttttcagatctggatagaccccccctccctgagtttggctcggatcttcgatttccccaagagcaatttgcattccaaaagccagacagcgtcagcagctcattccttagggcctactcatttctccacctgggcttgaaccatggtcacagtactcaccagcttgaccctggcggacccactagtgttggacaccacatcagtttccacttcgacacatcggtagtcctcacagccacggccatccacacggaggtcttcctaggtgttaacaaccacagtcctatagtcaccccagatcaacaataactcctaaacggactcacccattttccccctagagaagatatatgcagaatatctcttttcctcttagtggatcatctaaaattctgtccttgtagctaacaacaacattactattttacatatgaggaaatggagactcagagaagttgagcgacttgtccaaggtcctacagctagtgaaaacaaagctagttttccatgccagttgtgtctgattgcaaaatctatactacataccactatatagaatatgcacacaaaaacaagatctgaacaagagacaaaataagccacctctctctaaatctgcaattcttaaattgcaccaagaagtatatgttgtcagagctacagagtacaatcatctcaactgaagccctcctacccctaaaactcaacaagatctactgtgtaaatagtgaaagacacctaatcttctaaagaggcagtctctagaacagggtcaacaaactaaggtcccttgtttttgtaaataagttttactggaacatagccatgcccacttgtttaggtaatgtctatgattgtttctgcactacaaaagcagagctgagtggttgggccagagatatgacccataaggccccaaatctttactatccagtcctttacaggaagtttgctgactcttttggcagaagatggttttcagggtggtctacgcgctgcctgttccttctgcccatttatttactccttcaattacttgtatcagtacaactcattggtatcttttatgctatggttataatccactactatcattagttattttgctgctcaaagtgttccaaatttggccactgggggcttctttgggttagtttttgtgctctttcaacatgcctccaactttttgagtaattatctactttctgcaacacaagatatctatcctcttgtgtcttctctgcccagccctagggatcaagcctttctccaaggagccctggttgcttttattggggaatggtacttaaaaccaggaactaggctctaagttcattgctgttggagtattatttcttccagaacttctcagcagacagagctagaaaatacagttatgtatactaaccacccccaccacacacacacaaatctgtttaattctgtatctatctacatatctattaaaaagccaagagttcatactgatagatcaattccaatctaacatcacatggttcattctaaccttcctctgtttcttatttgtaacttctttctcaaagaaggagaaagctggctcttattatctaacatgtatttctgtatttgttcaatcttagtatacacagtttctgaacttctaacccatacccctgtgagaaacaaatttactaatagcacacagtatttgtgtaaagttctgtctttagcctcagagtatccaggcaaaatactgttttccagttacttcagttcttttcttctacgtgcccttcagtgtggttacattactcacttgtaacacaggctcatttgtaacttgtaactttttttttagactatggctctgtcgcccaggctggagtgcagtgtggcacagctcactgcaacctccgccacctgcgttcaagcgcttctcccgcctcagcctctgaagtagctggaattacaggcacatcaccatgcctggctaattttcatttgtaaatttttgttttccattttgggttcccccacatcatggttacttttaattacttatttactttctgagtttgtgagctatcactatagttctgagagaaaactcagaaaagtatgctcagagaaatgtcactctcctccgtattatgctattttcatgcccctttcttcccattcaccctaggtttctcttcagtttcaggtttatctttcttgtattttctctgcacaaataagcaaatacatgaattttttaatatctccttgtttcttatatgaagggtggaatactatagatactcttacttttttttttttttttaacacttaactatatatatgcaggaaatcattccacgttggctcatggagctccttctcattctttgtaaacatttttcaaaagcagtttttttcagaaaaagaatcattagcttaatcagattctccaaggagttgatgcttcccagaaacataaaaaataaaataaaacactgctctaaagtatgtgactgacagtttatctttaaactgcctggctaactgcatatgtgactgacttttttgagaaattaaacagaaaaaagcaaaacactgcagcaccacacagtaccaatgatcaccctctgccatacttgcttcaggtctttcacccgtttaacttttcaatgacagaaaataaacatcacaaatcaggtggaaggtcctgtgcagcccatccttcccccagcacctttcctccctggaagatattgagaggtgacagcgtgctggcagccctcacagccctcgcttgctctcggcacctcctctgcctgggctcccactttggcagcacttgaggagcccttcagcccgccgctgcactgcgggagcccctttctgggctggccaaggtgggagccggctccctcagcttgctgggaggtgtggagggagaggcgtgggtgggaaccagggctgcgggcagtgcttgcgggccagcgcgagttctgggtgggcatgggctcagcgggtgggtgtgggctaggcgggccccatactctggagcagccagctggccccaggcagtgaggggcttagcacctgggccagcagctgctgtgctcaatttcttgctgggccttagctgccttcccacggggcagggctccggatctgcagcctgccatgcgggagcctccccgccctcccacccccacccatgggtgctcctgtgtggccccaacctccccaaggagcgctgccccctgctccacggcgcccagtcccatcgaccacccaagggctgaggaatgcgggtgcatggcaggggactggcaggcagctccacctgcggccccagtgcaggatccactggttgaagccagccgggctcctgagtctgatggggacttggagaacctctatgtctagctaagagattgtaaatacaccaatcagcactctgtatctagctactctggtggggacttggagaacctttgtgtctacactctgtatctagctaatctactggggaggtggagaacctttgtgtctagctcagggattgtaaacgcaccaatcagcaccctgtctaacagaccactcggctctctgtaaaatggaccaatcagcagaatgtgggtggggccagataagagaataaaagcaagctgccagagccagcagtggcaacccgcttgggtccccttccacactgtggaagctttgttctttcgctctttgcaataaatcttgctactgctcactctttgggtccacactgcctttatgagctgtaacactcaccgcgaaggtctgcagcttcactcctgaagccagcgagaccacgaacccacctcgggaggaatgaacaactccaggtgtgccgccttaagagctgtaacactcaccatgaaggtctgcagcttcactcctgagccagcgagaccacgaacccaccagaaggaagaaactccgagcacatctgaacatcagaaggaacaactccggacacgccgcctttaagaactgtaacactcaccgcgagggtctgcagcttcattcttgaaatcagtgagaccaagaacccaccaattccagacacaatatccctatcttgagtctggagatggattcaaaaagcaacagaatttcaagtctaagagagtaagcctttaggatagaactccagaaggtgatccctcttcactggaagacccataactatgtaactgtgtctcttcccaacctcacccatagaacctgaaggctttctagctcaatctctaacactccagccctctccacctccatgtgccccactccccagctaggaaagtgaatacccagcccagaaaggttattgacaagaagttctttgtggggtgtaaatatggtgtaagtatgaacaatcattaggaacatgactcatggttccaggccagctcctggcactaactagccacttgacttaggacaagccccttccctctctggattagtttcctcatttgtaaaagatggagattaaattagtctcaaagtgattctctaattctacagatctataaattaaaatggctgtaattatttgcaataaataatagcagctgctatttactgtgcatttactatataccagataatgtgcaaggaatactgcagttaatgcatttaatcttttcaataatcctatacgatagtgttattcattccattttacaaatgagaaaactgaggttaaaagatgtcaaatgaatggcccaagttcagacagccagtaagtagcacttaagcctcaagtcagagctcttaaccgctatgctacacagtccactgcattctaaaggatgtcttcactttacaaaaggactcagcagagacctccttcacaggatgaactggctggccacaaggtcacagggtttactactgctgcttcttcctttttttttttttttgagacaggatctcactctgtcacccaggctgtagtgcagtggtgatcactgcagcctcaaactcctaggctcaagcaatccttctacctcagcctcctgagtagctaggactacaggcacatgtcaacatgcccagctaatttttattttttactttttgtagagatggggtcttgctatgttgcccaagttggtctcaaactcctggcctcaagtgaccctcctgccttagcctcccaaagtgctgggattacaggcatgcgccaccacatctggtccaactactgcttctaaaatatcacttgctctgaaagattagtcacacctctttgtagtgaaaatgtacttggtccaggaaggggctggtgggctgtcagaaaactgagcctcatcagatactgcttttccagcctttaattcactctctgcctcctggagaaaggctcaggtgataagtaaaagataaatgaaaagctacaaattttcctttccaagcatgcataatttttttccatataaaaaaaggataggaggaaaacaaaccaaaaaaaccaacctaaccagtccatgaatcactgtacccagggcaacttttttttttaaacccagttttccttataaaaggcttaggaaattgtccaaacctgcctggcctagctcagggcctggtgccctaccacagtttttatttatctgcagcagtcacgagcaaaggaattaatccatgtgtgaacacttaaataggagttaccctgaagtaaaagctccattttaaaactcaagagatgtcaacagcatggagtggtgtcccctccttctcagcagaggagactgatgtgcctctagatcaagggcttctggatgccaggaaagctcttggtgactttcacagctgttacccatgtgatcacaacaaccctaccagtagggtgtggtgtggtggaaacagccaccttccaaattatacttaaatctctgttgtcacatgccagttttgtgaccttgacctaaatagctctaagcctgtttcttcatctagaaagcagggataaccccgaccttacagagttacaagagaacagaaacgtcataaagcatttaaaggagtccttcagtgtaacacataggagtccccccaaagcagttcccttcccctgcttctgggggcatgcattaactcactgcatcctcaaaaacaaccctgagagaggttacagataagaatggaggcacctaagtttcaatctcctgtttgtgacagagtggaaggacatttaagcacagacctactttccctcacacccaggaagcccagtcctattacttcttaatagaaactgacaagttggcgctaccaatctgacacatctggaaggactttagactcaaagtggtcctctgaggttatgttaacccctcattaacttgctttgacttgtctaatactccagattcctaaaggagaagtgagactaaattccttcccctactagaaggtgactgccccccgcccttaggaaaggggccacatttggtccagctttgcaggctcgggcccatcacacagcaggcaaaagtaggtgttgatccttgtttgactttccaaccctgttgagtagccaggcattcctctgaaaggatatggctccataactctgcatcctgcagtgtctgggcataaggctttctgtgccatgggtctgtaaacagaaagggcagagagctaaaaatcaagagtcctgagggctggctccaattctgtcatggccagactgagcaaccgaatactgactgctcaatctcatagttgaaaaccaggctgaggccctgatctccctcttccatgctatacccctaaacaatgcttatgatgaaagcaagatccacagaaaagaaatggaagccatcagctgggctacaactcccttcaacagccaagaacatacaataaaatggctttcacagggttccaagagccctgtggtagggttcgtcaattgccatggccaggtctgaacctatgagggccagtttaatgtccaggtcatagccatagcactcagtaggctgaacctgggaaagctttattgtgcctaaagccctgtaaaggccacataacagtcaccatccatccccaacagccaggaccaggggtaggtgcctgaaccaaaggcatataatccaaagggtgaccaactctttttggcgtgaaatactaccagaccaaactgattctctcattgcaatctggtctctgatctgagaaacacttgagagaagaaaggagttaaagaggagctgacaggtcatgatatggaggagcccagagaggccacacgaaagtaaaggtattgggcagaggcagattctacaaagaagggaagctggacagcaagtggctgcagagaagggataaatcttggcagagaaaagcagagatgtcactagagataaagacagacagccacacaggccatgagataatccacggagcccatgagaggcggtacctcagagctgtctggggactttccagctcttgccacagatcccccttctcttttttctttttctttcttttaagagacagagtatctctctgtcacccaggctggagtgaaatctccaactcctgggctcaagcgatcctctggcctcagcctcccaagcagctaggcctacaggcacacaccaccacacacctaattttttttagagatagggtgttgctatgttgcccagactggatgccaactcctggcctctggtgatcctcccacctcagcctcccaaagggctgggattacaggtgtgagccactgcacctggcctatcccttttcttgagataattgaaaaatcccgattccttcaaatcaaaagaggtttaattctcaggagccacaggctgaatctttaatgaggtcactatgaaggctggggatctagtgtggatggtttaagacaaagtcacacttctgatggaaaaacaaacttgaaagggagccagcattttttctgtgttaaccacagcccaagtgcttgacatctcttatctcatcattcctcataaccccattctacttccaggtgcataagtccccattttacacaagggaagcaggttcagttatgcaagtaaaaccacttattgtaaatggtgaaggtgcctgctcagtctgactccaaagcctcattcaaaaagaggcaggaaaccatatgacttcagcaggagagagcagagatttctttatctctggtcagtggcttacccatgggccaatgtctggtggctgcccccaaatttcccaacactttatgataatgtccattctcaggccccagccccagagagtctgattcagaatgttggggtaaagcctcagaatctgtattttgtaggtgagtaaaatgcacttcaaggcttcagaatccctgggctaagagggaggttagcaatggcttctcatggatgaggaaaacacacatctagcccagtaagccagaaaagaggataaatcctagattctaaaaattctgaagtctgctccaagttctgcatggtatgggcagagtaaatcgtttatgatactagtaagacaaaagctatacaaagaaatgcaatatagggttctaaaggaacttatactcaatgtgggaaaaatgcaaccaaaacaatacagcagtatatgccatatactatttaagctctagaaaaactggggagtgggaggtgtcaattagaactttctctttcccttccagtttccccacaagcttttagagaaagggggaaagaaaaggaggtagaggaagcaaagattctctcctgccttgatctctggatccctactgaggaaatggaagaaatgactttcactgcagcaggaaggtggcctcagagtcaagtatgggctttgcaatcagacaggtctggatttaaatcccagtgccaccactcaattactgtgtcaccttgacaagcgactcaacctgcccgagctcagttcctcatctatagagataacatttaccttcagaactgttgtaaatattcaatgaaataaaaattataatatgtacctaataagaatgggatatagccttcaaagactgaaagagaacctaacagaaaccaatcaaattatttatcaaaataccgatttaatccacctttttgattctctgttctcccctgggagaggggatctgttcaccaggttgactcaaattgtatcacctagactccctttgctggcttctggttgggtttgtccagtggaagataccagatcagagggtgcccctcacccccaatctagtggccacatttctgatagtgcctgcatctatcgaagactatgacttatgttgggcagcccttcctccacagttccagctatcactgaaatgtggtaatactgtttcctcccctggcccctttggaataggggcagtagccactcccagtagttgtcttggggctcctcaacatctcttattggttccctgaaaccccccccatactgctctagagtcccatcataaaagtctcctgaactacctgaagagggttccattttctgccaataactaaaatgatccaccctcccttctcacaaactgacttctcccaagtgtgacacatcctctagtggccatgtttgagcctaattattctgtccatcctttccctcaaccccctaaaagaactagagtttctttctcttggaaacatgagttcagaactgaacgagaaggaatggtctcttttacagaggaactgggaaggaaccacattttttctaccactggcccaagaaatagaaaaccaatctgtagggagacaaaaacaaagcaaagagggggaaaaaaaaaaccagcagagattaggattcctggagaaacacttgcagccttgtaatccatactgttttgcttgagccgatgtgttggttaccattactagcaactgaatcctcaacacatcgtgaggttaatttcaactgcttctaactatcaccaaaacaagatgaaatattccctgaaatagtaaaagaaccaaaggctgaagggaaagtgacatcagaagctgaaatggacgttactggaccaaaggtgaaaagtaaaacacaaaatgactaggactatacaagcaacaggagttcaggcaggcactgcttaaggtgcactgccggcactctataaccaacgcaacaaaagtttaggagatttcagaactgaatcagttgagattccatggtaggctcattcacctgcatcctgacctttatttggatggtgtaaattgtgttttgctcctctatacatatggcatattttgggccaacattaataagcccttatgaagacgttgatttgaagcccattactctgcatggctctgtgatacacagagctgagcatttaccaacaactgtgcccaaatatgtccatggtactggtgagagggaggtttaatttaaaaaataaaaacaccatccaactcattccccctttaaagcttacatcacccattcaatgctactaagaacctaccaagtgctagacactggctatgccttaagggtcccccatacagacaagtcaacaggctattgccttccaagatccatgatgagcgaatgactgaacctctaagacctctaggatcgtgcttctggccacctctgcaagctgatcttccaccatttcccccagcccaccccttgggctccacatgtcctccacctgaggatttacagactcaccaccccttccttctggaacactggtgcctacttaattctcagtcatgctgagaactcagttcaaatgctatttccttagggaagcctcctctgacctcccagtctagatcgtgtccgttttttccttcatagcattcagtacaattttatatataaacactcaagtacatttatagtttctgcatcttccttctagcatgagagctatataaggacaggttccttcctagcccctgagtctagctcagttctgtgttgaatgaatgaatactgagtcctgaagatacagaggaggaatccttgacatggatttaggggagcaattccacctccttagggaagccttcagagcattacaagtccctggaattctttttatttattaaaaaaaaattatttctttagagatgggctctcactgtgttgcccaagctggtctcaaactcctaggctcaagcaatcctcccatctcagcctttcaaagtgctgggattacaggcgtgagccacaatgcccggcccctggtatactttaacttcaacctccactaactataccacttccttggcatagatcttacattacctttgtttttattttattcacttttactctctgtttgtctccctcctatctttcatttatttcacaaccatgttttggcatccctgctgtttcccacataacatgccaggagctagatatatgttggtaaataaaattaactaatgaccatggtgggactctgctgctggatagctaatgaactgccgtgggaattaagggtgctggggagaaagctctaaccttgaggttacagatatatccatgcctcagtgccactttcagggatgaaatgttgagagaaaataggacacatgacagagtcactacatcatggtaagctccggtaacaaagaagaccaaaggtttttaaatttagaggaaaacggttatccgtaatgtgtccctaaaaaaatactttgaggataaaaatcacctgaacaaagtgtatacaaaaatatagcagggaaagacatatctaactgcttttgggcatttttatgccccctcacacacaaataacatacatgttaccctgtaatacacacatatgtcccactgttgttaatcctgaattataactaaaatatgcaactgtgagttctgactttattatccaggcataatatgctaaatattggcatttcttcatatataaagggcccagaagataacggcaggtcacgatttttaaatggacatgtccttaactcacgttgtgggacttcaatgatagctggccgcttcaatccgatggctacatcacgggaccactgactttgcagttggtactgacagaggaaaggcatgaggaaaagaggtaggagctgtcgccagaactctgccaaggatgggatgaagaactctgataggaggaccacaccgtaggttaacaagtggagacacagccggaggaggatacagggtagctcgttaccaggtccaacatttttcaaccctcgttctggagtggtcataaccagggatttaatatagaacacagaggacattaggttatagctgcctagggatcttagttcttcattggcaaaatggaaacagcacttaggctatcggctgcctagccgctttttttttgagactcggctcactgcaacctccgcctcccgggttcaagcgattctcctgcctcagtctcccgagtagctgggactacaggcgtgcgccaccacgcccagctaaatttttttgtatttttagcagagacggggtttcaccatgttggtcaggacggtctcttgacctcgtgatccgcccgcctcggcctcccaaagtgctgggattacaggcgtcctagccgctttttaaaaacccttccccctttatttgtacggcaatttgtattttcaaagtgcgttcacctcgcatgcgccctcctaaccacgaggtgaggaaaagcaggccagaagcccacctccaaactcccatttcctcgaagagaaaactgaggctcggacaagatctgtgcgcgaacgccgaatggatggccctggggccgatgctctctcactaagaaaaggcctccgagactgcccaagcttcctgcccgggttcggaatcttatagacccgcaaaactgcaaatgcgctaacagtcctaaaaacgtccacgttgccagctctgaattgcaaacgccggcagcagaaccgtttaatcacaaggtaaacggagagtcgccgcagctcggctgcctcctcactggcaaacccagggcaggccgcgacccgcagggccaggctgaacccggcggccgacccaacgccgctgctgtagctacctggacgccatgcacgatgtacaccttctccgcctcgctcagcgtcacggacgccatgctgccgagctgccccacgagccgcacgtcatctgcgcgcgtcccctcctctggaccgcgcccccacgtcccacccccccccgccccgcgtcagcgcgtcatcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacggtcagttgggaagggaaactggggtaggggtgaagaagctggggtgaggcgagcctcacgggccgggggactcccagtgggagaggcgtgcggcgtagttgctcagagctggagttgacttaggagcgtgtgtgtgtgtgtgtgtgtgtgtgtgtgtgtgagagagagagagagagagagagagaccccgactaaggaggggcggacgtcgtgattggcccgggggtgctgtttccctgctcttctcccctccatttctctagtccctaggatggctggagaggcgatgcagccctccctaggtagttcttggtgggaagggtccgggaatgggggacactagtcctaaggcgtccccacccctccacccaggaatatctctcgctggctcgctcactctctgtgaccgaacgctgtcccattaccttgctgggacctcttgcctcgggtgcttaccagagcgttgtcccacagacgggggaggaggcgcttggtaaccggcactggcgaggtgcgcagtgcccggacgtccccaacgcttcctagcgggaactggaaaccccggcttgatggaagtgattactgggagctgtgagcagttgcccgaaaaaaagccaaccccaaccccttgcgatggccgagtgggagtatgggcattggatacccggagaggatatctgcaaggtgaagctggggtcaccaaaggaactcattaaggcggggctgacaaagtatggtgcaagttttaaaggagccgtgtggataaatgggagaaagttaacccaaattagttgaagcaaggagggcaggttaaagcaattctgatgactttcctgatgttccatttttgaggaccctcagccaaaaaaaaaaaaaaatggtatttatcagatagtgggttcaaatacagtttcagataactattgggagcctactatagataggctttgtgctacctttagaacacaagacaagtaaaacatactatgcccagagaagttccctgggcagatgaaggctccagggccaacataaccacagatcatggtggttagagctatgatggtcgcatcagtgggcacagtgggattgggaggtcgtctgataaggttatagagaggaagtgcttgctcacattcttaagcattaaactgctgagctccaaaattgatgatcagttcttcgtagactggacattagatgtttcttatgtctctacgtaattctccacaggggcacctaaaaggaagacagcttgcagggttggactttgccttccagggaaactgaaagaggtgaagccggaaggatttcctccctaatgaaggcacaggtgccccacctgttgtggcacttagatgtgtttgtgtgtggttggacggctgggttttatgtgaggagctctgttgtgataagataacatgagattgctgatgttataaatgatattttctagatgtgctagagattgctcagaaaggagagaccctggaagtgggattttagaagctaggatatctgaggagactgaggatttaagaggtgacagcaaatggacagatcagaaagacacaggaagaaaagcctgagttcagataccatggagttatctttatataaagattttccaatgtcttaaaatatagaacatgtatttgaactgtccccccctcacaattgacgggaattccatactggacaagggtctgcagtatttgctaaataatgttatgaacgatgtcttatatattaggctaagtaggtaagagagatgtaaacagtagaatgttcctttttaaattgtctactaaaacaatgacagtcttcactaatcattcggcttaaatgctgccagaacatttttatcacctttgctgtaatagtgcattggacgtctttaaaatccataaattctgagttcttttttagtgtattgaagtaattcaaagaacatatgataaccaaaaaaatcaagaagtcaaggatggcacagtattaaaccgtcttgtttttccatcactattagattcatttattgaatgaataaatgaattggggcatactattctgtaggtttgtgtattctaaaaccttatactctaattttcaacactaatttacatagtgcttattgtatgccaagcattgttctaagcactttataaagattaaccaggctaggtgcggtggctgacatctgtaatcccagcactttgggaggccgaggccggtggatcacctgaggttgggagtttgagaccagcctgaccaacatggagaaaccccatctttactaaaaatacaaaatcagccgggcatggtggcgcatgcctgcaatcccagctactcgggaggctgaggcaggagaatcgcttgaacccaggaggcggaggttttagtgagctgagatcacgccattgcactccagcctgggcaacaagagcgaaactccatctcaaaaaaaaataaaaataaaaaataactgattcaatccttgcaacagccctgtgatgcaagtattcttatccctattttacagattgggaaatgaggcacagagaggttaaatgccttaaccagggtcacaggttacatcattggtaaatggcagaaccaggacttgagaccaggcagtctagctctcctgcccatactcctaaccatcaccttacacagcctccccccaggttttattacattcaccagattatttggtgaaggaaatcccaattttgttatggcgttggtaactgtcctatgaactatatagttaatcttaattccaaaagcaagaagtctgttcaagcataaactcatatcccttgaatcatttttctagaggaacatggaatgtggtgctgatgggatgttgctgtgtctgttgcaacccaatattttaaacaaggtaaaaggttatatatgagcagaataagagcttaactccaagtagctaaggagagagccctcaatggcaaagatggctgatagatctggtactagggttgagtagcatgcatggagacccagattccaaccgtatgccatactcagatatctagaaactccagacagtgtgtttgcatgcctgtgagtccctggtgttcttatgggcataaagagataaactcaaaacacaacacctgcctaaaagtagtttagaatttattatagtgggggagcccaggacctcgaactactgcatgaacaagacaataaaataaagtgctcaattgagacgtggcaattagaagagaggccagcctataataaggtgctaattgtgcaggccaggtatcaaatacaaaaggtaaagagctgctgctagccacaagccggcaacaataacatgacagagatggagtaactctgtcccacccatccttggttaattaaaccaataaaagccagttacaaaagagcttcagggcaatgctgagtctgtggtgctgatgttgcagagagcttttttggagacagagtcttgctctgttgtctaggctggagtgcggtggcacaatctctgctcaccgcaacctccgcctcctgggttcaagcaattcttgtgcctcagcctcccgagtagctgggattacaagtgtgtgccaccactcccggctaatttttgtatttttggtagagactgggtttggccatgttggtcaggctggtctcgaactcctggcctcaagagatctgcctgccttggcctcccaaagtgctgtgattatgggcatgagccaccatgcccagccatagagagctcttaaaagcccagcaggaaaccttctgttcccagtcctaagcagacatggccatgttttaggccttttcctttgcattttcaccattagcccagcacccttgaaatgtacaaagtcagttaccgttttgcctgtagatctgtttcctttaaacactttgcatttgtcccgcctgtaccttgtcttaaaagaatgaggtgggaggatcccttaagccccggagtttgagtccagcctgggcaacatagaccccatcgctaaaaaataataaaataagtaataaaataatgatagaaatgaagaatatctgtaaagaatactgtcatagtctggccagcaggtcttcatctgtcttctagacattgtaacttgagattacagtgatagaaaaattgctagtaatacatgggtaaagcttactcttaattagaggaaaagttatacagtcttcatgtgtgtttcattttgggagagtgacagcatgtttcctatgtctcattagggcatatttgagaaaagggggtaacagatcctgcttaccaaatgtagaaatatttaaacacacacaccctgatagccatggaaagtaacaaagtctcaagtagaagtggaggggtgatgtctcagtgttgacctgttggggaaaaaatgaggctcatgccatgctgcctttagttccttcctgttttgcattttaaaaaatcatttgctttcctcctcggaagcagatttccagagacaaatggccagttcattcatggctgtcaactgtgaaggtgagaaggctccaggtgcatgtcccacttaattcagtcatacatcctaatacatttggaatgcatgggaaatgtcatcatttcatagtctcctccaaaccatagacttcgtagtatgtattgacttggcacttgaactcttggcaagatatgaatatgtatttcctattcaaggtcagtggagatgcaatgcctttgagtgagatcactttcttaccttagcaaggtaagcctaatgagacaagtacagttctggccacagtcctgttgcagtaaagtcttcagtatgtgaagtgtatgtttctaaaccaagaaatagtagcagagaatctagaaagacaggttgtttaggaagataacaatctatggtagaaagacttccgggcatcttagtccaaagatttgggctttgctattaacttgctttatgactttgaacaagtcagttaacctaagtctcattttgccctcaagtgagtatcttgccaggtttttaaactcagaatggatcctggatatgcaaatatttgaatattgaaaaatgaccatgtttaaattggggtttttaagacttctttcatttaccacttcattatacttgatatattttgctagtgctttttccactctgaaaaaaattaaatgaacaaaaggaagtcgtaattttatgctgtacttgattgaaaaaactaaacatgctcaggaaattgctaagagagatagttactagtgggcttctttttgaatattagcaaatcgggaaaagaggtaagtgaagcttttggtaaaaaaatgtaaaatccaagatattaacaaagaaaacgttgaatttgctcctgagaacagaggactcatagaatctcagccctgcaaggggccctagcaatcagcgtgatcttcccctttgttttatcaaatgaggaaactgaggcccagaatggtaactgtcttgcctgagatcatgaggttagcgagtggcaggattgggagtaaactctggcctcttgattccaagctcagtcttcattccctttagcactagcctcccatctatttccaaagccctctggtgaatggctggagagcccctcaccaggtaagcaggggctgtgttctctttctcacagcccattacagccttctttctgtggtcccaggttcctcccagggctctgctcttgcactgccacttacagtgcctggaataagtgataccagcagattcctgaaagtcaaatggctcccctttttaggccctagtacctagtacagttgcaataactggttctctcccttccctagctagtctttcggatttctctaagcacttttgcttttagtccctaaaaacaaccaagctctggcctagcctaagtgatgtcacagtggctgtgtggctgcacatgacacaatgtgggcccaggtgtcattctcaacatcctcaggtgggaacctttgctgataggtctctgcctagcatggggggaggcgttttttctcacaaaaagcagcattctgttacttggcaccacaggaagtatttcccagccaaagcagattttagggattcaatcctaggtgactcttctggctgaggcttcacggccttcctgcctcctaggttagggcaggatcggtattctaaatgttggctggtattcagccagggccccaccttagagcccaaaatgcttatgttcaggcctgtggcctgtgagcaccactgcatgcagcccactcgataatgccacctctgcataaccatgtgtggacaagatagccaaaccgtaagtaacccaaggtcactgatggaaacatcaatactcctcccccttttattttctagttactagacaaaatttaattattgtagtaagtagtgaaaagcaagccctggggcaagagcagactttgggagtatatcctgtctccaccacttcctggaagtatggttgtaggcatgcttcagttttctcgtttctaaaagcaggatggggaagtgggcatttatatgtgcaaaatagagtagatgtgagaatcaaacaggaagaggcatgtgtagcaagcagcccagtgccctgatggaggcagtggtgacaccttaagtgagggtcaggaaagaatcagggccccaccctacattcagcatatcccacactttggcaacaatcaagcagaactggagcctaccctcacagaggccagaaggcagttcattgtcaaatgagatcatgcactggattacaaggggttcacaaactatgagagtatcaccgtcatcggcaagtgttcattgggtagctggagcagtcatttattgttgcctttatgaagatgctcctgctggcttacaaacttcctgcaaggagaagttaatgcagggagatggcagcgtagcaattaaacagattgtagtagttaccatccattagacctagaaaacaagttagccacctccctgtgaagatccactgactccttgagcttcacttccttactcatctgtaaaacagagtggaccacaatttggaagcagggcgggtagttctcacagtctctttacaagcagctatgtttttgagggcccaagtctgattgaggtaacccaatgagtgtcatgctccattaatgagacaggtgccagaaggggctcatagaagaaggaatgctcaatttttatttattcattagttagtttgtttgacagggtcacactctgtcacccaagctggagtgcagtggtgcaatcttatctcactgcagcctcaaccttctgggctcaggcgatcctcctatctcagcttcccaagtagctgggactataagcacacactaccatgctcggctaattgtttaagatttttgtagagatgaggtctcgctatattgcccaggctagtctcgaactcctgggctcaagccatctgtctgcgtgggtctcccaaagtgtccttacaggcgggagccaccatgcccagacttgtttttaaagaataggtattatgggtgcccagaagccagtgaaaggaaagtctgcttagagtgccttttttgagtgtttttgtttgtttgttttgtttttttttaaagagtcagagattagagatcctagtccatccccctcactttagagaggaagatgctaaagctaagttgaagtaacttctcctcaggtccctcaaatgtgtgtaagggagcaggaagtacaactcctatttcctgcttgtgcatttgtctcattccaactttgggtggaaaaaaaaaatccatgtgctgtgctaaaaagtgcagtctgtgacggcaagcagagccgttttgaatcctggctccaccaccacctcactcaatgcgaccttgggaatattccccaacccctctgagccttactttttccatctctgcaatggcgaataaaagctgccatgctgggttgctgtaagaattaaaacgagctgctttgcgtagtcctgaagcataataggcattcagttaatgttgatgcccatctccattgctgtagccagtactgcatgttttgcctaaaacataagttttcaacaaaatgtcaaaaggacttaaattttcacatttgtaaaacaggaaaatttgactaaaatctaccacatggtctttaatatttctcccagctctaaaattctgattttttttaaccagttactcttacaagtggcttgttttaaacttgtctcaatttttctgttcattgcaatgtataaatgatacccatgaaaagggaaagtagaccgtgttacccaaatgagtggtgtcttctacggatttccaatgtttgtaacatttattatgtcacactgtacatgagtgtgtcttttttttcccccaattaaaaaaaatttatagaaacaaggtctcactatgttggccaggctggtctctaactcctgggctccagtgatcctcttgcctcagcctcccaaagggttgggattgcagatgtgaaccactacacctggttcgggtgcatatttttttttagtagattagtaaagccaggagctggtaaaatagccaattgtaataaaatagttatagtaagtagaggaactgttagcctccatgagctatccaaatcccagactgttttctgaaatgaaggacattggtaggagtctgagtgtgtgcatgaatgggttttgtaagaaggtggtcagttatgaggcaagaaggaaatttcggtttaccgaccacttcctggtttcctcaatgaactgtaatatgtgtaaggtttggcttggaggtacaatattttactttttttttttccatttgttttttgttgaaggctgagtatgacagagacaaaaggcagtcagagggagacagcccctgctatagagagagaaacagtgtagacttgttggtagcaaagatcttataaaacaggccagctcactctgcctgtctggacactttccttggctagcagggtgtgccgcagaagataaggcacctttcttctgttaggcttcataccacacccttacctttttgaaaaagtttagtgactcatcctattttttaatgaaatatttcaaacacagtgattcatgattccctctttgtttttctgagactcatctaaaaagtgggcataaaatttacaatccttttggatccttacacaaataaaggtaattgtagtgcaggtgaattaattttctacttgaccaattttgtttctaaagcttctaaggcaaagatcatctatttgatctttgaggttgcagggctggcttgtgaatactttaagactatcactctaaaatgtgagaagttctaaaagaaacaaacaccacatttttaagactgtacgatttaaaccatagaaggttaatgttatattgattagagtgaatttcagctgagagttatagacatatcagaaaagatgctaccctctttcagtggacattttaagtgattgtttaagggtagactgaactatttaactgtggtaagaattagtttaggtgggaattcagtgtttaggacaagttcaagaggataccagaccagccctcaacagcagtctagcataataatagatttattaaaatgtcacatattcactcgaaacaaattttggcttaagccaaaagcatcctattttagagtttctactattttgctgatgttcatgacatctgctaagaggctgatgaaattgagtttcgattttatagttcctacttgtagggagccagaaagtttaatccctcaatttttgttttaagtatatagattatccttatctctaagccaaggggagatcattgcacctgatttcaagtttgttaaaccagtctgtatacagctatttcatacaggctccaatggttgaattaattgccctttgttgatgctactttgtaccgtctcaagatgtgtgctgttcacgagtgcatgaatgttcatgtggatgtgagaatgtgggtggatgcggtgttttagaaaagtaatcctcacaaagtactttgaggtgcttccaaagatttggttttagatctggctgaactactccatgactttagtgtgggatcttgtcttataaaagcaggtgaataggacttgttggcaatctgagaggatgggggtccttggtacacttgctggactgagaacagtggcattttgggactctaatacattcagtagagaactttatgtttgatgtgacaatcatgctttgaccctgtccataaagcatggactgtgggtcagggttttgttttgggtttttttgccacatgataaagattagtagggatttgcccctcactcaacaaatgatgtagctggattctgcccatcactagcagtcaacacttggccaggccagttcatcctggccaacccgatgaagtgccacagtgggatggggcctgagagcttggcattagcaccacgatgttcaaaccctttgagctgcctaccatggagagacagcatggggactgaggcataagtggtataccccaaggctgactcagcaacccagtccctggggctcatggagccccagactccacttcactaagtatatttgtgtctgtcagtgtgggttagtggaagagcacacttatgataaggtataatgaagcacgtgtgttatgtatggatctggaggcaattctctggaccacaggcagtttttgttgttgcttttagaatagcactaatttcaggcatttcttggttttggtttctagaactctatgaaggaatactagctgatttcctttgacttcccacacactgcccctcacagagctcagatcatcattttgacaccacatcttatcaggattgctggcactagggagctccagaacacctctgggcctgtggatccgtttcccctgtgacttccttacccccgcccctccccaggcttagttcctttgcctttctgggcttcagtgaactcttctatcaggtgaaaataataattactttgaacatggaatactaatatatggaggcgctaactctttttaatgctataaaacccttagccaaaaaacttcaatatagattactataattcaagttacaaaatgatcattgttctagatcttccttggaaaactattagccacttagaggaacagaaaacctaataccaccaaaatgagactcaggcctgttgcccttgtgcctccctggacttgtcggcctctggacgcagacctctcatctgtcttgcctgtcacttctagagtggtcttgccacagcatgagtactattcctgcacaactttcctcagaaactttatggctcaccagtacctttcaggatgaaatcccatctcattatgaagtttagaggctttctaaaacacaactttctcctacctataaagcctcatctcgaatcacctcctctctttcctacaaagcctgcatctgtccacagacacgcacacagccctggtcatcctgcccctcctcttccccactagtaccaccaattttcctgccaggcccacccggccccccttgcctttttgtaagcagtatgcttcacttggctccaggtgctgctcagagcccaccccttcagaagtccttgccatgaaaaagtctatttatttcacttatggttgttggggttttgttgcttttggtgttcgggtttttctggtactatttgtcccttttttgtgctattcattagtcacctatgtgttagcattattgtgggtgtgtctgcttgatatatgtgaccagtcactcaggaattattgatttgagcacatataccaaacactaggctacagagctaaataaaatgagacttgcaggttggtggaaaaaaagcaaataagactagtgttattaggttgggagctgggggagggaactggcagggcctgagcagggcagcacacacacattattgtccacatcatccctcgtgtgtgagccccctgcacagctccttgcatttagtggctgctccatgaatgtctttttgagttgaactgaataaagagaggagtttttagagaccaaatagggcaaggggccggggtgaaggagacagggagggggaactagaggaggctgcccttctgagagcatgtgctggcagatgtggtttggggcttagggcccatcttcggggccctgtcccagaagcctgagtaaccagttctgcccagctccttggaagtaaggacacttgtagggaggtgggtccttggcagaggtctactgctcaaccctaaggattggagtttctctaattcaaaatagaaaaggaaaagggggtccatatttgccttttttgtttttgttaggggtaggataaagggaacatatacagtttgtttcgtggtgggttttttttttttgccatatttctcagattttcagttggctaatttaaggaacaaatcttttcttgaaagctacttttgttgcttttgggaggtctgggggttaagcaacctttttatagcagtatgcctttcttggttttgatggggatattttgaaactctaagtgtggaatgtgcccttcaggtcaggacttggtgtctggccctgccaggtacacctttggcttggtcctttcctagatcacaggttctcgctcaccagtgagggtcatgggaaaacagagctcctctgtacactctttggtcccacgttgtttgaagatagaacattccggttacttgagtaagagtcagtccacttacctcatggtcctacttgacacactctccaccatgcagaatatggtcacagtcctgaaactaagcagacagtgcctctaagaagtgggcctgggatcacaaatctcatgcattcatttaatcaacacatgtattaagtggctactctgtgccagccactgggctaataagtcctcctctcaaggactatatggtgaagagcttagcagttgttccctgaaggcctattacccaaaatgactacccttttgcaaataaatctaacaagacttagtttatttgcttttctagcccacagccaattagcagtagtaaatagaggatatgtgggtatgactggtgaccgtagacacagaaatgagtaggcaggaatggaggaggaagacaaaggatcatatacagagatgccagaacggcaattataacagtctgagcaagccagttgatgtgaagccgagacccagtgaatttcagtagccctgaggacatcattacctaacacactccagtaggtgatgttcctggtaataactctaaataaatcattccagaagaaatggttgattattgtgcttaagggacaaacagctataatacccctcccctccccttccttccttccttccttccttccttccttccttccttccttccttctctctccctttctgttttaagatttccatcttaaccatccaaatgattaaagtgtgtttctacttggaaacaagtcacatttatctgggaagttacttacgtggaagggcttattcctcaacaaaaccatgcacatgaaacataactcttgtttagtcgaatcattgtcataaatacaatcaagaatgaggaattgtcattcttgattgtatgaatgcaaccactctgaatattctgtgaatataatttaatcactggaagtctctaaggagaattgctctaaaatttattttcagtgattatccatttatgaaaaccataccatttatgataaaaaaaacagtttgatagagtgtacaggttatggggaagtggtccgcaggctgcagataacaagaggttttgccgtcacagatgtggatgagacagtgagttgtaactgacgatctccatcacaccaagctgttctgccagggaagcaggatctgttatttatttgatagccaacaactgcttagaaccaggcatcagcaaacttttctataaagagccagggagtaaatgtctagggcttgtgggttacagctattcaactcttgccattgtaatacaaaagcagccagagacaatttataatcaaatgacatggctgtggtccaacaaaacattattgtttttgagcttaaatagtaattgtgagaacacaggtgatataaatataaatctgcatggcagtaggaaaaaccaaaagaatgcttgcaactggaggttgtcaaaatgtagagcttcaatcagcttttgaatcattgtgtgatgtcagcttttcttttctttggttttccttgaacagagtttgtaattttagaatttgctgggcacaggtcaggtcccagacattcctgatctccgatcttctactgtcctgtttggtgcttcagaaggtgggcctgcatcttttaatgcatttaggttgtctctggcaggactacattgccactgtcctctggatagcacaggattgctctgttagaaaattttggttgatggaccaccaggaaccaagacttttactctacttgaaatggttatttatttatttattttaagacagagtctcacactgtcgcccaggctggagtgcagtggcgtgatctcggctcactgcaagctccgcctcctgggttcacgccattctcctgcctcagcctccccagtagctgggactacaggcgactgccaccacacccggctaattttttgtattttcagtagagatggggtttcaccgtgttagccaggatggtctcaatctcctgacctcgtgatccacccgccttggcctcccaaagtgctgggattactggcgtgagccactgcgcccggccgagatggttattctatctctatgtgtcatgacttcttgttccctaacacagtgatagtgactgcatttgctgagtcgatattcctttgggcaaatacgtaatagcacatttagctgcctttcagccattagttctctgccaccttgggaggagtggccctgtccttattcttcattattagtctgtgcaactttcgactctagaatgtctgtcattttgaatagtagttactggtctgccctcctagctttttggacatgtccttactgttcataacaataccgaaagcctgcctttgcccttcagagccatagtcttcaggaagcacacatggccagtgctgcttttgagtgatttcttctgctgtgtagttgagttctcaaaagacagagatatttcttgcctgtgttgtagcctgtgctatgagtggcttttccatggcacctacatctggtggggagcttgagccatcacagtttctaactgagaaacctggttggtgatgcaacaggccaaagagggtaagaaaaaagaagagaagggaaatctatgctttctgtgtcttgcagcacatgctgtggatagatattagtcattgattcttggttgtttcattgctgtctccagagacttgaattgcagcttctagagagaaagagtgctttgctcagcacttgtttcagaaggaatggatgtatttcctagagaaaatacatgtgcataacctgtgaggtgtacagagtgttatgatctgtatcattcgtcacaagctcctccaccagttccctcaaccttcataccagcaatcctgggaggaggtggccagggctggaatgtaggtgttttcacaggtgaggaaacaatggcacatgaagcacccctcagccaggtggtaggaaaacatctttgaactctctccccttctctctgcctctccttgccttttaagtcaaaatttgaacatatctattgaggtactgtctacccagtagatctctaataactaaggagacctaggttctagtgccacctctaaattgccaggctggcctgggtgccgtggctcacgcctataatcccagcaccttgggaggccgaggtgggcagataacttgagctcaggagtttgagatcagcctgggcaacatggcaaaaccccatctctacaaaaaaatataaaaattagccaggtgtggtggtgcgtgcctgtagttctaggtacttgggaggttgaggtgggaggatcccttgagcccgaggtgggaggtcgaggctgcattgacctaagacggtgccactgcactccagcctgaatgacagagtgagaccccacctggtctcaaaaaaagaaaaaaacaaattggcaggctgtgtcacctgcttctgctctggctgaccttgggcaaggcatttaccctttagaggctccctttttattatctgtcatgtgaaggccctgtttcaagaaggctaaattgactctcagaatcagggaagagaactcatgttttaaatgaacaaggtgattaggtggctttgcacacaggggttgcagataagtaatcacaactcactatgggagcaattttgtcaaacctccttgatgacaagacaacaccaagtttctggattctttcctctctctttcagatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccgtgagtatgtctgggcttgttttgaccagcccacactctcctcctctggctctggcatggccacagcctgcatgttccccctggaccttgggaacttggaggataggagggccaggggagggtgaggaagtagatctctgccttgttcagagttctgtggaattctggccagggaagaggggtcaacacctgtaccacagcctatctgtcttggttaaatgatactataagtacatggatatatacattcattgggcctgctctgggaggggtttggtctgggggaaacctggcctctggttaaaaagacacagataaccttgaagactggggccagatgatcagagcagaaagcatgctggagggttgggtcaggattgggcttcccagtgaagacagtgctggagctaggtggacttgaaattaaagccacatccaattccaggaacctgcacggaaatggccttcactttgcttgggcgaggtgcatcttttcctgaaaagctggacaagcctgtttcaggccgcagcaagtgcctcttggtgaatatctgtgggtaaagcagtagtgttctgctcaatgacttagctaaatatgccaagctgcgcacgtggctattgaatgtttgtgcaccctggtattaaaccctctgttctgttccttttcttgtatgggaaaagcaagagaatacattatttgataaagacctcctgtggcttgtttcagtacgtgggacgtgtgtgtttaagagagggaaagcactgctactagcagtgacactggccatacagattttgtttctgtgagccccagggaaagtgcagtagtgatgatgataatgggcctgagctagttcttgtctcaaagggctccatttcctgccggttcaggtggtagattattattaatccatcccaaaggaaagcagctttcccaactcaattacatatcagccactggtccagacagcatctctgttcctgcgcatgcctcagggagaccaaacacaccagcaggcaggggcctgtttgcctagtatttagcactgcatgcgggacagccatcgcctgagggaagccatgtatatgggtataatcctaagtgtccccaaacacaaggatatgaaagagttttcccagcagcatctatatggtcatgctgaaaataagttaaggatttattcagaaatgtttatgataccattgctattggggatatagaagtaaaaaacattgctttgctcagttcatagtttactgtctactaagccccagatactgttcttaccctcaagatgccctctgtctagaaaagacaggtgatgataaccctgtgtgatgaaggtttggcagaaagaaatgtggattgctgtgggagaacaagggtggagagattaatcaacatatagaggtgactgcttagaggaagcgatgcccaagccagctcttctccgagcagtggacattgaggacaggaaggaggcagagggagcagcttgcacagagacgtaggaatgcaggagcatggctcctctaggcaccaggagtggtgggaacttaggaagagaatggatttaggttggtgatgtgggcgaggtgcctaaggaggaggatgggagtttgatgatgaggggcagtttagggcccctaaggattttcaacacatcttaaacaaaactgtcattttacaagtctctttctggcagtagtgaggaggagtggcactggtgtgggaataaaatgaatagccatgtttcctgagtgcccattctgtgagagattgctttctgagcaatggctacagctatgagcaagacagatgcaaattcctgcccttgtgaagctcactttgtagtgacggggtcaggtaggaaggacatgattgaacagggtattttggaaagtggtaagtgctttaaagacaataagacaaagtgaccaggatgatgtgctgttgactttctggggcaaagggggactactttagatcaaggtggtctaagaagtcatctctgaggtggtgccttttgagctgacctgaatggcatgaagctacaagccaggcagacgaagatccaagggtagagaaaagagtagattcaaaggcccagagacagaaacatgctcagcacatctgagaaacaggactaggaccagggtgatcaaaacatggtaggtgggggtaagagtggttggaagaggtgaagagggcctcagaggccagattgtgcagggcctggtaggcctcatgagaactttggattttattctaagtgcagccggcagccttcagagagacagggtgtgatctgatttgcattgtgcttgcaatggaggttcaaggtgttacaagtagaagcagggggactagaggtattgcagtggtccgggcaagacatggtgtggctcggaccaaagtgagagcagtgaaaccagagagaagctgttggatttggagtctgttttaagctattagttttcaatcctgcctgtaccatctcttggagagctgtttaaaagtactgatggctgggcctcacccccagagactactataattggtctgggggcagggccctgggtattcgaatgctttagagctcccacgtttccctcacatttacctctcaggccaggcctgagaatgcagttcagaactgacagaatggagagagattggagagtataccttccagagtcttagctagagcagcctggggagcactggtgcccattattgattttggaggagaaatcaaggcttatgttctagtcagactgccactatattatgtgcaaggagagatgctaggtgggcagtagatagtcagtctggagctgatggaggatcagggttggagagagtgtgtgtggaggtcattggtttctgtaaggcatgtgaaaacagggaactggatgttgggcagtgagaggggagccttctgccctggcattcccactgccctcacatacatgggttctttacccactgcattgaagcgtacagcctctccagggaccttggccagctggcccttgcagtggatgcagaacagcatgattctcactgtggtgtgttgccagcttccaatcccaaagcagtgagaggcacagactgtatcctaaacaacagttagcttcccagaggtgtattttgctggtagccccaaagataactggccccaaaaatgaagaatttgtcaaatatctaccattagtaagggaagcaactgagagcatgttctatagatgtgccctattttagggtcttcatgctaccacctgcctctgcccatccccagcacatgatatctcatgcaaaacccagtatgcaaaacagagaggtggggctgcagaagcgggagctcctaaggcactgctggggcaccctgggattccaaggagcagagttggaagcccaggtgataagcaggtaagttaggggttccttattaatattgcagtcgtctttttttagaaagtggtcactgcagggttctaaggagttccctaatgggattatgttttatatctcaagaattcatgttgcacatactttttcagaacagtttatatccaaaggttataagcaatgtatgcattgtgtatcactttggtttgttatcattactagtttaaaatatatatatatacatatatatatatatatataaaaaccttgtggtctccctcaagcagttactttaccactttcagctttggaataattattccaagtgtaatatctgaacaattgcaaccactatagccttctggaccatttttcagtgatttactccaatgtagcagtagataggtccacatagagcttgaaaagaaaagggaagtgggaaatgactcacagatttgtaaacagcccccttggaagtgagacagccgtttgagaaatagggcaaaagggacaggtctctaaacagagggaggaggacaaatggacagaggagcagggcaggtgcctcacttgacaggcaggctggcctggaggcagcatgggtgtgggcaggagcacaagtcaggctcatgtttggtctcctgacgccttctccttgcccactctgaggttgtgtaatgtcattataggggctttctgtgttctggaaacactttagacgtttataagtctagaatggctccatgtgtcctgaggaggcagcctcttgaagacaaactggactcagaaacccttatcttactacccttctctctcttttcctcatttcttggtttcaccaccttttcttttccaaattcctcattctctgagctccctcaggaatcctgaggggcttctttatttctgagacaatgtctgtctcccagaagatgcttaaacgtgacagatgtagattgtttctttttgtcctggctgccaggaagctcaaagccaagtgttacacaatgacagtaattgtataaacccttatgatcagtatatttttgcccctccttttttggatcttatcgtttattaacttcataaattatttcaaatctgagacttgagaaaaggaggaatatacagtcatgtgtcacttgatggggataagttctgagaaatgtgttgttaggcaatttgaccattgtgcaaacatcatagactgtacttacacaaacctagatggtacagcctactgcacacctacgccgtattgaatagcctcttgttcctaggctacaaacccatgcaacgtgttactgtactgaatactgactgtgggcaactgtaacacgataatatttgtatatctaaacatagaaatggtacagtaaaaacatagtattataatcttgagggacttgtcattgactgaaacatcatgatgtgcatgactggatttatagtcaatttaaccacattgttaaggaaaagaaaattcgtctgtctacctgctcccccaccccgacccctcttgaatcccactctgtgaacaccttgctgtaaacagacctccatgactatctcagaccactaccggccactgattttcatttcagctgccaaaagtcattgagtggaaatattggggctcacttcaaacatgcaattggtattcccttctggagtctctttcaacagccttacagagcatgtgctgtgttcagagcccaggtggcaagtatttcctggaagggtagcatggcagcatgatgttggacctgtgggaacatagaagaggaacagcaggccaggtgctggatgcagccagagaagcgccttgtgcatcttgcccagaagtattggcacattcactgcatcaggttaggggacttgcctgagggtccattggagtatcgtgctgcattctccctcatgccaggcaacttctcacccctgcccccgagcaacttataaatcccaacaggaaaagctttctggcttcagagggaggaaagcagcccatttggggaccaactagctaccttttacttttctgtggaggagacacatggccagtgatgcaggcctggggttggttaccatgctcctgggagagctgttggagtttctacccagactggtgggtgtgcacgggctttgatcccatggccctgaaacaatttaagcaggttttcattcttgttgcttgaaatggatggaatgttgagtccttgaaattattggcatttctttagaacctgtctccactactttccattgtttctttttatattatcatattatcctagatacttattgaaacagccttagtatcctaggcctgtttcaatcttaatactagtgtgctgaggtagttggtggtggtagaatgatgttgtgacatcaggcaattaaaataaagttttttccaagtcacttaacagaaatacctggtaatgatatgtttgtcttctgatagtgacataggttctagacttggattgtctgggtcagaaccctacttctgccacttattagctgtgttaccttgggaagatgcttgacttccctgcctttgttacctcatgtttaaaatggggaataccacaatctctacctcataggtttgttgtcagaagtaactaacacatacagttttgtcacaaagcatttggaactatgcctggcctgtaagtgctcaataaatgtatcattattcagcttgagttattgaatacattcttcgtgccaggccctaagcagtttgctgagctacaagttgacagatgttgtcttgtcctccaggaatgtcttgtgatgtaggagagatggtgtgtaattaaatgacgtgttccatactatacatacaagctgtggtagcacaaaggctaagtaatgggttctgccttggatgtggcctggggccatgaggaagtagcagagaaggtgatccctgggtgcattttaatttgggtgctagaagcaaggaggtgcctggcaagttggagcgggtgagggtttggttggtgcttaaatggagcccctgagggtagaaaggaaaacttagaatgttgcctttgggaaactccaaatagaccacagggagggactgtttacggagggaggtggcactggattggtagtccagagctgagatatggtggcctcaagagccctgcccaggagcttggactctggtccatggtccctagggagccagtgaaggttttaggccaggggaataatgtgatcagatttccatttaagaaagtttactctggaaattagttgggagaaaggatagaagtgggttgcaggatttgagggagagactagaggcaggaagacctgggagatgctctaatagtctggggcagatgatgatgggctgaactaaggcatgatgatggcatggaggggagagcatgggattcaaggcacagtctgaggcagaattaacctggtggagtgaatgggatgtggggaagaggattagaggaattggtggtggttactggatttctaccccaggtgacagggtacatggatatgccatgggccaggaaagggagacttgagggaacagtttggggagaaagcagcaggttccgttttagctgtgcacagtgcctttgggacagccaaatagagagatctgcagattcaagaggtctgagttggagcttgtgattggagcattatcaccgagtgatggtggaagtagagttgaagattgttcaggagagagtgcagaatgagcagggaaggaaggagtcttggggtgaaaccctgaaccctgaggaacaccagtagcctggatgggcgggattccaagaggaggggagaggcacagccccacagacagggagaaggacagtgaggagaccccaaggaagacaagggctaagaattgacttttggatttggccacagtgagttgctcagtgacctggtgcgaacagttccctggtatggaggggacaggtgcatgaacagtaagggagaggtcagcagagacatcaggtgcacaaggcttcaagcagcttagctatgaaagggcagggagagctcagagcctgctaagaacacaaggagaaagcttggaggtaatggtatgggggccctgagggccaggattgacttgagcctcatcttccaagacagtgggtacccgtgagtccagggacagtgaggcagtgagatgaggaatatgagaaggatttaaccctagcagccttaatttgctccaaaatagaaaaggaagtgggcaggggtcaaggaaggtactagaagtttgggctacctactaaggggaatggctgatggaggcacatcacaccctaccccacccctaaatacacacaggtgcacatacaagtaccattatgttccttctgcactgaaaactcagagctctgtgcagagaatgtggaaggagttctgccatgactagagcagaaaagctttaacagcttctacacacttattttaaaacagatttaaattggttccactgtggggccaaatgtatattttggaagctttgtgatctgctttttatgagcctatagattttttaaagtgtttttactttagtacaaagagaaaagactttaagaatatgtttcagaatgttggtagtacttgtcttgggtgatcaaatcagagtgaatttttccttttccactttttcatctgtattttctttcttaaaaccatgaacaagtattactttggaaatgagagagataaagtcagtgcattttgacctgctaggcttgcagcagtgtggaagcttcaagacatccctgtggagtgtgtaagaacgtggggtagggggataggcatttctcagtaatgcaagcatgacagcagtgacaaaaatgtctcaggccttcaatctcctgctgtctgtccaggattgtaaagaacaaagttccttaccatgaactaataacaaagagctctgaaatctgtggagatgagcccaaaagagcataatatgcattttaaaaaagaatgaaacaaaaagttgcctgaggcagagactggaaagtgtatgcatcagactcctcagtcttgggggctggcccagctgctctctggctctgagaggtgggctcaggtggttggatgggtggggccctgcctgaatggagatgggccttttgggagatttatgcaaatggagtctcattgtgggggcacatgtttagaaaggctgagctgctgaatgatgtctctactcaaggtctggaataaataggccgtaatgagaataccaaacaagagctctgattcccttttatgggttagaggtttcctcttgcagtcttttatacagggtcccctggggcttacagtacattctggtggctgggaccttcttaaaaactgggactaaacaaaaaaaccacctgggccataatttaggaaaactcaagcctcgttgcttcatgtccttgggggaaaggatgtccctttgcactttttctcttatacacatgacaatagtaacttctagttgtggttttctggttttaggatccacacagttgcccaaactcaattactttttacatgaaagagaacacagctggggacaatggctcacacccctgtaatcccagcacttcagaaggccaaggcaggaggatcgcttgagtccaggagttcaagaccagcctgggcaacatagtgagaccctgtctctaaaaaatttttgtaattagctggacatggtggcttgtgccggtagttccagctacttgggcggctgaggtgggaggatcacctaagcctggaaggtcaaagctgcagtgagctgagatcgtgctactgcactccagcctgggcaacagagcaagaccctgtttcaaaaaaaaaagaaaaaataatgaaaaataaggccctttgggcttgagaccctgtcctctgcctggaccagtgcccttcccaggcccccttggaaatccacttatgccatgtggtctgggccctgcctcaccttcatgaaaccttccagaccctggcccttcacagtgcctcactggtggcccgttggatgtctcaaggtgagacaataatgacattttggttacaagcctcaggaaagttgatcatattcctactttgggtggctcctcaagtttttgtttttgtttttgttttgcttgtttttaatggatcatttcctctttgcaaaagccacttgtttctaatagaatatttcataaatatagtcaagaaaattaaaagtacctgtgatcctcctacatagggtctcactatgttgcccaggctgctctcaaactcttggcctcaagctatcctcccaccttggcctcccaagtagctaagattacagacatgtaccaccacacattttttttcttttttcttatttatatgtatgtgtatatgtatataaaatctgttatagatgtttcctgtgtcaataattgtgtatttttatagcatatttaatgtccaaaacggtattctaactggtattgtagataccatgtggtccttgcccaccaaaatgtgtttgcttttgaactttctgtcataggcttttctgacatctgactacattttgcagaccagattttttttctactgttttaacttaaaaaaaaaaagtaatgaaatgctttagagagttgaaagagtataaaggacctcatttccaccccactctcagtctgagcctgcagcactgaggtgcgcttgcatgtggacaagtgttccttcagactttctcattgcctccttgtctcctgctccttgtgagcctttggctcctcatcctcagtggggaagcacgtcattgctctgaatgacaggtcagccaagtgctgcccatctcaggagtgaataggtcctcactgaggcaggagaagcagaggcttagcaggggaagggctggggcccagcaaagagtcatgtgaagagcagacgacaggagatctgtaggcccacctctaggaccgtgcttgaactgattttcctcccaggtgctcctctcctgcttagtatccaccaggatcctcctggccttcctaggatccccactttcagtcctcttgcctccctttagctcctgacgcactggtggccatgcctttctctaggtgctctgcctcagcagcctcactgcatctgcacctgtccacccaccagctgtatgaggcctgggctcccatcgcttctttgtacttcccacagtgttcggcatggtgtagaccttcaggagagagttgttggttgacttgtctctgcagttttcttagctggaatcttaatccactgtgagtcattttcacagtgcaagacagaaccacagctcccttgcatttccagcacttaaagatttttctgtttcttcagtggctcttcccttcccagaattcttttataggaaaggttctgacacccagtcttcatcccttctgccctgggaacccctcacttggcctgttataatccatcggtccaactctggggagaccagggtgctctatctgaaactcccaatttgcccaccctaataaactgtactttcactctgggcacatgcagaatgtggggacagtcttagtttctgtccttctgatgttacactgacttccctgattgtggtatctcatgggtgcctactgaggagtggagcttgctgtgaagtagacctgacacaggggtcatggagggaagagtgccccagtccaatgccatagctgtggcttgacctcgtgtcaggtgtggttcttgtttgggagctgggccaagcaggcagagttcccaggatggcacatccttggctccctgttgtcactacttctttcacccctttgctggaagctgctggatcttttacctttcactttgtgtcatactgtgtaccaggccagggcatctggtgctgatcaaggtagacccaatcatggagtttctggtctggcacagtagctctcagccctggctatagagtagaagactctgctagggagtgtaaaaaatgcagaagtcagggccatactccctggtagtttttttatagtagtgctgcataagagtctaggcatctgtagttttttgaagctgcagcattggtgccaacaccagacccagaaaacagaccaccatattactgagcactttatctgtggcagtaccatctgagccctttctgcaagttgtctatgtctagtttaaccttctcagtaatgctgggaattagataagatgagtcctgcctcactgattaggaaactaaggcatagataggcccacctgtcagtgggcacaccactcgcaaatgtagagctcagatttaaagcaaggccaggggacttccaagccagctctaaccctttgtgctatgccactgactgatcttctctcttacttcttggacctatattcccagctaccttcctgggtgtccctcaggcacttcagactcagcataccctaactgaactgatcagctcttctcagaacttccttctgctctcttaatggttttgacgtgccaccacttaccagctgctaaaaatggaaaccctactggggctcatctcctccctttttgttaccctctccaccacccaataacaagttggttccctaccatcatttgtagattcagatctcagaatttcctctccacttctcccgctccatcctcgtaattcagtttttccttactggaccatcaacaataacctcctacgtggtgtctggaattttcatctctccctcttcttatatgatccacataacacaggcaactgagctctcttcctgaagcaccagtgttacctaatggctctaggctacctataaagaaaaatcccatcccaacctggtattcagcgcaccacatgggctggccccggcccatcggtccggcctccccgctgacactgcatacgcacagttcagcacactgatattctccctgtctcccagatatgccatgctcaccctcacctctttgtcattactcatgccctcctctgctggaatcccttttctcccacaggtctacctagccagcctctatacattcctcgagacaacccttgaacatcactacttaaaactcctctgattcccctgattaattggctgctggctcctctgtgctccctcaacacaaataccttccacagcatgtaacctcttttactagaatcgtttgtcagcctccaaaacactataagtcttggaagcagggacctcctgtgattcctgagtccatagcagtgagcatgagagcacagggctcagcaccaagcaggctcttggtgaaggttggttattaagaccctacttaggcctgtgcactgcctgttttccttctgtttggatgggtgcacagccagagcagaatcttatggcattttggctctgccattggctctaaagaacgctaagtattcacaagcatactccacaggtggaagagcaaatcagagggcagctctggccagacagcaagtcaaatacctgagggcagcagctcccagttgcttatggattcactaagaaccaaatatagattacaattattcataacaataccactggtaaaagtaaaacttaatcccagcaaacaacccattaaaatgtggagctgcaaattttgatctggggaaactgttagacatgttgctcaccagtgaaacttagaaagggagaagctgttatcaggaaatttaatatagaccaaaaaatagtcagtgagccaaatccttgctgttatataggagagaatggattcaattaaaataattccagtaaaatgaaaatacaaagtaatcaggaacaatgtcactgtttagtgtagaaaattaatcaaagaattggccgggtgtggtggcttgcacctgtaatcccagcaccttgggaggctgaggcgggcggatcacaaggtcaggagattgagaccatcctggccaacatggtgaaaccccatctctactaaaaatacaaaaaattagctgggcgtggtggcgagcacctataatccaagctactcgggaggctgaagcaggaaaatcgcttgaacccaggaggcagaggttgcagcaagccgagattacaccacaccactgcactccagcctgggcgacagagcaagactctgtctaaaaaaaacaaaaaacaaaacaaaacaaaaaaacaaagaaaagaaaagaaatcaaagaattaatgtggcctaatggcatctcctcagaaaaatttttggtcaataaatattccttaatgttggcataattctgaacacagagtccacatgttgttggtatcaaagtgtcctgtccatgtgtgtgtgtggttgctgctttcaaataactatccccactgtagaatgttagagctgatagaacccccagcccaaccctgatacctttcatctttcctacagggggcagtgcccaaaggaaatgccactaaagaattcatcgagagtttacagttgaagcctgggcaggtggtgtacaagtgccccaaatgctgcagcatcaagcccgaccgagcccaccactgcaggtacactcactggggctcgcctcctctcttctcccactgtcctgcctccctccatccccgccaacacctgcctcctggagtagcacacacttccccaacaggggccaagtcagcatcgggattccaaatgtcccctgctctgggcagagagtgatcactgtgagtctccttcctggtccctgtgagccctctagattgcaaagagcatttggtttggcctcaggacacctgtcccgggacttggctctgccacacctgacataggacctgggcagggcctttgtttttatatatgtaaaatggaggggattcctgcttttcctacctcacagctttattacaagggtaccatgagaaaaagctttagaaaatcattctgtgaatgtctgggacttgaaatgaagcggttgtccttgaatgaagactttcttttaaaacttctaaaggttatgatagttgcagaattaaaccaaaaaagaaagccatttccccatcttatctgtggtcagttttctgttttgttttcaggtttctttattaagtttttctgatgagaagacatctagctaaaagttgtactttattggctgggcacagtgacttacacctgtaatcccagcactttgggaagccaaggcaggaggatcactggagcctaggagttcaagaccagcctgggcaacaaagcgagactctatctctacaaaaaaatttaaaaattaggccgggcgcagtggctcacgcctgtaatcccagcactttaggaggctgaggcgggcggatcacctgaggtcaggagttcgagaccagcctgaccaacatggagaaactctgtctttactaaagatacaaaattagccgggcgtggtggcacatgcctgtaatcccagctattcgggaggccgaagcagaatcgcttgaacccgggaggcagaggttgcggtgagccgagattgtgccattgcagtccagcctgggcaacaagagtgaaactccatctcaaaaaaaaaaaatttttttttaattagctgggtgtggtggcacacatctgcagccccagctgctcaggaggctgagggcagagcatcgcttgatcccaggagtccgaggctgcagtgagccaaggttgcaccactgcactccagcctgtgcaacaaagtgagaccctgtctctaaaaaaattttatttatttattttgagactgggtctcactctgtcatgcaagctcatagctcactgcggcttcagactcccaggctcaagcaatcctcctgcctcagcctccagagcagctgggactacaggcatgcaccaccacacacaaagggagacacagtctcactttgttgcccaggctggtctcgaactcctgggctcaagtgatcctcccacctcagcctcccaaagtgttgggattacaggtgtgagccacctcgactgacatacaaggaaactttacatgctgaattacagaaatacaaaaatatcacttggtccccttttcagagggtatgtgtttgggtggggaggggttatagaggactgaatctgctccaggtgttggacatcttccttgtcaggcttagcctgcggagacatttgggtgtgtgagagatctgaacggcgatttctgcctggccttgctgcctgtctttcagaggagagtggccagtctccagcactcagattccggagtcagctccccagtacctgtgtgctgtgcccacggcacctcagcctgccctgcctcagcgtcagtcatctattttcatcttcctactcacccctggaaatcgggattgctgcagggatggcctccctagataaagaaattaaggttcaaaggggttgagtgctccacggtcacacagcagtgagtactagagacaggtttgggtcccggcagttctggctccaggtccagacagggctctttccacaggaactccagtttggggatgacacatgtaactttatgtagttgtatgtatgtttttctgtctgaaagagagagatctgcagacctcctcaaagcttgagggtgagggctgaggagcctgggtaggggccaatggtgattgctagctcctccggggtttctgtctgtgggtgagcttgcttctgagatctaattcaaggcttgcctcctgtgcctgagatggaggcttcagtctggtcttttcttgccactctcgggcttaggagccagctgttttctaaccatcactcagattttttttaaaaagctcagcttgcttatgtggtttctcaggatagcccggtatggtggagcagactctggccttgaagttggagtggttggtgttggaagttcagctgtgtcgcttgctacacggtggaccttcggccaggtgctgcatctttctgagcctcagctttctcctctgtaaaaagggttgtttctttgtagtttgttgtgaggattaagtatgagtaactgtgagtcacctagctcaacaagcgtaagctattgctaatagaagaatgtgtatggagttagggatatgctgggtttataaaggctggaccagaacagggaggtgttaactttgtattatagaaaagaacttttggtgattcttttctcttctctccctgagccctcagctgcctccaccgcctggcattttcctcactgcctcctccttgcctctctccccaggatgatccaagggaggtattcttgtgtgctagtaaacagatcagcttgggcaaagcaagagctgctgattcagatgaactaaagtgaggatgcctgtagagttgcctgttcctgcctcagaaatgcatgctgacaactgctcctttgtgatggtgcgtggtggcccaggccatctggggacccacaattttggataagcagaatctccagcataccagacagactgggtttgtttatagtcgttgagcccagaggctgcctgcctggttaaagttgatgtcgaccttgcccgctcaggcaaaggtgcatgtgtgcacatacgtttgcgcccagcattttagaatttgagactgtctccattcccttgtctctggtggataccacagatacacctagaccttgggcctgtaggtgttccttccagccctatggtgtgtggttgggtctttccttcctgggagaagcactctgaaaccccacgctctttcatcctggtgtcaaatctcctgttcataggaaccatggaagcatgtggaaactctgtgggaggagccatttatgctaatgtggatggccatggcatttggcttatgctttcaagcttgtccaacccatggcctgtgtgccacttgcagcccaagatggctttgaatgtggcccaacacaaatttgtaaactttcttaaacattaggacatgtatgcatagactttttttttttttttttagctcatcagctgttgttagtgttagtgtattttgtgtggcccaagacagttcttcttctaccagtgtggcccagagaagacaaaagattagacactcctgctaggttcttctgcatgaggagggagagacctctgactttggcagccccccgcctccacaccccagacacccacactgaggctaagacagtcctgggctgcttagagcccctgagagattcttgttttgtctttctcatggttatgattactgagaaaatctatgtagcactagtattgtttttaaagcattttgcatacatttttggtgctcacaatgaccctaagagatcagagtagttctgctgaggctgattggagaacctaagtttctctgaccagagcccaaaatgaggacctgctctcagatcccctgttctttccactccactgcactgtccttcccaaaatcgtttctgagctggagccaggatgtggtatagatgtcttttttgcttataattttagtcatagccagtgaggggtaaaatgaaaacctgtgtgtgacgccatggctcacttagtaccttcttgctgttttcttactattttcctacatgagcatcccagtctgatgtagttgaactcattttccaggcctgctctttcctgtctgtggtgtcagagacttcattcagctgacccttgctaaagggggccctgggcttggctctgagctcgactctgagcttatagaggtggattagacctggccctggctctaggagcctgccacccaagcagggcaggcacacttctccaccatgatatagtttggtaagtgctggtatagggagagacagaaccccatggaatgtggctatgtttccatgttgagccatcacccagggtgagcaagagagcctcggccagctcctttggggatgagtaccaagtaagggccctcatacctccttggagaggaaacacataagccccagagaaactgaatacatatgagccagtgagcttggtggattctaccaaggtttgaggcctgaaaaaatggtaggaaatctggaggaaggggagaagggaagcatctgccttcttctacagtgacgacaaagaaacatagaaggggcctgggaaacctggaaggccaggatgcagatacctccatttagggcatttggtcttttctgtgattgtttttgcacacttggtccctgtgccatggagctcaccagcttacagcgtctcatccacgagactctggaattagtgccagaaaggaatgccaggagaggactgtggacaagaaggacccttagaggatagggtggattttgccaagtggaaagaatgaagaaagggcctcaggtgttgaggccatccacagccaaaacggggaagatggctgagcaagtgtgtggaagaggctcttagtctgtgatctgtgagccttccttggccttgtgtttgggctgccctgctatgcctagggagggaacactgctgagccccctgcccatgtgcatgcagtgggggctgggaaaagggctggctctgaggtgattgattccctttgggagtcaggagttgtggggggaggtccacattttttcttcctcatggcagatggtgccagaggtgaaacagcagggcagggtgtggtatgtccttcactgcccttcaacatctgcctctggtccctgtccttggttgctccaggctccagccccagcacccttctggcctctgtgagcagctcagcctctgagcagtgcctccagccacgtgggatgggcctcaccccacccactctgcataccacctggcccaaggagaagggtagtgtgggtttggcatttcatatctttgaaaacaggaaactcggggaccagcattttagaccaacacttgtggccctcagcaggctgtactcactctccctgcggtgtttatttttctaatttggaagcccagcgagactcagcccattgggaaacccagcttcctggcattcacgccttgtctccagagaggctgggaggagagggaagaatagctttgctgtaagagcttgtttaaactcttgggcagctttcagaggatgtccagccacttggcacctctctgccgctgagccaacactgtctcaagagcacccacttgaaaacccttttaaaaataagtgcagatgaaagagaaactgctcaggagccaggagcagggaggtggttaccctcaggagtttgttccccagatgggaaggggattaagaaacccagaggtgctggtctctggaagaacatgccagaaacaggctctatggtgggagcatggcacctggtgcctgaggcctaggatgcagggagtactcactctgcactgtctgcttatctgcacttttaaaattgtgtattgggaacaggcattaccaatttaaaaatatatattctgcatgtatacttatatgtatattcatgtgtatttttaaaagtggtaacagagagagagaagcagagtggctaatggacttgctggtacttctcttgctctttgttacctccatgtcccttttgtgtctccttttcttaccttgccctcctggtccccagggaaattctggaaccaggccagcatgtctgagatatacccattcccaacatgcctgtgttagtaaggccctttgaagttgtggaaaagagcaagggtgcagaccagtatgaatccacacatcgtctgagccaggcacaatatctgtctcatgtattctttataataaacttattttgtacagaagggaaactagaggctccgagttagccagtttgaccaaggtagctcagcggactcaggtctgcattgccaccaaagttcatgcgaggctttgaaaagcacacatcttctccttgggctacaagtgagcaccgtggtggaggactgtttccgggtagtctttgcttccaggttctggaatccaggggacagcacacctccagcccagcagagctgctcctatgctttccctgtccttccagctggtcagcaagagcttagccagcactgtggtgtgagtgtgatccagcaaggccccaacgcccagcccttcctccagcatccacctgccattgcccactctgcactttttcaagaacccaaggtaaaattagttatagaagctagtggagaggaaagctggtgtgaactaaggaactttttttatttttatttatttttatttttagttgtcaaatgattctttattgaaatatcgtcctttgtgcttctaagtagctgggcactccaccgcaccactgttgatgtcatctgtgatgtcatgagggtggcggccaccaacttggcagcccacagactgggcagtccccagaatccctttaatggttccagagagttgtctggttaaaggtcggtgctgtatctgtagagcaatgttgacaatctcatcaaaggtggtatttccggctgggcacagtggctcacgcctgtgagcccacccagcactttgggaggccgaggcggggggatcacttgaggtgaggagttaaagactagtctggccaacatggtgaaaccccgtctccactaaaaatacaaaaattagcctggcttggtgacacatgcctgtagtcccatctacttgggaggctgaggcaggagaattgcttgaacccaggagttggagactgcagtgagccgagatcacaccattgcactccagcctgggcaacagagcgagactctgtctccaaaaaaaaaagtggtatttccgctgtgtttaacatttttctgtttctttctgtctcacggcagttccttgagggctttgatgatcagggcagaggcagaaggtaccatgtcaatctgggcctatcttttctgaatagtcactttcactgtaagcctcagacccttccagtcaccaattgctttggcaatgtcatcaccaaccttttttggggacagacccatgcggcgggtgcaatcttgggggcccacacaggatggcactgacttcactcctggtgttcctcagctatacaactttgatctcattgaggtcgaacttcagcagcatggtagaggcagctggtgttggatgaacccagatttgggacaaccgaagaaggttgcaccttagctgcctccgagctgaaagccaagagcttttttttttaaaaaaaaaaaaaaaaaaaaaaaacttatttttagagacaggatctcactatgttgcccatgctggtctcaaactcctgggctcaagcaatcctcccaccttggcctccctaagtgctgggcttataggcatgagccaccatgcccagcagaactaaggaactttggcacaatcacagctcactgccgtctcctctccccaccccaggctcaagcgattctcccgcctcagcctcccgagtagctgggaccacaggtgcacactaccacacccggctaatttttttatttttgttggagacagggtctcgccatgctgcccaggctgtcttgaactcctgagctcaagtaatctgcctgcctcggcctcccagagtgctgggattacaggtgtgagccaccaaacctggccttgaactaaggaacttttaaaaggaaatataattgtattatttcaaagctttgtttatagcatttcaacctgttttgaacaaataatgcccccaaaataataaaaaggagactagaattcattaaaataatgaattgaaaaaaaattgtcaatgagcacatctattggctggtgacctaaataaagaagcaggcaaaattgagagagtttatttgggccaacattgaggactgcagcctgaaacacacttccaagttgccttcgttcaagcaggttttgggggggggttttaacttttattttatgttcgggggtacatgtgaaggtttgttacatagataaactcgtgtgttgggggtttgttgtacatattatttcatcacccaggtattaagcccagtacccaatagttatctttctggccctctccctcctaccctccaccttcaggtagaccccagtgtctgtgttcccatctttgtggccacatagtattccatggtgtatatgtaccacatctctagtcaatctgtcatcatttaggttgatgggcatttaggttgattctgtgtctttgctgttgtgaatagtgctgcaatgaacatttgcatgcatgtgtctttatggtagaaggatttctattcccttaggtatgtatccagtaatgggattgctgggttgaatggtcgttctgcttttagctctttgaggaattgccacactgctttccacaatggttgaaccaatttacactcccacgacagtgtgtaagtgttcccttgtatctgcactttcgccagcatctgttgttttttgactttttaatggtagccattctgactggtgtgagatagtatctcattgtggttttgatttgcacttctctgatgatagtgatattgggcttttttttcatatgcttcttggccacatgtatgtcttcttttgaagtgtctgttcatgtcctttgcctactttttagtgggattgtttttctcttgtaaatttgtttaatttccttatagttgccagataattagacctttgtcagatgcatagttggcaaatatttcctcccattctgtaggttgtctgtttactctgttgatagtttctgttgctatgcagaagcttcttagtttaagtagatcccatttgtcaatttttgcttttgttgcgattgcttttggtatctttgtcatgaaatctttgccctatgtccaggatggtattgcctacattgtcttccagggtttttatagttttgggttttacatttaggtctttaatccattttgggttgatttttgtatatggtgtaaggaaggggtccagcatcaaccttctgcatatggctggccagttatctccagtaccatttattgaatagggagtcttttccccatttacaagcaggtttttaaagggaaaaaggagcgggctgatacaaagctgtttgacaggaactctcattggcttacagaaataacattgattagtgattggctgtacattgttgaactatagggtgtgtgtcattccatggctacttggcatcagtctagagcccacatagctagtggcttcaagaggtaattatttgctgggcacaatggctcctgcctgtcatcccagcactttgggaggccaaagcaggtggattgctcgagctcaggagtttgagacccacctgggcaaccccatctccatcaaaaatacaaaaaaattagctgggtgtggtggcgtgcacctgtggtcccagctgttcgggaggctgaggtggaaggattgctggaacccgggaagttgcagtgagtcgtgatcgcaccactgcactctagcctgggtgacagaggaagatcctatctaacacacacacaaagaaaggtaattatttatctcgaaggggggtgtgagacatgactgctgtcacaggctgtcttatttcagtgcctctctaggcctaataattaaatgggctcacattcctcagattaaaaagttttttttctttctcatggcaaatgagtctttctaaacttgagctttgggaagcagttgctttcaagcccctagtagtccgggacgcttgtttcatattattactttgaattgtccaaagggggagcgggtttgtgcttgctatcaaataagcttgaaacaggctcagcccaaaaattatcccaataatgttagaaatgtgcaaattaatgaactgatctggtcgacagttaagctcaaatgactttttttttttttttttttttttggagacagagttttgctcttgttgtccaggctagggtgcagtggcacgatcttagcttactgcaacctctgccttctgggttcaagtgattctcctgcctcagcctcccgagtagctgggattacaggcatgcaccaccacacccagctaattcttgtatttttagtagagatggggtttcgccatgttcgtcaggctggtcttaaactcctgacctcagatgatctgcccatctcagcttcgcaaagtgccgggattacaggccactgcgcctggactcaaatgacttttctgcttgcttgctttttttttttttttttttggctaaatggatgtcatcttagagccaaaaagttcttggagctgggcctcctgctgtccttgaccttgctctgaaatagccctctcttctgtcctttgtccttccatggtggaggtacctggccctccctggtagcacctcatagtgcttctagaacttccacccatcccttggtggtttggtcttttggggaaataggtagcagccattctccaaatcttagcccacttggtcaagtttttgaaactgcttcattctttttctctcgggaaaccaaatcgtaagccccattacttcaggagagcaggttctatcttagccatgtaaccatgtcagttccgtcctatgtatgtgttaagctaaggggctttggagaatgactctgtacccgtttggaatgactgccacccctggggtcctgaccctgcctcccaagccccacgtgacacacacccagcaaaacccctggcagtgcccaaggaagccatttcagaggagtggagcaggagccatgggttctgcgttcccccggggccctcccaacaccatggggatgccctaaaggtctgacctgtgggctgtttcagtgtttgtaagcggtgcattcggaagatggaccaccactgtccctgggtcaacaactgtgtaggcgagaacaaccagaagtacttcgtcctgtttacagtaagtcagcttgcaaattctgccctgccccccatgaagcaatggagcactttgttcctttgaaaattctcagcattcacgatgttctttgctcagaatactgcctggccctgtagatctctgccttcctgccaaagatctctctggctcaacaagtgcctgtacctaagcccttcacttgagcgtttagaaaattgatttcagttgattagctatgagcaagggctgtattctgggctcccattccaagtgttggacctaagtagctcaagaaggcagtttgggtgatgacctcaaatcctgaggtgcaggtaggtggagtctacttagtgcaaggactagaagggccctcagcagtcagcaccctggcttttcaagggaggaggtacagcaggcttgaaccccccgcccaggcagctcatactgcctggagcccaggtcatgcctggtgacgggcttgcttctgttctggttccacgtactcccggaggtggctgctcacttgacccagggctggtgggtagacggatctgtagggaatcgctagctggccctctggtccctcctggtcaggccttgtcctgactaagtgttcctgagtggcaaattctgagtgcccctgtcccgggagcccgtgaggtcagaggattctcacaacaatggtgtctgcactggtttcctgtttcagatgtacatagctctcatttccttgcacgccctcatcatggtgggattccacttcctgcattgctttgaagaagattggacaagtgagtatgtgctgaggctttcctccctgctccagggtgggtgtgtgacctgagtggggggcggggaggctctttgtttccttcatggtgccaggggccaacctcattttattaaatctcctgaaagcctatggactgaacagggaagaaatggcagagactggaatctctcttcatgaaaaaatgcagccccttaacttcagttcgacaggtaaagtcatgagttggacagacagaccctctggactgagcgtgcccagggagaatgcaggccccaagcaagcacagaggccggttccaatgcgtgggagccatgctgggagagaagttttgttttctgtctttccatgaggcacttaaatcaaagatcattttattccagtcttgcagagattcattttttactttctggctaggacatggagtttctttattaatttctttggtttttgtgatggtgttttttaactgcttacactgataatcgtgaatttacattaagattgtagataattcttcctgctttagaggcttcccactgaaatgtgcaaatactgagggagaaactccagccagaagattgcacagatcctgaaggaaaacaatagatgctggaggaaaagaaataagaggccacctgctgggctggctctttcatactcacaatctgtgagacaaacgtcttgagcaaggaacattgtatttcctaagcttttccctccatgggcctccttttttttatttcactgtctttagaacttttgctcttcctatacatgctgacttcttcccacaattctggcataagtcaaatggcagaggtcaagccagcagacaatagagataggagaggagggtaggggtgagtgggtatgtgcagaacttgccattctgcatatctaggtgagtcgccagcaagttcctgatcacttggtgagcattctgaagtacatgccttctgctaggcctggggaaccagatctactccagatgtggccttggttacttgacaagggagtccaattaggatattttatcatcccaaacacctcccacctctcgtcaagttaacagacttgggcaggtgataggggtagcacagactgtcagtgaggcaaaatgtccctgttgttgtaatggtgctggaaggcaccattgcattaatgcctactgggagccaggaatggcccaaagggctttttgagcagtgcattgtttcgcccttataacaagcctgcaaggtaggagagatgcttcccactttgcagatgacaaaagctgtggctcacagaggatgaacaagtttccaggatcactcagctaacaagagggtctgtagttcaagcctaggtctggagcaagatttttagccctgtctggttgactccagtggtcagggtcctcccagccatgctcttgattaactgtggtcaaaattcctgatggagtgagcttcaggcacccagcttctatggcagctaggctgggaaggcacaggtcagtacccaaagttgaggcctgagagttgactgtatatgaccattactgccctcactgctcagccctggtggagctgttgggccataggagctggtgtgagtgggggcagagggctgtcccccaggattagggcactttgagttgatatttaaagaagggtagggaggtggttccacactccctgatctgattcctacctccccaaactccattggtaattcctggggcccagcctacagaggaatgatgcttgctgctttgcaaggagggagaataggccatggccctgggctcttccaccagctccagggcagcagaggtaggtaagaaggaggtgctttgtccagcaggcacccccatgtgctcctgccaggccaaggccgaactgtgcagatgttctttcatgaattcttaagtattcccctgtacagaaaggaaaacaaaatctcagaaagcccaaacctcttgcccagatccttttgttgtcaggcactgtcccaaggctggttgtacagcagtaagcaaaacaaagtctccccgctcctggagtttgaagtgtagtgggagaggcacctatcaaaccagtacagaaagaaacaggtaattccacaatgcaaaggacaggaaagacacaggggctggaacagaatattagtatgggccttgtagttagagctcatgatcaggaattggtgccaggatttgtacctcgtggtgtctgccagatgtcagagcctctcattctccccaataccctgcccagcccaaggccacccatacttgtagccacccacggccaggccatcaggctggtggccaccccaaccaagccctgccccacaaggagccaagaagagaaatcattctgaggcatcgataagttcccagggaaacctgaggagatatgcattgtggatgagatgtttcttacctgtcacccacatggtgcttggtatctttccaagctcattcccacatttgacctcccttgcccctcctgacattcccgtgggggagccagcaggacagcttggatggagtgcttactcccttaattcccagaattaatgaagcccgactctgccctccaggatctgatctttccagccagggaaacaggcacaagtatggaagcaacgagaaataaaccacagcccaggctcagccagcatgggccgctgcactgaggcacagaagtccttaggtgaagagtgccaaccaaggggcctagcctgtctgtcagcaccatcttccaggcctggcatttcccaggccaccttgcttcagggccttcccctccctgctcacccccaccatctccacagcacctttgcctttctcttccatgcgctgggtttctgacttagactttgttcagacaaaagattctgcttaaaagcaaaccatacctctagtcaaatctcactgcttcacagtgcagtgggtggaggcctgaagatggcaggactggcctcaggtccccggggctggaggccaggacagtgaaagtgcctactctgggcccatgcctctttggtcgactccctggcctttggcactgttggcctcggtgctgcaaatgtccctgggagcgggggcagtgcattacctcacactgtggtcaaggctgagacccagtagttcagctgcccctgccaagcttaaaatcccaaagccaccaagtgatcctccacagctgcctgtgagctgatggggcacagaggggcagcacgtcatacaggaatgcccagaaaacctatggccatagcaggactggacaggcctctccacctgtgtacctgcattgtgctctctgaggagagcagggtcccctgtggtgtcgtcaggcgttcatgcctcacttcagaggccttcctgggcccttccatgtgtcaggcactgtgcttggcactgggggcagtgaacaaggaatgatttgtgttagggaagggaagccctggctggggcctggcctgttgaggaggcctccctgagggattgagagatagccagtgtgggccaggatgattctcaccgtagcctggaggccagagacctatggcacccaggaggaatgaaggcctgcaagcaggaggcagagtgggcgcctagtggggcagtgagcctgggcagcaggcagtgggtgacagtaccaatccctgtgtgctgcttctctttcagagtgcagctccttctctccacccaccacagtgattctccttatcctgctgtgctttgagggcctgctcttcctcattttcacatcagtgatgtttgggacccaggtgcactccatctgcacagatgagacggtaagcaggtggctctgcccaccatttccacacctggggatggggaggacccagggtcagtgttgctgggagagctgctcacagtcagactggagcccagtggtcaggcccctggtgtgcagggcacagttctttgtttgcagttacacttgggtcatcttcatccacacacaagtcctccagccttggggcagccatagcagatcacaccaggagtgcggcccagcagccgtggctgaaaggctgcctttaccacatttccttccatcccccccatggcaggtcttcctttatactgtactgcattagacactccactaggcactgagggcacccttcccatctgggggccacaggcttgaaatagagtggttgacagggtgccctaacccagctgggacaggcaggtcagcttgccagccatgcctgggtcctgagggcagagtcaggagacaggtctgccttgagcccccagggcagcaggcttttacctggcctctgggtcatctctgtctggcccagccctggtcctcatccgctgccttctcctcacccctaccatcacctcccatctacccacagcatcttcgctggaagctttgaggctgctggctgtgccagactggggcctactcccttggtgcccctactgctgtctcctgaccttcctaaggtgtctgaaaacctcaaggtggtcaatccctggctgcaatatgggcatttctctggggatttacataggaagaaggggtggcacttagctctgggtgtgaggaacaagcagagccatgaggttgagagccatcccggtacgattcctggtgtcctgaggccacctcagggtcagctttcaccagtggtctagggctctgggtgaaggtttgggcctcagggtagtcagcattagaagcgggctcataggatgacaacatcctcccactgctgctgggcgccttcccctgtgggcttagaggaggacgtgcaaagaaaagaagggacagtgctgcccactgccagagcaccattattcgggtcttccggcaacttttagaaggttgcggggcttttggcaactttttttcttttataagaaatgatgtcattgcaaaagagtttctgtaaaactagtagccaatggtatagatccagccctgtatccaagcagtaaccgtgaccaacttctctacgtaagatatacggggaacccgatggggattctttcaggaccagtctgccattgggatactgccgggccacggtctgggggagccagaaggcaagctctcacggccccagtcctagccgttcttccctgagaagaccattcctaaagagaattgtgttggaaggaaaggagaaagctggagggccctgccccacctgggaaggggtgtcttccctttggcctgtgcccttcccaggtccctaggctgtgaagaaagacccagactcagctgtcctcccagcacccctttactagagaccacagcagacagacccctggccaggcttctgccaggctgctcctgtcctttccctctgggcaggggccccgttctcaagccctgccctttgaccagctccatctgaagaagagagagagggaggaagcagctctttccccagccccagttttttcctgagacttagcaggggaagcagcgctggctccgtgacagctgctgcataggtctgcgccatgcttctccccaaaggagccactaggaggacctttgccatgccatgctggctggcctggccatgccaccctctaacctgtactaatccctcctccttcctcctctggtgacttctcccctcattcgtggtctgtcactcctattcaaccttctcagtttgtgtctcaccaggcccactaagcggggtgctgcttgatcccccaggctggtgagacacacaacgccagagcagtcatttgatttgttactttttttttgtctgcaaggtggtcatggtagcttcaaacttcctaggaacctatcccaaattaatggccatcattggttatgatgattgcgagctccccaacagctctgaggcctctcacgccaaagccttcatagtactccatccacagcccagcacagagtttctgaagagtgcctctgcagagctcaacaaggggccagggctggagagacgcgctccttatcttagcgacacaccccggcctggcatacttacaagcagcagtttctgcgctgctgatagtgcttctttttccctcccttcttggagggacttgtgaatgagtgcccaccaaaaaaaggagaaatttttttagtaacactttttatgagaaagatatattaggtagatagctttgttgctttaaaaaggaaacatttactccattcacctgtcgctgcggacatccctccccagaaaccacagcaatgcagtgcttgactgaaagtatgattgttcttgttttcagggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacctgttctgatttagctctctcttgaggtgttacccttagtgggaggccgactatccacaatctacttgagttttctctggttgggtgtttgtttcattgctctgtctcttgaatgaggatactttattttttttgttttaaaatgcatttatggtccctctcttgaaccagcttgccccaccaggcctctttcctttgctttctgcagcctgaatcaattcctttgtgctgatgggctctcctaagagctttcctgagtcagttaactttacctcgtgtctacggtgctattcatgcgatacgggcgaggctgagatgctaagattaaaaagaaaagaatgctgttttagatcaagttgatagcatttgttttccatatgcttttttaaaattttttcataacatacagctcagttaggtgtatgaaagaagtgttattgtattaaataactagagcagggctacagctctggccctcccctagggggaagagattggtaatactccatcttccagggcattttttaaagtgagccaggttagctcttttcccctggcatttctcaggaatgcagtagatagtgctgaagatgcactgacttttttttagtcctaaaaatagaaactcctcctttaaagctgtgcatactatgcttatctttccaatagagtggggttccttcagatatcctataggattctgcctctggttttgtataggccttggctagaaagagtcaatgtttctgagctctcaaaccagttgctctcagaagataggaataccccaaggttcctggcatttttcctatttcatttttgttcagactgatattttgccaagagcacaatgactgaggaatgtagccatcatttgcagggtagtgattggttcccagcctggcttccacacaggacaggaagggaaagcatccctgagctctcctcagtatttccggatgtaatgaaagaggacatctttctacacaaagtcagccccaacttttggcttggtcacaggagttctgatagtactgtttggtgcactcatgggaaattgaaccagtcgtagccacagtctttcagagcctgggctctggggagtggaagtgaaaaataaagatgtggcttgttggattgtgatccccagcttgctttccttctgtcaactctgtcaggtttgtgttcatagcaactagactgaatatgcaaaaggcttagatccaagcaaatctataatctatgcatatttgcatgggcttggtaatatcatgtacacaaaacacatttgggtagaagtgcatgtgctaaatctccttttagtcccaccattttgtcttcttcatactgtacttcctcttttttgtttgagacaaggtcttgctctgtcacccaggctggaatgcagtggcacaattagagctcactgcagccttgaactcctgggctcaagtgattcttgtgccttggcctcctgaatatccagggctacaggcacgtactaccatgcctggctaatttttttgttttttaatagagtcagggtctcactgtgttgccctagctagtctcaaatgcccggcctccagcaattttcctgccttagcctcccaaagtcctgggattacaggcgtgagccactgggcccagccctgtacttcttgaaaaagccccaagtattagcttttgctcatctggctaggccacttaaatagttagaatccaccgtcccctaatgcagaaaccgtttaggtgaggtaaattaacaaacattttaagccgggcgcggacacttctcactgtggacatccctcacgcctgtaatcccagcactttgggaggccgaggcgggcagatcacgaggtcaagagatcgagatcatcctggctaacacggtgaaaccctgtctctactaaaaatataaaaaaattagctgggcgtggtggcaggcgtctgtagtcccagctacttgggaggctgaggcaggagaatggcgtgaacccgggaagtggagcttgcagtgagccaagatcgcaccactgcactccagcctgggcgacagagtgagactccgtctcaaaaaaaaaaaacaaacattttaaacatgtatgtgaggttggcattacacagaaactcctctccgggtgggctgggatgggctttctcagccaggctaatgggttttaaatttctctcttttcaagacttgcagtgcatcagcttaaagggtgagccagccagtagaggggaaggcgccccacctagaaggtgcccttagatatcaaagaaatgtgaaaagagaaagattttgctagaatcctcctcaaaggtgttcttgaggttgccagaccagcaacgtcaacatcagcatcacctgagaacttgttagaaatgcacattctcggtccccaccccaggctaccgaaccagaaaccgagcggggcccagcagcccgtgtcttaacagccctccaggtgattctgactatcaagtttgagaatccagttggggctagcaggagtcccccctcaggtggtccctgatgcctgctggtgatatgggtcttgtgtgctgctgggctcagcatagtgcagttggggtgtgctgattgtgagacaggcacgtgttccctccgcggagaagccactgagactgccttccctcataagctgcggcctccccaacaaacaactgccaagacatcaaagaaagtctgtatgaagcagatccaaattattagcctgcccaccactccttgtgcatctcatcagtggaacccatctctagaccaagggccctttgggtgaagaagcagcccggaagggaaagagaaaagagtagaaccaagggacctccagatgggagcggcggccggtgagtagtctagagccaggggcattgtagcagcctggatacatgacctgaacacgtcttgacctttgctttctacgtgtgggtttcaacacccatgtggctttttcttgtattctttaaatatgtatctggcttaggatcacctcatagaagagaaagaattcacagtgaagcagaaacaagccactgaccagcgtactcccaacctgaaccttctttttctcaccctctccctcaagtaaacatcttgctgacttgagcagtgtgattgccgtagcaaagcagagtggcccccagggatcccgctctgttgggcccacaggaggagccgatgaagctgatccaaggagtgaggacaagcgctgcagagggacgttcgctaaaagccttctaggggccgcacatgctctaacacggacataaggatgccctgaatttctgcagctgaggccatatagtctggtgaccaagtatttgggtcctggcttcagtctttggttgaaatgtctgcttggctacttattaccgcacctactaccaaaatatgaccttgagcagtaacttctttaagcctcagttttttcatctgaaaacgggaatgataatctaaatcacaaagttaatggaaggattaaatgagggtgatgaataggaatgtatagcgtctggccctggtatggctttataaatgttagctgtgttggagctgtgcttttcaaaccattggtcacagccattcatggtttgcaaccagcatgtttttcaagaaaaatgtttaatgcattacatattgcaggataagtattgttttatgaagcttagggagttgtgtgtatatgtgttctggaatgcaacagaaaaatgtttcctcttgtgggttacaatatagaggtatgaaatctctgatgaggagagacagtgttatctggcccgctatgaagagacacatttgcataggctgctccctgaggctctggctttctacatctgatgatacagggagcagggaacagcctgttctcgttctgtggggctcagctgagtctgttctgcacagactcttccttcctcgggagccttagtcctaatacattcattttggagtgttggtgagtttgttcacagatcacagctcatgtgtcacccagactgacctgggccaaaaggcccatcacacaccctgcaagagcttctggtgtcgactatgacccccttaccaggcatcaaccatttttgttcgttctcttgagcctgaagctactattactgctcctctgcaaacctcaagcttaagaactttgcctgcaggatccctttaaatccacacaaaactcaaaattgagtcctaccaggaaaaagcagccctcagcccatttttatacatcggatttgtttgcaatattttctttctagactcaaaagtcaacactccctgaaagtttgtcgactttactgctgaagacctctggtagacaggccaggctctgtctggaatactttatgaggttggtgaggaggttgagtataatccaagagtgcctatctgggagcatgccacatgaatggcaaataatcatcctgtgggctcttggcttcattccccttctctctgactgagctcagcctgggcacagtggtgatttgcagtagaactggaaacctgttgggcagaaaaaaagacactagttctggttccagttctgatacataacaagctagatgagccttggccaccgtcatggcctcttggaacttctgtttcttccccatctgccaatcatcaatactcatacccacctcctcacaaggaggccataaaaacctatggtcatggctttgagtccaagtcagtgtggatgcagccagtctgtcatttttgggtgtttcctctgtagccgggtctgccatatggtgatgtcccagctctcgtgctatgaagttaaagcctctttctcaacaggctgcagatgatcacccaggaagagaatgcagaatgcccaaagcaaaccatctcagctggtcactgcttctgtgccaagaagggaggcctggcgaggggccagtcaggaagcagcatggcatcacatgctcatgacccacatgaaggtccctttagacttgtgtcaacaagatccattttctgaaacaactatttttgttctgattataaaagtaacattggctcattggtaaaacttggattgtgtgagaagtctacagaaataaatacaaatcctctagaattccatccccaaaagtaaccactcagacaaatgttctaatgtcatgtaaaaccatattaaaccatcttttctagctgcatagtgttatagaatcatttgcttaaccatcattattgggcatttctcatttccagctttgcattattataattcagtgttcaagtttgtattgcataaatctttgtctcagattattgattatttttaaactttttgtgaaatcagacttacaaaaatgtgacaaaaacagtacaaagagttcccatgtacctttcagtcagtctcaccaaaggtaaacattttatacaaccataatacaaatataaaaccctggacattggcaacaccatacccttaactaatgtatgtaccttattcacatttctccagttgtcccattaacacccttttctgttccaggatcccacactgcatcatttgcgatgtctccttagtctcctccagtttgtgacagttcctcagtcttcctttgtctttcatgaccttgaccctttttaaaaatcgaggtgaaattcctgtaacacaaaattagccattttaaagtgtacatttaatgcattcacaatgttttgtaaccaccaggtctgtctggttccaaaatcttttcatcaatctttgacccttttgaagattgtagggcaggtattctgtaggctgtccttcagattgtgtttttgatgtttttctcatgattagattgaggttaggcatttggggcaggagcactgctgaagcaatgtgtcctcgttgcaccgtatcaggaggcatatggtgttgatacgtttcattattgtgatgttaactttgatcattgggtgaaggtggtacgtgcaatgtttcttccctgctattaaggtactgtttttccctttgtaattgataagtatcttatgaggatatacttttgagatccaatttttttaacttagaatttattcaaaagtcaagaatcttaaatctctgaaatggcgtgggaagaaaaagtgctagatacacagagatctttcttgagtcatgtgaaggagcagtgcccaagcccagcaaacccacagcaaattcccttggcttccagaagagatggagaaagcagtgcccccagtggagggtcaaaggcctctgtgcagggtgttgtgggcctggagagctggcctggccatgtctttacctcctctgggcatctccccaccccaacaccctttctgtggcctggtggctgagttgcagccgacacccagaggcaggtgagttgacagcttggaagaggctgcagggtggatctgctgcatgagcaggcctgagcccagccttacctccccacagtggtcctgtgtgccctccggctgcctaatgcatgttggcacttgctgtacgagcacccgcttcttcacctcgcatgctgtttgtgtcctgcactccttccttaaccccatcgtccttctgctgtgtttgcagcccctatctaccctggtgggagtggccaaaaatatttaggaggggatcaccagtttgtagtggcctcagaggatgtgtggtcccccttatgcctcagccactcatcagcctagcccctgcccatcatctggcattgcacttgtggaaggaaagaaggggagggctgggtggtgggtggagaacacgtcagtccaccaggcgggccctgcttgctgtgttcctccacgctgctgtccacccacaccccagcagtcctctgagggacctcccgggggtgacctgggccacaacagactgcccactcagaccccatcttacccatgccgtggacaccccgcccccccccccgccactgctatgctatagctgggggtgtctatgtgagctgtacagcccagcaccacgctgacgatgttcttcatccccttctccctgcagggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaaccttcatcctggggttttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcagactgaaagcattgcaactgatgtcaaaaccagatgagatcttacagggagagagattgggtgcaatttgcctctttctttgaataaaaagctctttgctcaccctc

SEQ ID NO: 37888 - DNA, 19668 bp, Homo sapiens; identical to SEQ ID NO: 36793

SEQ ID NO: 37889 - DNA, 66383 bp, Homo sapiens
gcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccgggtgagtgcaccctgccacagcctggcacccgatggggcaggcacgcttggaggagggcatgtgtgtccgtctgtctgtctgtcctttctgagcctctcagaaagcagagcatgccccatcccctgggactggcctggtcctctggtctcagccacagctgtttgctcactggagcgcgccggcctgttatgcatgtgagacatcatgagcaggtggtaggtgtttttagcagagaagaaaatgctgagttttcaggcaggcaggcaggcaggcaggcaggtagctggacagagagtacagcaccttcctgatccctttactgttagagtgggctcagggtgcccccaagccttgagcatttccctagatatgggcagctgctttgggaagggagtattcccagcatggagagggcaggtgatgggcagttggatagatggacagacagacggttgaccttggctgcccagctgtcagagtgtggggctgggctggactgagtactgggcacctgctccatcccaaacttgagacaccaagaccctggctcatggggctgggcgcttctccccattcaccatggctgctttgtctgtctcaggtcttgttccccacaagtgctggggcctggtgagatggccccctatcctgcagtgtctgtgatggggagcagcatggcctgatgcagatgacacagaacatcaggggttgtctgagtaactctaccgcctggctggagacagcaacaccagagaggcagaaagttagccatgctcctgaggaagcactccaggagcagggactgatgggggaacagcccccagaccgtagtaggcactccgtcagtttctgtcaaacaaagagactccccagcaaggcactggtagacccagggctgaaggccccaaggctcagggcgaactgtgaggcatacagggcaaggacaaccctgcctggtggctgagcccctgaccgtgctgttccgggcacaaggccagagggggaggcccccagtctgtcactggagggtggtaggtaggcaggggtatctgggctactgcccaccaggggaacaaggggacagtttcttctctggggccttaaggacttgccttgggcctgggggctggaggaaggggttggaggggaagcactgaagtgggcaaggcctgaaggggcttggcagaggggccagggaacctgggcagcgggtcaggagccaatgcccccagtggaggagtaatcttttttttgttccacgggtacttgaggggaccccagaagtagaagccccacccagggatgccgtgagagccttataatagccatagaggccacatgcttacaggaggggtgctggcctggctctggtgcagggaacaggccctgacctccatccttcagttgcagatgtggcttgttctaacctggagattccacccctccagatctactgccctggagaccacagggtcctgggcacccacagccttgcacactttgcatgaggtggtgacctgtgagcatgtgagccccagtggatttcccactgccctttcccacagctccccacccccatgcttgcaggactccttcctgtataaggtggagcctctgtgtgctctctcatgggccctgtggcctcccctgcctgggactgagcccacatctcccccagctccaccatctcgaggcctcctgctggtgctccctgccctatccctatgggtgcaaattggccactgggctcagtggcactcaggatagccaatgacctcacccagggtctatgtgccacctggccccggccagccaggggcttaaatggcagcccagaagccttaagctagatagcaggaggaatgtccttactctggggagggggtatgcagggatgtgctggatccaatgactgtggggacttctaaaaatagaacccgaagctcgggcagggcaccgggggatgggcatgatatggcctctcggcttcctttaggggcataccccaaatcacctaagccgcggagcaggctggactgggtactggagccttccccagggctcggagcctcttgagaaattttggtggtaggctgctgatagcctgggcttgtgtcctggttcagtgccgctggcagggcaggccttgtggacacagccctgccatcccaccagggctgtaggatttactgccggggctcgcagggcccttctgcaccagggacatccccctacgggggaggcatggccagagctctctggaggaaccccactcccaccccagccaggacctgagcctgtgccatagggcaccagaggcaagagtgtgtgaccctgtggggtgggcaggcaggcgaggctgggatcgttacctcgcttcagagcctggcaaactgaggctcgagtctgctcacaggacagggatgtccatgggtggatctcctgtatcctgtcacccctaactcccatgctggcttgctcacccctctaactgggactaatagagaggcactggggagggtctgtcccctctcagctgcaggtgtgtgctgcagctcctcctggaaggacacaggccacctgcaggctgggtggtggctcccgggggctcatggcagcaactttggggcagcagcagcccctcaaggcatcccttcatagggtctctgcttgcagacccacagagaagggagttcaagagggagactgggaaaggagggtggcggggaaatgcctttatttatcctggacaggtgtggctgggcctgcaacatgagctgccctttcaccccaccccagccagttctccaggaagtggagaagggggagcagcccagagagggagcagctccaaaggcctctgccctggcagctggccagaggctggggctgtggtctggggtctcacctcttcatgcctctcatgcctccgccttggggaagaggagtatgctttgttaggctctgctgctctcagctgtgtcacctcagaagtctgtttacctgctcggcctcagtttttctcacccttaaaatggggatagcaggctgggcgcggtgcctcatgcctgtaatcccagcactttgggaggccgagggggcagaccacttgaggtcaggagtttgagaccagcctggccaacatggtgaaaccctgtctccactaaaaatacaaaaattagccaggtgtggtggtacatgcttgtgatcccagctactcaagaggctgaggcaggagaacagcttgaacccaggaggcagaggttgcagtgagctgagatcgcaccactgcactccattctgggggcagagtgagactccatcttaaaaataaataaataaataaacaaataaaatgatgccttccacacctgtgagagctctttctaacaggcacttgtgaaaactttccacctgttgtctactgggactggttgtgagactggtggagtcgggggctgagcctgggcccaggaggggcctgcctgtctactggaaaccctctcttcctagggtctcagccaccccgcctgcaggctcacctggagcaccagctcagaggcctcttctctgtgggtttcggttccagtatttatcagactctcccagctgtggtgggaacatgctgaggacagagggtctctggggagaggaagggggacaggctgagactattctggggtagctgtgccggcaattcctggaatttcggggccgctggagcacgcagtgctgtttcttgggcagctcttagcagtgctgacaggccgtgctgtttatagccgcactgaaggtcaggcaagcctccgagggcttcagtggggctggcaggggcctccctgcaacatctatcaacaggggaagataaacggccagaggctcagaggctcacagctggggaatgcattcttagaggtcccccaggccaggtcctccgggctgctcagaactgcatctaactctgtgagggatccaaaaggagaggacatgaggctggctgggtcctggggaatgaattggacccttggaggcccctgggccaggacaccgtgcaagggcagctgcataagcagccccagggctccgggcctacagatattgtggggtagccagtgtcaggactgcagggctgtttgagaaaggctgggccaggctctgctgggggctagctccccaattccctgagtctccttccctttctgcatggtcccctctcatccagaggctgcccctgactgcaaagaccctcctctacactgagccctcccacccccaaacacagctttggcacccctttgggaccaggctccacctctgcccaggaaccatccttggacacaagaatgggccttgctgggggcccttgagagccagtgcccatgagggcattttattggccacacccaagacccaaatggaactgtggacctggacaggaggaagagaggcaggagagactcaagagacacttgaggaaagccaggggaggtgtggtcagctacagagggggcagtgacccgtggctttggacacagaaggtcattgatatgcgtggaataatggggccaaaggcagacggctgtgtgtgagcaggtgggaggcagcggcagtgggggcaggatgtgtgggtcacttcttggaggagtctggaggtgcagaaaggagacatgacaggagccagttggagccacccaggcaggcagggagaggctttttgagcattgaggggactccggcttatttatcggccagggtggagttggggagtgggaccatggggagacagaaggttccagtgagagggtgagcatgagcaaagccccaggggaggccagatgggaaggcagcagagcaggacaagacagtaatttaatcatacaatgaaaatgcactttgtcccacctgccccaacccaggcaggcagcctgggagtgtggggagggggagctgctgaaacttgtacccttcctacttatctgccacctgccccagcctccacccaccacatctacactggcacatctagaagaggaggaaggcaggggcctgcctggtttgaacaccgggagtgaatgatggccagaaacgtctgcagagcccagctgctctctctgctgccagggaactgggaaaataggagccaatggcatgggtgcgtctgaagcctcactggtgccttctttcccctgggccttggacagaagtttcctcccctccccccaacacccaggcccctctagggacagcaggctggctcagaactggtcagtcagggctggctcctcaagctccaccctctgccagctgtggatcttgtttcctgtggagcccggggatgtagccagccagcctcacaccttctgggggtagcagatggggtcagcactgtgcctcctggatttggagttttcctgaaactctctcagctctgcaccctccttacataatcccctgtttaacgacataatcctcacaacaatcccgagaaaggcattgtcattctcttgacactggagggcttggaggctggcaccgaagtcaggggcccggcccatactggcacctgtgctcctcctttgctgcctccccgcccccagcccccagcactcacaagtggctctggcaccagctctccctgggctgcccttggaagtgccctaagaccttggcccagcaaggcggaagggctcctgggggcagggagctgatcttggcctccaaacacctgcagcctttcttgggggctttggagacaggagctcggtgccccaccctgaggccattctaggctgcacccagggttgggtttccagggtttagaggggcccattggcgggagaagactgaaatgtgaagtgggaatgaaacactcattcaagggaggcatttaaatgctcaaaggcggctagaaagattaaaaagaaaaaaccacagctccaaggagttgggtgctttgggccctttctgaaacacagaaaggaaagaggaggatggagtcagacaagacagacgtggaagcatcgtgcctggactgcactctccatgagccctggactctgggcaagggtctgagggtgcccccctccaacccacccaggcaggctgctcctgaggtggggtgaaggcatccgatggctcctgatcatccatagggtccctgcctccatcctgcctgaagcacctccctagaggaggatatcagcacccccagcccccaccctgagggatgttggaccctactcagggcagccaaaggccaggccagctgagccctgacaagcagacacagctgcaggggagaggcactgggcaggggatccagctcagccacttccctctggtcagaggcttggctactgaccagaccccaggaggctgagctctcccttgggagcaagcatccccccggcccatacctgaggatgagggagagccaggcaggtctaggtgaggggaagtgaggagacctggtggggagggctggtgcccgctgacccatgcctgtgggagaaagatgtctctgaggcagctccagagggaggacagtcagatagccctgcagagggcccctctgatctggccccagcctctcttggatatcattctgttgcccttgctcatgctgtcatcatgatcttctggacacaactcccatctttcctgtcagcatctcctctgtgaccgaggccacagcctttctgcgtggggtctgcaatgacccagccctgcagggggacgaccccttctctgtagatgggcatttgggggtgccctgccgtgagagagccttgctgtgggggtgtcctgctgtgggggagccccatgggcagttcactaggacagaacagacattgcaaaattcgccctggaaagaagtatgctggtacctgcaactttctttgaaatgcccggcaaatgagatggattgatggatgtggagggatggagtgtgataaagcaaagcgagtgaaatgttatggtacagccatggtggcgggtgttcaggtatacactttagaatgttttctacttttcctgcctagaaatctgcaaaaatgtctataataaaatgttggggatcacatagaggagtagggaaagttgattttctgcaggacaggcctggctgggcagctcaacttgcccccaggagtcccctctcagtctagaaaactcttttgctttccttcactgatgttggtttttacactttgttcacctctacactcaaggcagcaatacactcctgtcattaatagaggctatggcaatgagtctgggggtaagggctatgtgtattttaagaaatctcaagtagctctaagatgcccctgcggggcctggagggcaagctggactttgcaaagcagatgctgtggcttcctggcagtccagacgtctgtttctatattgtcctttcctgtctctgcagattccagggcaggggaaggggcgctgtgggcacaaggtggccagtattttaagagggcaccacaggctgggtgtggtggctcatgtctgtaatcccagcactttgggaggctgaggcaggccaatcacttgaggtcaggagttgaagaccagcctggccaacatggtaaaaccccctttctactaaaaatacaaaaattagccgggcatggtggcatgcgcttgtggtctcagctactgtggggagactgaggcagaagaatcgcttgaacccaggaggcggaggttgcagtgagccgagatgatgccattgcactccagcctgggcatcagagcaagaccctgtctcaaaaaaaaaaaaaaagagaaagaaaaaaaaaaaagagggcaccacagcccctagggctgaaatggcaggttcacagcaattggagagggctgtcctggtcttgccgtcatcacccacgtggtgtagggcagtgtttccgtgacccgtaatgtggtcgtgcagaaacaactcagttcctgggctgcatctgcagagcccatctgggaatgggctggacactggtgactggtgactgcagggcatcctggtttggaaggggcttccctgtgaggggactggcaggagcttccacccatgtctgtaagcccagagcctggccagaggcccacccaggcttggcacctggggcaagggactgtccccagagcctctctgggctccttctaggatggttctcgggccttggcctgaatctagcttctgccaacactaggagctggcttggtccttgggttatagccaggaaggtgactgggatgtgcccagagaagcccagaggactggctggtgggcatgtttgggaggcaaagccaaggaacacttccagccacagcttgtagggggtggggtccggagcctcctctttcctgtgatgtccctgaaggccaggcctgcatggcactcctcatgatgtcatgggggttggggacctccaacatggtatggtgggagtcaggtcataaagccattctatgtgatattagcaggggccagcccattccatgtgatgtcacagagggtacagccagagtctctggcattccatgaggtatctttaggggtggggctgctaatgtcactaggggccagccatcaagcctttttaggtgacattattagaacctctgaaattttgcatctcatgtgatattactgtgggcagggccaccaaagcattcagtgtgctattactggaggccgggggtgcagaatttggcatcgtgcatgatgtccccaagagtgcagtctgagccacgatgacatcccaagtaatgtcccaggaggtgtggccttcctgagattccatggggaattcccgggatggagttgcagtggcattctgtgtggttacactgaagatggggcctccagactgtaacattctgtggtattatcggggctcagggtttgggaactggcccccgcacctgcaccctgccttctggaggtatgacatcaactacagaaccctaagccctgccccatttcccagctgagtttgctcatccaggcagggttgtcggctacctcactctctccacatctgccaggtagcacaaagcacctggcactaagatgcttttgagtgggtgcatttatcctgcccttcagcctggcagtgtctctgggatgctgctgtgtcttagctgctgcatctcccttttctcctggagtctgaaaagtgctccatagctttgcagggtgcaggggttataagaggctaatcaaggttacaaatagcctgcagttttttgtttgtttgtttgtttttagacagagtctcgctctcacccaggctggagtgcagtggcataatcttagctcactacaacctccacctcctgggttcaatcaagagttcaagcgattctcctgcttcagcctcccgagtagctgagactacaggcacatgccaccatgtccagctaattttttttgtaattttggtacagacggggtttcaccatgttggccaggctgacctcaggtgatctgcctgcctcagcctcccaaagtgctgggattacaggcatgagccaccacacctggccaccctttttttttttttttttaagaccgagtctccctctgtcacccaggctggagtgcagtggtgcaatctcagctcacggcaacctctgcctcctgggttcaagcaattctcctgcctcagcctcccaagtagctgggactacaggcgcccaccaccaggcatggctaatttttgtatttttagtagagacagggtttcaccatattggccaggctgatctcgaactcctgaccttgtgatccacccaccttggcctcccaaagtgctgggattacaggcgtgagccaccacgcccagcagatgcctgcaaatttttaagagacagagtctccctctgtcacccacgctggagttcagtggtgagcgatcatagtttattgtaacctcaaactcctaggctggagtgaccctctcacctgcctcctgagtagctagaactacagccatgcaccaccacaccctgccaaatatttttatttttgtagaaacagggtctgggctcctttgcctgggctggcctcaaactcctggcctcaagcaattctcctacctcagcctcccaaagtgctgggattataggcatgagccaccatgtccaacagcctccaaaccttaatggctcagaacaacaaaagtttctcattcatgcaacgtccaatacagtgctccttaatcatctctcctcctctccatgccctgcattcagtcagtcaacaagcagagagtgtgcaggatcacaaggatggttgctagaggcagacctggaaggagcatacattgcttccaccctcattcagttggccagagctagtcccaaggctgcagtcagacacaaagctctaagcaatgtggtagtcatgtgccggaaagaggaactaggcttggttagcagctggtactggccgtagcgaatgaaaaacacaatgacggcttctgttgaatactcccgggtgactcttccccaaggactggcctttcctcaggaccaccttccttatgctcaccccccacctccactatccaatcagatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaagtaggtgggagctctccagagcagggggcggaggtttgggtgtgggcatggggcaggggccaaaagagggattgtcccatagcaattgagtgggccccgccctgggctacaaaactgtgcaggaagataaggacagccctgggccagaggaatgaacaggcccaagtcgctgtcaagcacctagaggcagacattactgcctcactttacagttaaggcagagatggtggtcctggtgctgcccgtacgtgggccattggtcctggaaggcaggtcttacctacttccactttgcccaggcagcccccagtgacgtagcaggggcccatggattctgaccaaaatgcccaggggccatgatttctccatcctcgtcgggcccagggccttcttggggagatccagcccatggggtggacagtggatctggggccctctgactcagctatctctgagagctgactctggctctctcttgctctctcctcaccagccctgcccaggcaggagcttctggccccaggggcaacttcctcacctggtctcatttctggtttctacagatcaaagcgtcccattcccatctccacgacagcacctccagtccagacccctctgccggtgatccctcaccagaaggtaggtgctgactgtggcggcggggtccactcagccctggttcctggagtgctggccctggccagcctgcctggtctttggctggcccaactgggatgaggccgtgggatcagccctgccccatccctgcccctgctgcagctgaccctggggaagtgaggcagccccttgggagagactttcaagcccctgttgaacactggatgtgggaatgaatgcctgcctgggtgcaagccacctccgctatgcctcgtggctgggctgataggaagccagcttgggcagcagtgttcccaggagaggggtcaccctcctggccaggcaggggacgagcgtccaggctctgaccttcatttgccaagggggccaccgctgggtgactgtggctgaggcccagcttgacgaggacctccaggtgtggaggggcctgctggcctcacccagatctctccctctggtttccacttccccacctgcccctcccaagtgcattcccctgtagcccttaggacgtgctggcaatggcaggcacaggggagaagggaggccaagccctggctccagacctcaccactgcctaggcccttcccaaggccccgccaagcagctcaacccccgagggctccctgctcaacttctccccctatgtgaactgatagtgaccccacctgtccaatggggcagattgggcagggcagtggggagaggggagaaaaagaggctgacaggggtggggtaggtcacagactggggaagtgggtggagggctgcttgggagatgcttgcagaggtagactgaggggcccaaatgtgagctacccaattcctcagcttccctcctcacctccccaccacctgcccacaaccagcccaggaacttcatctcactggcagtgtggggtcagtggagcaggaggctgggctgtgcccactgggcacccactctcaggggcagggggaacagacacagaacgggccatcccctgacccctacacccacttcctcgggccctgggggcaggaagcttggcttggcttccatgcagggcttggcactctgcccagctggatgccagcctcacgccaggccaggagccatgtgcctgcctgctcctccaccagtgtcctcccctccaagtgctgcgcccaggcgctctgggcttcaggctgcggggctcgcgctaacacatctgtttcaggtccacgcaggagcgctgggacgcgtgtggcctctaaccgctctcttctctctcccctgcatggcctgccctgtgccaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggtaggtaacggacatacagctctccacaggtggcctgggccacctgggtcctcggtgctcggcagagacctggtcaggtggtcagagcgaggcactggccccaatccagccagccccgagcccatgaggtcagcagtgatcctgcggcatttgccatgagccgggcatgctagcgatttatacaaccaaccacgctggggtgacatgtcggattttgcagaggaggaaactgaggctcagagaaggttaagtcacagtccgtttgtccagctaccatgtggccgagccagtcctgaattcaggagattctgacttccaacactttttcactaggccactccccagaacaggacagcacagcctgcagccttcaagagctatgcacaggtccccacccctctgggagctcggaggcaggagcaggggagcgttcgagaggtggaaaagcgagttatctgggactaggaatagtctgggaagctgcctggaggagggagcccttgaattgtatatggagagactctttggcagtggcgtgcagggagcgggtttgcaggagtgaccttggccagggtggggtggcgaggaagcaggaccccaaggagaaaggggctgtgcaggagaacagcagcctcacccctaaggtctagctggcgggactctgggagcacagcaggtaaaaggacatgggactggggcactgtaggggggaggcaaaggaacggagtccccacactgggcctgtgttagctctgagcccttcacgcttgttctctcaccctaacttctactcccgccctgtgcaattggcatagccctctccaggcagggcaggctgagtcaaggcagtagagcctagtggttcagggttcctcctccgaatcatggaggaatcacactgtccatgtctcagggttattgggaggataaagggcccaacacttgtaaagctctgagctttgtctgtcacccactcactgcatgacacctggtatcatcactgcctggagccacccagaagagtcacagtaggaatccggtcagtctggcccaagcccatgcccttgcctttgcccttgcagcagaaggcacctgtgccccatcaggtcactgctccctgtggccctcagcttccccacccccccagctctttctagaatcctcagtgaagctgatttctggcaccacatggcttgcttcccttacccaaggtgacagagccatatatgcccccagggttccccagcaaaggacttttgccagaaaactcagggaatagtagaacagagatgacctccttgtcccgcatttgttgggctggtaggtcttcccggtccttttcaggaactggcctcaggcagagaggtcagcctctggtggcctgggactcccaggagacccacctgcaatgatgataatgtctccccatactgaccatgcactctggctatggaccagctaacagtccacatgccttatctctcagcaacactctctaaaacaactctctctgcaactccagaggtgggcatgattttccccattttatagctggaaaatagacgctcagagagagcaagtaatttgcccaaggtcacacagctagtaagtggcagacagaactggcatgcaggtctgcctgactccactttgcattgagacagggacttgctgcctgctcagggaagtgaggggccaggcccacctctgcttcccatagtgcctaaggtactctgctgtcggtgcaggggctgcccagaccctgatgaatgtgtaaattatttcttggtgctcagagcagcagagtctgacgtttcctccaagggatggtgggctaggggaggatgtgcagtgggtgcttcatccaaagtaaaagctgatgctgctgtctcaggcaatgccggcaggaagggctggagcctctgacctgggctggcctagggcaacctctgctgggctgaggccaccacctatgctaagtgggtcagcaacagggtcagcaagggctaatccccgtgcttatccatggcacacttctcccatgctgagcaccttagactcatgacccgttcagtctgcacaacccacctgcggggtaggcactaccatctcaagaattagaattaggaaacaggctgggacgggtgggtaatttgcccggagtcacagtgctaggaagaggcagggtcacaacttgaactctgtcctgtctggctccaaaaagaagccccttccgctactctctcctctgggcaacttgcagtgcaattctttggcacctcgtatcctcttggaaggaggagagagaaacagatgtggtgcaagggcagacgggcataggcatcccagcagcccccttcttctcctcccttctgaggctggcactgaagggcagtgcccctcaggccactcagtgcaagggcccctgggcaggtcttacatctttggctcatcttccccaagacccaggcactggctcctctcagatgtgtctgctgccaccatcccggccccaggtcctgggtgggagaagctgagcaggaggcaggaataaatgtcaaagaaggagcaggctgccaagggagggcagaggcagcccccaccccgccaggccaacactgccctctgcagggggccctgggctggtcagggcaagagatgaccctgcagctgtcagcactggccaaaaatggagaaggaatggagctccgtgctggccctttcctaatatagctccacttgcagctattttgagcctgggaggatagagggaattttatcagttctgaggcagtggcgggcctggggcagagcagggccactgtgctgctccctgggaccggggaccactgacttgagcctggcttcccagggtttggctgcaaatgaccagggccaggctggccggggcccaagctcccccagctacagcccacactgggcagattcaagaaggtggcagagtttggggacagagccccccaccttccacactgtctccctcacaggcccccgacagggctgctggccacagggtctgccactgcagggaatttgcatttaaagaaacacaggacagacactgctttccctacagagaccatgctctgggaggctcactctcaggtcagagtgagaggaaggggcctctcactgtgctgcctcggctgttgagctcacacttctccctgcgcctgctcgctcctccatcctgcctcattgctggcccaaggggcctttaggagtggcccctggtgactgtgcaccccactcccctataccccaagaggagcagccagagctgcctgcgtctcttctgggagggagaggaggtcaggtttgggggggcataggaaaccccgcgcacaccctgcctccttaccactgcaatgcctgctcaggacagaattccagagctgcccccacaaaacagactcttagtccggagctgctgacaggcagggaggcccctgggcctcagccttttccatagcagccacagctggtcctgtctccacccctagcttccactctggggtctatagccaggtttgtatgtgggggattcatgtatgcggtacgagtgcccctgaagatagacaagaaaacccttcttctggcaaagcagagggcactggggacccctcaagagggaaacattgctgtgtcagtctctgaaccaaaccgagggtcccagtagctgtgattcccggctctgagttctccctcctcactccttgctctcctcacccattgcggtttgggctggttctgcctccacaatgaccaggctgatgatggccccggcgctcaaactgcccctggtggagcctctctctgaccaccctgtcttctttgcccttttcctccccaggtggtagtcaactctccagccaagttagtatcaaaggacagcatgtgtgtgcgcttgcgtgccagccccagcatgtgtctgcgtgtgtctggcgtggatagagtgtgcctgctggcatgtgtacatgtatgtgcatatgtatgagtggggtacacttgtacccctgggtgagcctgcatgtgtgaagctggagtagaagcatttgggggtgggagtgggggctccatccgatggttctaatttcattcccaatttcctgctgcagcagctgcttaagatgtgcctggggttggtgacggtggcgggcgcagggggagggggacacaggctgtgctgctgctgggcctgtgtgagcctgaagacctttctgtcctggcgacccctcagaagggctgcactggatcttgtctgcccggggagcgcacctatccattggagggaagagcctcctgtgggtagaggatggccagctactcagcaaactggacttgagggggcctgggcagctggagccctgctctgaggaagaagcacattccctgaagcgtctggaagatcagagccctgggccaccaagggggtggcctgcaggaagagccccttcacggagaaaccttgctcagaatccctgcgggtgccagtggagccgcttttcacctttggggcattctggactcagcttgggctgctgctcccgacccctacccccagccccatgcctgcgcttcccctgctgtgtgtagtgggagatctctctgtgcctggcagcccctgcagaccctgggagggagctcaggctgagccaggcactgcaggggagctgggaaagccaagatgggcaaggaaacccttctatggccaggagtggtggctcatgcctgtaatcccaacactgtgagatgccaaggcagaaggatcagcttgaggtcaggagttcaagaccaacctgggcaacatcgtgagactctgtctttacagaaaaaaaaaaaatagtggcatatgcctgtggtcctagctacctcaggaggctgaggtgagaggatcacttgagcccaagaggttgagactggagtgagtggagatcacaccactgcactccaccatgggcgacaaagcgagaccctgtatcaaaaaaaaaaaaaaagaaagaaaaaagaaaaccttctgctgcactgggctttgggggagggtgccaaggattttcttgaatacacccagaccacccaccatctggagacttgtgtagcctatgggggttcagggcctcggctctgggagatctctctcgacacccaccgcgcccagcccttgccttggccacccatgtaaccgccacctgttgcccttttctcctccctctccctgcccgtactcccgcacccctcccccagcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggtaagcgcctccctcctccaccgccactcagtgcctccagagcccgaggggtatgggccattgggcaccatcgggaccagctttcttccctcacgttggacctcctggaggcatggcccttggaggggagccagccttcaccagggccttctggaacgtgggtatcctctcttcagaccctctccatggtcagctttaggagaagggtggagaaatgcagaaaatggtggctcctcaaagtgcttttcacagcctctgcattttcccaggctctatgaggaggctggaagaagagacttctacagtcctcttaacaaggggaccattctggaggcccccaggcctctcacagcgaagctgtcctttaaggagggggaagttaccaggttcttccagcaatgagaattgattcaaatacactggctgggtttctggtttgggaaggggtctgcgaccaaccatccacactactgctggcaatcagtcccacagatgggagcaatccccttctttttgccctaggaagcccggcctcaaggcagtggcatttaagacatccttggttcctggaattcacccattagctatggctggggaatttgagggttggtaaagaaagagttggctgaaaatcatttgtggatgaaaaatgctagcaatgcaaacattcatgcagacagacctctctctgcgtgtctctgtgtctccctctctctgtatgtctctttctgtcttcctccttgttgctttttctctgtctctccctcccccgaccctcgtgtgtgtgtgtgtgtgtgtgtgtgtgtgtgtgtatgtgtctgtctatctgttgtttcttttttacacacatacacataattcctcactgttttctacttgggaataccactgtgttggctgattatcagtctcggcaacatcttatccctgggtcaggatcccctagcaattcaaggcaaaaagtcttgaaatgacagtgatgcttttttccaaagccagaaaaaccgatgtaataagagggatggagggattaaaaagtcccagagaacccagttgcacttggcctttccagaccccagcccttgtggccatgatatgcatgcaggttataaagggcaggctccccagccccaagggtggaacagtgtgggctctctgggctctgctggaactgaggagcctggggcccttttggagatgcagtacttcctctaggccaccagggagcagaggtcgcctgtcctggagtttcaagtcaaactcccaaggctcagggctgctgctcttcgcctaattctgggcaaggttgattgaattccatcattcaaagcagaaaatatgaccatgcaagtttacaaacacaagcattagctcatgcgtacccagaaaaacaaggctgcctaagcccaagagctaacagggatttcctgttaacatttctttgtcacgtgtgtccttggtgtgctcttaaaagtagtagcaatggccaaagggaagttcaatggagaataatgaaagaaatgctcttcactaactttctgttttctgcacgttgggaagactgctatcatttggtctcaccactagggcacccatcagttttggaattgatgcactgttgattaatcgagacttcacgaaggacgtttcccatctccctcctgtcccctcccatcccctccctattcctcccctggtatgcctggaaagggtcctcttctcctcttccttttaacgcagccacgctgagctgaccatgctgtggtgccagtgagtaaccctcttggccataacgtgctcccatttctgctgttaatttccgtggttccttcctcaatgaccgtgttttttctctttttcttcctccttcacccaccccattcccataactcgtttctgaccctaacccggctctcttgtgtgcgctgcccctctgctatcccatgatggacgcgcactcacggctgggttttcctctgcttggcagggcgtcaccgctggcgtaagtagaccctgcagtgtctgtccagtcatccgtctgtctggttgtgggatggtgtgtgtgggtttggtgggatgtgtctgaggaccagtggtcagcccacgtgctctgtccacgctcctcctcacacccacctgtcagccaaacgacatcccttgcagcctttacaggcaagtacttgtctcttggggtttgtccaaataatgtcactgtggtcacagaaatcacagagtagtgacactcatgctgcaggcccaggctgggggtgcatacctgtgttcttcttgccgtgctttggggtagctccccccgcctttcctatctgcactggaacagtgtagacccagacattagaatgcacactgggccattattcagggctagaaggtgacaaggtaacctcttggaggccactccccagaatcctcatgggaagtgtatctgcaggagccagtgcctgccatgaccacccatgggaggggaaagatgaatcagactgggggctgcacacagtgaagcaaatgcagcggtgacctgatgttgcggtgactgtggagtgttttctgtggcaagaagaacaagctgaaagtgggtccagagagtggactcaggccaagggccaaggactgcaggacctgttccatcttccctgcatatattctccctgagccttggtgtcatgaaaggcacagcagtttccttatctgactcccagtcttggtcacagcagcaacaagagtccctggtctttgcacggggttgtgggaaatgaagccagaaatgctttcttgaacccttggagccaagaaaggcacaggggagctcctcctgggcacattccagggaaacagcagcaaacaccttccacctgctctctggattgcaaagctctgtagagaggctcaagggccttgcatccacaccttccctcacccactgcacagttcacactccctccttccctcccctcccagtgggtcaggagccaggaccagggagacctggttgtgccttcctgttgcccatctcacccagaccttaggaacgcctgggactcctccctatgccagaaatggcctgtcccagcaacagcaagatcccaccctctcctttgctccctgggcagctgcaggctcctccctggccggaccctagaagcctctgctggtctttcccaaccgatcccaaccacaggctgccagtacctatagctctctgggccagggcagggccttcagcgaagccagggcagctccacccaacctcgatcacctttccccacctctgctcttgtagcccaccctgagccagacacagggaccagtcctgggacacaaggtcagttccctgtcacactccttgcagggagggtataagacatggacaatggggagtttcctctcccagccagccagccctctggggaaaagggagaggcaggcagaagagtactggacagggcatctttccaggcataggtccagggcctcccactgggcagaagtagccttcctgagccctatgactgcagggagcctaatggaaaggacacagggctagcagccaggaaacctaggttctcacccaatggggcccttatctgctgtaacctggagctagttggctggcctctctggacctcagcttcagcatctgtacgaggagagggctgggccagcagtctgttactgttgtgggcttcacctgagccctcccaggcctctgagaaggtgggctgggcggcttggtcctctggtcccccggccagggtgagtgggctgtaaggcttttgaccatggcctgcactgcagtctgattcaggctgggaggcactggacccgaggggctctagggtcccttctggctctgatgtaggatttgtttgttcagccaagagttttgtgcacctatcatgtgccagaccctgggagcctaagggaaggtcacctggtcctccacaaagggctgcgcttctctgggacagaggaccagtggcttccatgcagccccactcccaacttccccaggccagaaatcccctgtccctacaggccatgccagggctgtgccttgctgccttgtttcttaccactttccagcagagtcagcctactcacactgagcccatggcccccagtccttttccagggcagtgacagcattggcagctccttgtttggatccaaaagtgtgaggagggcaggagatggatcctgaggaatcctctgtgtcccccagttggcctctctccagccagccccaaactcacggcctgctcacggaggtcaaagaagacctgttctgtttcctccctctgtaaagggaatctaggggtggaaatgtctccggcctaggcctggagttagcactggggaagggcagacctgagggatctgagcctcctgtctctcatgagggaggggagtcactgcttcactgcgaccaatctgagcaccgagaacccaggtcatgcccatatctcaggttctcagacagcaatggataaaggcaaggtggggacagaacgataggggccaccaatgggcatggagcagggacccagcagggtgggaactgggctccagcctagccctcgcccacggcctctctctgcattacaggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcagtgagtgcaggctctcagggtggctgcagaggagggagatgctgaggggccaccagggacctgggcccagcactgcagaagccagggagtcctgctacctgcccttgaaggtgggccaggcttgatggtttgtcagtggctggcagggctccttctgggcctctcaggcaggctgtccggtgacagcagccttctgctccaatgccaactccagcagtgggcagcaggcttggtgtgcaacttccgggcgagatgattgcccagggctgggatgaggccctctcaggctaccccctgactctttcccaatgtcctctggggcctctgcccagcacacagtggacaggcaagggggcagtcaccgtgtggggcctggctgaatcctggggactcagtgcccacagagccccagcagctttccttgctgtgtctcccgtgagtcccctgaccagctcctttctaccaacagtgcaagaccctgatgaagaagctctgcgaaggtcaaggtaagtgcctggactcaggctctgtggccttgccctctagccccgtccctccccgggcagcccccaggtcacatcactcatggaagggacctctcaagttcatggatttggaaagcctggcctgcaaagggctccagctgacactagcttgaggcagcatcgtgagtcagtgaggtgggcacctggacccgagtctctgtcctccaggcccaggctacaagagcgaaggctctgggctctcccagcttcatccctgggcagggggcagggctgctttggcctttgctgggctgttgagaatgagggcaactttccctgtgaggacacccggctggccaacttgcccacccactcatctcagggcctgtccccctatgattccgaaggctgggcactgagaaacaggcacacagggggctgtgctggacgtgaacgcctgacccctggactcacctgtccagacccacattgaggtaccagttctgtaagttgctcaaagcaaaatagttgctgaaaaaaaaagaacaagccctggacatgaggatgggtttgtgccaagctggggtcttagagcatggtttccccatcagttgcaggtctgaggccacagccaccaacctaccactgtggcccgtcaggtgctcatagcatgaggtgggcatgggggggggcatgccatcctggaactcactggaacccgctggggccttccatggtaaggagtagggctcattgtgattgtatgtacacttccggtagcaaatatgtcatctgcatgttcttcccggcactgtctgccttgggccagtgcatcctgtggcagcctctgtgcaaggggctggggctcagaggcaccctcccatcctgggccaagctttctgtacttgctaaccagcaggcccaacactcagtggccatgtgacctgtgcagagtaggactctggagccagcttagacttgtggattttatttttgaaccaacacttttgccaactcaagttgctcccactttttggccaggcatccaagcctaaggtggggtcctcccaggcctgctaaggatggcatgcagtcccaataacagttcttaacccttcagtgcctgcagggcatctagagagtccgcgatgaagtgatgtttgatttagctcaaaagttaagctccagctgctttaagtgccagagctctcagctctcccctcccgctgtgctccgctgtccctgcgtgctgctcccatgcttgtcttgccctcctcttagaagccacccatgtagctgcttcagtgtgcaatgcagatgttcccaaacatttgataaaaaagtctttaaatcacacaccccagagcaagcggcttcaaaatccccccgggttccttccagcaacaggccagcagggggccttttttctccctcctctgagacccagagtcctgccttcctggctcccttctggttccttaatgttctgcttccctccgatatgcaaggcagtcacgctcagcttgtgcctcattaaccagatgtcattagaacgggaaagagtaccgtggaagtgcattgcagcaaacttttgtcttttctttcccctggaatatttgcaggctctgcaaagttattgagtgaggagagcacaaaggcagtgttgaaggtggtccccaggcctcatccttggccttccccttccctccttcaaggagcatctcttgaagtttgttctgcctggtcttgagggtaattgaagggtgggagagtagtcctttcaccagcggcctaaccccatgaaagtttggttcagcctcagcaaaaggcagctttcggagcctctcccccagctacggcagggtttcatgctagggaaatctggggaagagggcctgggaagtggctccagttagcttcctccctcagtcccaggcaacttccctcaccccatcagcacctctctctggggtctcaggccctgcagtggaggctctgaagcacccagccagcctctgcccaggtctggaggggctcctctcccttcttctgactttaatttctggagagttatcctcgtgggcagagccacccatgtcactgaatcccaagcagtgatcccatggacccagaggcaggtgcagtgggtgtagcagttctaatctgtctgtgattgaagcctaaagcagtgtgtgtgatcactggtcatgactggggccccaggctcacctacatcactatctgagcagaagggaacatgccttgtcccaccctggtccaggctggtcaggggtcttgctcctcagaggcctgagccacacttctatctgtccccactcccaagttcgaagctgcacccctagactctcctggcccatcttgttggctgagagcagccacctaccttctctttctcctcccaaatcccagcggggattctcagggtctctcttgaaggctgagtttccccaggaaggcttccctgtaaactgcttccaagtgtctcactccagcagagcctgggtttgccaatcctgtgcatggtgacacctacacagtcttatgcccatgcaaaggtgctttctccttcctggtgctgtgtggtgctgtgtggtgagaaagttagcgggaatgttgagtgagtagtgtcaggcattctgcaccaggcaggggctctgggacctcgaggtcaagtgtgaatacacatgtcaagaagactttgcaaactttcccttcacctccatcactgctctgcctccaaggtccacccccagagtcccagggcagctcacagccctcttctcctctcgggtcctggctcctgatggtatctctgtgtctggtagcacgtagcttccatctgaggctccagtgccaacctgctggctagcccaagacagagtctaatttccagggactctttacaggtgaggtgggggaggcctgaacaggccaggcatcagctatgaacttcccaccctggaaggaccaggcaccttaggaaactgtccaggttgccttgaacatcagccttctgcctacttccacatgggaactactctagtaggtataggtgacgctgtggctccccagtttccatcggaggtagctgaaatagtgcctccatcccacaaactgagcctctaatctcagagtcatcgccacagcttccttctgactttggaaaggcattccagggccctgatcactcaaaaggtcagatccacattgggcagccacattggggataggggtggggacaaggcagggcttggatctgcgaggcatctggatcccactgctggggggaactatccaggatgtagcccagcatgtaacccagacatgcccctgatcccttacaagtgcagcctctgcgtttccctgatgcctgcctgggtaaagagctctgcatctccccatctttccaagcgttaggaacaaagctgatcttagtgaagagtccctagaggagctgaaggtgcatcacatagccctttccatcccagatcatgcaaaaatccttccatgcccgttttctatcatgcagccattaagcttcttccaataagatgccagggctcactggctccccctcttccctcctgcagcctctcagatgcccccttccctccctctgctgcgcagtctctcagttttgccccccctgcagccacctcgcttacacgccgcacagcatagggccctcctgccaatgggtgcccccgccaatgggccccttgtaagaaagcaatgaaaaaattacctctcttttttggattttgagtccctggtgttctgccaccctagcgagtttgaaaaccacaactggagcaccagggatgttgccccaggtgccgctgcctgagcagcccctgggaggtcgtctttcttgctcttgctctcctgtctcttttcctctctcctgtgccttcctctcctggctcctttccttggctagctgaggatttttaaacagcttcaagtagagcatgctcactagattggactctccaggactgtccctgtccctgtcactaagcactaatgacaaactatcacccagcctccacaggccttgctaggacttgacgatttacaggcaaactgcctgtgtctgatcttgtgcccctgtgtcctcggtagtgtctacgggatggtcaggactgtttgtagtgctgtcagcaggactcaaggagccccaccacatggactttgctcatgccatctccacccctttaccccaacctcagataggcaggtatgtggcaagggaagaagacgctggcacttagattgtgattctgcccctgagtttctgtgtggctttaggtcattcatgtgacctctctgggcttcagcttcctcttagtataaggaaagttcagactagactggtggttttcaaatatgttatatgttagcagtgggtcccttttgtcaaacagtcttagacagagacccagtatgcaggattcaaggggtagagagagacagagactgccaggtaaagcaggtgcagaaccgaggacctctgtgagtgtggggacatgggggccagccccgatgactgttactgtgcagaaatagaaggccagcactgccacatcttcttttcaaagacttaaagttgctcttcctgatttttatatgctagcaattcacttttttttttttttttttttttttgagacagagtcttgctctgtctccaaggctggagtgcagtggcgcgatctcggcttactgcaacctccaccacccaggctcaagcaattctcctgcctcagcctcctgagtagctgggattacaggcatgtgacaccacgcccggctaattttgtattgttagtagagatggggtttcaccatattggccaggctggtcttgaactcctgacctcaagtgatccaccagcctcggtctcccaaagtcctgggattacaggcgtgagccgccgtgcccggccaacttcttttttttctttttctttctttcttttttttttttttttttttttgagatggagtctcactctgtcgcccaggctggagtgcagtggtgcaatctcagttcactgcaacctccgcctcccgggttcaagtgattctcctgcctcagcctcccgagtagctgggactacaagcgcatgccatcacacctggctaacttttgtatttttagtagagacggggtttcaccatattggccaggctagtctcaaactcctgacctcgtgatctgcccacctcagcctcccaaagttctgggattacaggcatgagccaccacgcccagccaacttcttaattaaactttttattttgagataattgcaaattcagtgcagttataagaaataatagagatccctagttccctttacccagcttctcccaatggtagcatcttgcaaaatgaaagcacaatatcacaacgaggatactgacactgatacaggcaaaacacagaacttcccttcacccaggatgccccatgccgcctttttatagccatacccactcccctccagcacccacccacctccttaacctctggcaaccactaatctgtgatctgtcctccatttctataattttgtccttttcaagaatgttatataaatggaatcatacagcatggtaccatttaagattggccattttttaatcagcataattcctgggggtcacccaagtggttgagtgtcccaatagttcatctattcccttttattgctaagaagcatctcatagtatggactcagaaattaatctttaaattgagttggaagcaccgtacaggttaaacatactgtgtttgtggctggatggggccctttggccaccagtgggcacctctggtctggaggatgtgatcggcccttccagcctggaaggcctggattctgacgcctgtggcactggcctttctcaggtgctctcttcctccattcattcccacgtttctgactgctgcttgcctgctctgtactgtggcctcagctgagcaggtgtggcttgagccccaagaggccccactggtgggaagtggccagaagtcctggccctgtatctgtgacagtgaccttgtgagtatgtgtgggtatgcacgcatgtgcccaggctgtgctcaggcctggcgagcaggggtgggcaggggctgtgtgcaaaatcttctctctggggacagtgaggcttttcgaggccagggcagcacagggaaggggcaggtctgcccaccaagcctcatcacgggggataggtgctccttcttcttgatgcccagctaggggacagagatcatgcgaggtgcacctgtctgtttggttcaatcctgagagctcacagccaaagcagccctgcccagccctcactacatggaccagggaggccctctttgctcagtctgccctcagggccattagccaggtcccttctccacagcccccaactcactcaaggcagggacttcagtccctccatcctggtccccaagactctcggtcttcccctaacccaggcctgacctgggttacaatgtaccccatggattgcatagcttctccaagcccgttccctccctcccatgccctctgccccacctgttagacaggggaatggtgaacacattccctaacccctttcattctccctctcttctctctctttctgtctctgtctctgtttctctctctctctctctctctctctctctgtgccacagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaccaagccccagtcatgctgtgcctgtgtgtgtcccacccaagaggggctgtgagggcatgatctgggacagagagaggacaggcaccatcagaagaggagcaggggctgtgtccaccggccccaggacacagcgcagctctggtcctgctgctctcctgccccacaggttccgagcccagctgcaacccacggcgggaggatggctggtgggaatctgtgctgaggcccattgggcaaccttagtcacccacaggacagtgcatatgggaatactcgaatgccccctgcctctccttccacaccctgctgcaaccagcagactgagccattgtcctgccccaccccatcagaaggcaccccgcaagctgttctcacaggaaggagctacttatgctcgatcctggtccagaggcgagagaagggctccagtgggcacacctgggctgagaagcagttcacaagggaactcagggggccagggctggggctcaggggaaaagagatggaaggcagccctggcagattcttgctcaagtggcaggaggcaagagggctgggaaggcttccacctgggtcttgctcccagctcccacccacctgtggccttgtcctagtcctgggcatttaggaagggctaggaagggcagcagcagccaaaaagatcccagccaggcctcaggctcatgtcctgctgagctgtaagccactagctagcaccccattcacctgacccaggcctgaccacttagaaagtaccccatgatggcaaagcttctccaggccaattccatgtccctgattgtgtgaaatcacaggctgaggacatgagagtggtggcacttacattagaagcagatgctgaggcccagccctcaaggctgtcctgccttttctgtggctgggctagccagagctctgcgcccattcctgctgcctgggcagaggctttccctctgcctccaggaaccttcgcaatcccaccaggaagcgttggtgtttgaggccgctctctcctgcccatccaccctgagatgctccctaaagccccctgccaacctattctggcctcccaccccatcctgcctccagcagtctgatgcccgggccaggcagccttcatcccgctgccttcatctaggcctcctggaacacactcatatttggctgatgttttacagaggacttgcaaggcccaagggtgggttgggggcaggggtctgccagatagagagaggtcctgggcaatgggtatcctgaggctggcaaagcctcagccaaccactaagagttggcgggctcttggacccctgctcccagaccccagcctgtcggagctctcttggagccacctagttgaagccctgccttcccacctaccccagaccccttcatgtagtgccctggggggccccaggctgggttccatgtaaacccctcagtataagcaggagagatgttctcattcagcatccggtgtctgtgggcatttgtggaggtgcctgactactatgggtgctaaaggaatcggaaagggccgatgcggctgtgttcccaatgcaaggttgatcatgtatggtccagagacagggagcatccctccaagtggtggatcaaagaaggcttcctggaagaagaggtcagtgtattttatcatcaggaatggttagaatttgggtggaagcagatacaaaaggctggacagatactctaagcagaacaagcagaggtgctgatgagaagtggtgtcccagaaccccaagttaatcattttagttggaatggagagaatgcagaggatgtcatggttagtagtggtctgcatctagactcccaggctatgggattttgaatgcattctgaaggaaagtggaactagcaaaggctgtagggtgcctttcacactatagctgatgaggtgttcttcatctagaccacaatggcaatgtgggccctggagttgcatggagcattcctggggcaaagtgatgcagctcagggttcccctgagccatagtcaccaggcagcaaggtggaacatagaccaggtgggtggcagcatgaataatttcaagaccaaccacctgactggcattctatcatcacccaatcaacagagattttcatgctctaccatcttaactaacacaagtagcatcatcacccccacagtggcaaccaccccttcagcactgtcaataccaatcacaaggcccccaccatcaccaacagttctgaccaagcccagtggcaacaaccccaagacccagcatcaccaccaccattcccatcctttccagacataatatcatagttatcaataacagcatcaaccaaaccccaccattcccaccaccaagggccaccatggaagagcaggggcacacagtcaacatgctccaccttgatgctgaccagactgagggaagagataagctgaaaaggggacgatggtcaggctgtgtttctcctggccacgccaaccccccatggagccatgagcatgtgggcctagtttggtttgatttggtttttgcttagatgtttaaactgaattatgactaaggcaggaggcaactgtagaccttagatcaggatggggtgatctcaccagcactgtccttaggaatgaagccaggaccaagtaagttctccacagtgcttgctctatgatgcccccttcagaatgcttcagagggtttgtggaacttcaggcaggaactgacctggaataagagcccaagatccttcaagataccctttgatgcctcctctgccttccctagccctggcttcttggtgtctttagacagtgtgctagagaggatgctactcagcaagaaccccaagcagcaggctcccttacgtgcatacccaggtatacctggtggtgatcatcgtcctggtgctgtggtcaatgatgaattttcctagggcccacatccagctccaacttcatgccctggaatccagggttcatttggagctctggctgcggagagcagcaggtaagctggcctaacagtgaattggagccaaggagacaggcaaagccaacctcctattcatcctacagaatattgtccccagcctggacactgtcattgtccttgtcctgtgcagtgtcctcatttcccagcagcctactggaagtgtggtgtagggccatggagagcagataaaggagatcagtgttctgtgtcagcctgagccgtcccaggccatacctgcccacactgagaggagggtctgagcagccagctcagtggcgtggctacagagactgcagctacttctctgaggcagtcacatcaccggcatggcttccagaagcgaggttctttcataggtgggttcgtggaagggccagggccaggcacggctgcaggcctgcaagctgggctgcccaagaccgcctccctgagcattaagtcagggaagacctgggcaggatgtaaccactgctcttgcccatcccaaaagcttcccacgcagttatggagaaggatggcactctctctcccatgggggcagtcaacctcaaccttgccacttctccagctccattcttccgtgaccctgtcacaatatttcatgccctttttaccatacacctcaccagatgaaggaaagtaattcagtaatgcttttgcaaatagctgagggcccgcttgcattcctatctagggcagacccctttagtgtcagctactccaagtgtggcctgtatacagaccagcagcatcagcatcacctggaagcctgttagaaaagtggactcttggccgggtgcagtggctcacgcctgtaatcccagcactttgggaggccaaagcaggtggatcacctgaggtcaggagttcgagaccagtctggccaacatggtgaaaccccaactctactaaaaatagaaaaattagccaggcatggtggctcatgcctgtaatcacagctactcgggaggctgggacaggagaattgtatgaacctgggaggcagaggttgcagtgagccgagatcgcgacattgcactccagcctgggcaacagagcgggactccgtctcaatttaaaaaagagaaaaaaaaaaaaagaaagaaagaaatgtggatgctcagttctgccccagacctactcaactaggatcaacttcattttaacaggatccccaggggcttcaagcacacatggaagtttgcaaagtgttatagtggtgaggccccaagcccttttttgccattttgcagctttgtgatgttttactagagacacaatctttctggacctcagatttctcatctacaaaatgagggtcacaatcccaatggctcagggaggtttaaatgataaaattgagtaatagggtaatttctttttttttttttaagatggaatttcgctcttgttgcccaggctggagtgcaatggcatgcatgatctcggctcaccgcaacctctgcctcccgggttcaagggttcagccccccgagtagctgggattacaggcatgcgccaccacgcccagctaaattttttttttttttttttttgagacggagtctcgctctgtcgcccaggctggagtgaattggcgtgatctcggctcactgcaagctccacctcctgggttcacgccattctcccgcctcagcccccaagtagctgggactacaggcacccaccaccacgcctggctgattttgtttttgtatttttagtagagatgaggtttcactgtgttagccaggatggtctcgatctcctgacctcgtgatccgcccacctcggcctcccaaaatgctgggattacaggcgtgagtcactgtgcccggcctaattttgtttcttagtagagacaaggtttctccacgttggtcaggctggtctcgaactcccgacctcaggtgatccacctgcctcagtctcccaaagtgctgggattataagcataagccaccacgcctggctagggtaatttcttttactgtggtaagcacttagtaatgcaaagtattgttattctaattatttccaataagaatagtgccttttattggggaaagagtctacttggctgatcacaacaagaggtttatttcttcctccatgaggtaccggttaaggattcaaatcacaacatccctcaatcagatcctgctattcttactgataagttgtaggaccttgagcaactgaattctctttgttaccatttcctcatctattaaataagagtccatgataccaacatcagagggctgctgtgaggaagtaaagacatcattcctggcacatagcatgaggtcaataaacaaactgcatagtgtagggggagtcattcccacttgcagaagctgcatttatccagttgctgttattgcaaaaacaaatcaaagagtaaagaatgtgcatttctttgctttcctataatttaatttttattctctgcccaccccattttacagttagcaacccagctctgactgctcttgtcttcctagagtggttctagggaagaggtgcttacagaatgccaaggcactcagggtgggggtgtgggggcacacctggtcctctgtcaggttctgcctgcactggcatttgctgagacatccccaacccgtctggtccacactggcagtgtggtcgcctttctctttcccagttacaaggtctttcagatctgcaggtgctcaggaccatgttcttgtcactcttgggtgcatggcaaatcctctagggcacccaggccacacagaggcatggggatctttgggctatttcaggtctgcctggcccctcaccatgggcatggggaaccctggggtcctgctgcttcctcagggttgaccttgaaaaggggcacaggggcttctattcttgaatccccttgccacagtgcccacttttgtccaggtaaccttgctctgcctggcatggtagctttcagccatctgtcttgttggtgccctgagtccttccgagcccaaagcctaggttctcacaactccagagcctaagcccttgacactcaaatatcttcactctgctttttttgctgtatcattccttcccaaggtagcacatgccccctgactgaatggggaagggtgaaaacaggatcagggaggaacctgggtggataattccatcggcctttctaccacactgttttgctgaaaaagaaaaattaggaagtacagaaaaatttgaggggtgggggtgggaaattcctccaggattgaaaaagtttttgatgttactggaaccctcctgtggtctgagcctctgctcctgggatcctggaggagctccttccctgagctggaagacacaccctctgaggatcctactctgtttgcaaggcaggtggagctttctgcccagcctgcctctgctgcagccacctgcccccatgcagaggggcctcacagggtctctaggctcccttgacctgttgtctttttggtcccgcctcatcagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggtaactgggccacaggtgctgggcctgaccctggggaagggaggcaggaaacgccccactctgggtctacctgtggccagctgtgtccaaggtagttagggcccgcaggcctagaggaagccaaggccagcgctgcttggtgcagagtgtgaaggggaaactgagggtgaattacaggggtgtgcaccactgtggcggggactgtcactctgccccccagggacacatacaccggtgagagaggtaacagtgtctctctctgacacatataccagtgagagaggtaacagtctctctctctttctcacagacacatacacacactcatacacacaaagttagataacaaaaggggactgtggaaaaagtctttgttcctggaactcaaattagatagaatgaaagttgtccctgtgggctggagaaatcaaggaaggctccatggaggaggcagcattggagctgggcagggaaggcaggtcagatttcctcagagagttcagccatgttaacgccagaggcacctggtatagtgggatttatatctgctccacagcttactgtgtgtaaccttgaaaaagtgactgaagctctctgaacctcagtttcctcatctgttaagatgtttacctaacacttattatatagaattatgatagaaaaaatgtctgtaaaacacctaatacatatgaaggacacaagtattgtgagttcctgcatctgccctcctagacacccagcaagcagagaccaaaggccaggggagaagagcgaaggcagagaggccaggctgacaggtcactctgcagtggccatgtggcgcatcaggctggatggggccagctctctgtctgggcttccaagagtaggccagttagtgtttggggtcagagcccaggtgtcccaggcctcccaccctggcccccacggtttgctggggaggacatgcctcttggatcaggatgggtaggtccatggtgcagcctgaggtgggattgatgtgagcaaaccggcttgcaggcctgtctgctgcccccatcccgggcttcacattaaccacatggtgccaagcccaacctttccccagcccaactcaagcctgaaggaggagcctggccctccagggatggtttcatcccagtttcctggggggatttaggacactgcttcccctctttataccagaatctcttcatataaaggccttgctacctgcagaaagatgaaactttgaggagggcaagaaatgcctctgtttttgagtgggaagaagcctcccaatatgaatggtgaggggctataaatgctggagccctgcaggcagtctagcctcatccctggggccccaaccctgctcaaaggcaggcaccagcaccaggcttaggtctcagtgtcctgggcctgcccacggctgagctcctggaacccttgggatgccccccacagggggagtcctcccttccttccctttgccttgccaggagagctgggacctgggtggagcttggagaggggcacagagggctggctgcccagcggggagtggggctggagcagaaggggtcacgggtttgcactctgagcaaagctacctccgctcctcacacatgggctggggtggagcgggaggtgggggagcccatgggaggcaaatggactccccagcctttcatgggagcatggcttcagaattttcaatggatgccataagcctctgctccctttcccagtgccagtccctgactcaggacctgtagctcctgggctgtgggcaaagtgtcctccaatgatggagtccagctaagaccactgcaccttggcccgcccccatcactatggaagcctggcaccccttggacactgtctcttcctcttccatggagacccctactctgctggtcttagcacaggaatctatccagagaagggcaggtgggcctggggaggggagacaatagcttcactcagccagaaactcggcagcttgacagggcaagtgtgcacagccccctggtctgggatgccagctccctgaggctcattttatctccgccttgtctgggacagcccctcagacctctctggatccactcagaagcttggtggtgggttctcatgccagggccagtcccttctcagagccccagagaggaaggcactcctcatcctacagctctgcccagcagggatcggcaggccccaggtccttgaggaacagacagaaggaaggcagaaagccatgtgggggtggcaggcagggctcacttctccagcacctctagcaataacccatttgccctgggtgtgggcatgtggtcccctttgagatctgaaagaccagggatgtgttctgcaaggtgttcattagttttaaatgaagaaaagcattttacaaacaaatacaattggggaacactgatcagacaaggctcaacaggccgctggattccaggagttctcagagccttcagctctctgggaggagaggccacgacgcacagactctcctgagggtaatgaactaggacgctttttttaaaatctctttgaccccattgtccctgggccacacatggggaaaggtgaccctaggccccttgaaaactaacccagttggaggagggcaacaggaactctatgcagaagaggtgtgtgttgggggagaggggggtgccttgggcagcaggcgggggcagtctcctgacttcccctgagctctcactggagcatctgtgcccagaaacctgagactttgctgttccttccagcaacaatagaaaagggtaggcagaagaggccaggtggtcaggggctgaggtgccccacaaggtcgtgggggtaggtagttctgaccagcgccatctctctcctctcccctacctatgcgctcttccacagtcccacctggacagtctctccccatgagagtgaagggtcttcccggtgtcctcctggtggcttttctccctctctccaaaggcggtggcactagccacccaaggaacatcctcctcccctccaagaccctcatggtccttccttcacagtttctggcagttccccagaaatgtctctgtcaggtgtcctcacagaggcttctgaagacctgggagccagcctgccttgactgcaggccccagtgggggctgtccttctgggtgtaacccctccccgcttggttccaggccccaggcctcttcctacagccccgcagtggccgcctcttcagcacctgccacccacaccagctacagtgagggccccgccgcccctgcacccaagccccgggttgtcaccactgccagcatccggccttctgtctaccagccaggtaagaggcagagcaggaggggaggctgtcgaaagccatgggcgggctccaggagccacaagagccaagaagtggctctgggggcacatccccagaagaatgggaagcaaggccttgctaatgatgctccgccctccgtcccctagctgtgggtcagaatcctatggagcctgcatctggtctgggggagacaggtgagcaagaaagcggtggatgattctaagggagagcgaaggagagcagagaagtcttctccggaccgggcatggtggctcacacttggaatcccagcactttgggaggctggggcaggaggatcgcctgaggtcgggagtttgagaccgccggggccaacatggcgaaaccccatctctactaaagattcaaaaattagccgggcgtggtggcacccacctgtaatcccagctactcgggaggctgaggcaggagaatcgccgggaggccgaggttgcagtgagccgagactgcaccattgcactccagcctgggcgacagaatgagactccatcttctctgtgtcatgccagtgtgcgagatttggccgcagccatgggggtacagaacagcacataaggagcctagactcgggagcaggtcctatccaggcgcagggagaaaccccagggaagttttctctgccgctggagcccagggagatgagacaggcactgagtcagggcaggccttgcttcggggcgctggttcatgaagctcgctctgacagcagggctgagtgtgggcggtcgaagcggcttttgcccgagacagaggccggtgccacggcctgctctgctctcgaaggcaaagtgcctcatccatccaggctgcgctgttcatggacaccttgtgttctggggatggaatgaagcacccagcacagcgtctgtcacacgggaggtgcccttctctgtccctacagagaaggggcaaggatagacggttctgaggtgaaaactccgcagggcgaggtggcattttgcagtagtgaaaagccttagatggagcagtgggaagaggctgcccctgcagagactgggaacacagggaggggaggctggagaggagttggaggagaagcggcgggtggaggcgaggccttgccggggcacaaggaggacatttccgtctcttcctggggaggcgcttctggcaccttccggggcggcctccggctgtcttcgcccagcccgccaggcggcgtcagggctccgggggcgcgcggccagcccgccctgcgtctccttcctcctccttcccgggctggggcccaggcgagcgagacgggccggagccgcgggcccccgcgccgttcccaggccgcgcagacattaactcattcctgcctagggggaaagaggcggccgggcgggcgcgcgctggagtcggcctgcctccacctccctctccgggaggcccggctgccaagcggagtccgggggcggctggcaggcggccccgtatgaagtggggcgtgtggtcccgagcccccctccgctccccttccctccaggctcttcggatccgggcgtcagagagggcggggagcccgcgcgggacccggagcgccgcggccgcagccgcagctccccccggggcctcctccgggccgagggcggcgttcgcaggccggatcttatcgctggcgcccgaggtgggcggccgctccccggaacacctgaggcccgggagggggcgggcggcggcggcgcggagaccctgcgcgcgggccggggacggtcacgttggcccgcgggccgggcggcggccaggcgcttgcggagagccgggcccggcccggcgtgagtcagaaatcaccttgtttaattacatatccccgagcccgccgagtgcgataggggacttttgaacttgccaattagagatgaaatatcaccttctaatttagactggcttaattccgtcacgcaaaaatagcaacagccccggggctgcgagatgggatatcaggtctctcctggcgtgacggcgagccaggctgaaggatgcagaagctgagggctgcgaagcgccactgcctgctcgccccccgacggagtcggggttgcgacgggggaacggagctgccgggccgggccaccgaggccggggaggttccttctctgggtgggttagccccaagcaaggaagccgtcaaatcggggtccagattctagcctgcctctgtgagacctctgtgttgtgggggctggaaaagaaaaggaggtggatccgggagtctgtaaggccttccgatggagggaagcgactgccaggcagggggaatagggttagtattgctggagggaggcaggaaaggtgggccagggccctgtttacttgaaagggggcgtactaaagcctgttttgctgcttggggagtttctaagcgggcatctgctgttgagtctggcagcctgagctcgtttcggctaagcagttcaccagctggatgacttggaggcagccatttaagctctccaagtctcagttcctcatctgtaaaatggacttgcaaatattatctgcctccttggattgcagcgagtaataaggcacgtaaagggcctggcatgtggaagcagtcattttggtgaaggcagcaccacgcaatagaaatttcctattagccacatttttaaaaaataaaagaaagcaagttaaattcattttaatatattttctttgactacatatatttaagatatcaggccggacgcagtggctcacgccagtaatcccagcactttgggaggccgaggcgggcggatcataaggtcagaagatcgagaccaccagggtaacacggtgaaaccccgtctctactaaaaaagtacaaaaaattagccgggcgtggtggcgggcgcctgtagtcccagctactcgggaggctatggcaggagaatcacttgaacccaggaggcagaggtggctgtgaagccgagattgcgccactgcactccaacttgggcgacagagcaaggctccgtctcaaaaatatatatatatatatataatttcaacatataatcaatataaaataattattaatgtgccttcaaaatctggtgtgtgttttacactaacggcacttcttggtcggactagccacatttcagctgctcatcggccacgtagcactatgtattggacaccgcaggattagggcttctggtcttaatctttttattttttgagatggagtttctcttttgttgcccaggctggagtacaatggcacgacttcgactcactgcaacctccacctcccgggttcaagagattctcctgccttagcctcccgagtagctgggtttacaaggcgcccaccaccatgcccggctactagaagttttagtagagacggggtttcaccatgttggccaggctgatctcgaactcctaacctcaagtgatccaccggcctcagtcttccaaagtgctgggattacaggcgtgagccaccgcgcccagccaatcttaatcttttttagcagagaattgcacttcacaaagaaaggaaagaaaatgttgcacagaacccccttatatataacagagggatgaagctgctctgaagttgtgctagatcacctctccctgctctctgtccctggtggtgttcctggaatcacttcttcccccagcattttgatattctctgcaaagttgttagggagggtgacaatacctcaaatttgggctgtacacatttacaaaatccattcactatgtcaccccagcaggtccccagcatgccctgtggggcaggcagggtgtcaggcattccaccaccactgaatagacctcagtctcaggttatctgacttcaggatgttccatttcccttccctcctctcccccaaccctaggcgctaccagtctaactgggctgggcttccctaggtgagcagcaggccatgagacaggctgacagtacatctgaccctgacacccaggttgcccccatccttgccatcctcactcacatttagtgacacactatgccaggtactaggctacgctctttatatttcttaccttcccttaatcctcataataaccttgtgagatactaagaatcagtattgccagttttagatgaagaaattgaggcccagagaggttaaggaacttgcccaaggacacaaaaccaggaggtagtagagctggatcctgcagccagggctcttggctatgctatcaagactccacagcagggggtctccttcatgttgaaaatgactcctccctgacatgttgcactgagattttctagaaattggactcatattctttacagaggcagcttgggatgatagaatgaatggatttggagatgtattcccacttactagctctgtctgagcctcagtgacctcaagtgtaaagagggaataatgtgaagaccgattcagatgacagatgctatgtgcctcgttacccctaaaggggaggaagattccttatggagaaggtattatcttttttttttttttttttttgagatggagtcttgctctgttgcccaggctggagtgcagtggtacgatctcgggtcactgcaagctccgcctcctgggttcacgccattctcctgcctcagcctcctgagtagctgggactacaggcacccgccaccacacccagctaattttttgtatttttttagtagagatggggtttcaccacattagccaggatggtctcgatctcctgacctcatgatctgcccacctcagcctcccaaagtgctgggattacaggcgtgagccaccatgcccaaccggtattatcttttgaaggcctcactggcaggatggctccagggcagggctgtggagggttttatctcttcttccttcaacaacatggatggatcctatctacctggtccctactcacccccagcacagggatttccagctcacccagctctgaagggtgggtcacctgggagtggaaggtgcagagtgggagccacaggctgccccaggcggtccaggggaaccaggtgggaaagagagactggagatggggccagggtcttaggccctaaggaaaaccttcctctccaggttgaggctggagtatggggtggggggcagaggcggggtgtgggtgcagggactgcctcaatgcagtccatcctgcccatactgagctcaggaatggggagggaggctgtgctgacatgcttcctagggttgggggaatgaggcctctttgctgaggagcagactgaaatgtggtgaggcttctggaacctcactcactggaagaggaagccagctggaccttgcctgcagggtgcagctgggtctgccctggctaggtgttgagggcccaggcgggagagggctgtgggtaagcagtggcaatgctttttctgtgctgtgagcccaaaacgtttttctgctctcagggagctggaggagggggtgatagaagtgaggtggtgcattctcttccctgtgctctgactgcctgggcaatctttagacagtcactcagacacactctcagcttccaccaaagcgatgtgggagtacaggggtcccccaaggcagccacgggccaagtgagcagctacttctaggctgtgtcaccctagagtctctgcccagcaccctctgaatgactccttcaagatcccccaccctaatcaaaccaagacggaattgccccccaatacaaatcaagccaagctgtttttcaagaaagtaattgtagctaaacctgaaacctgaacctgaaaacccagctaccaggtcacctgttttgtcctgagggctgacctaggtccaggttcagcaaacttatgccaagggaggtatttcagatgtcaaatcactggtcagagtgcaactgaaagcatcttgcagtcaaaggcgaggtgacccactcccacctctccccgcccaggtacccccacccccactctgcgtcttatgcaggccttgggcagtcaaggcctggcggagccccaccctgcacagctgcaaatatttatagccatgtcccttttccagccctgtcgagggttctgctgtgcttgctccctagctctgtgaacaccctgctgagaattcaaatctgggccatcaagaagttcaggaacaagtctcccaaaaaaactgaaattgtactgctctaatgttaaagtcaccttttgcatttctctggctaggagtgaggggaactgggaagaatgaattcctgacacacctttctttgggttttttttggcttttgcagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggtatggtccagctgtgcccctgcactggggcactggaagggcgtgtgtgtggggtgcttgcccacagtctgagccctggttgggagagatgggggtaggaggcaggtgtagggagaaagcctcgggtccttctggcttgccatctggtcttacctctctgagccttagctgccatacctgtgtgacacccactctcccagggagctgggaggaatggcatgaggtatgtgggtgaagctccagcaggatgcctggtgccaggaactcccccttgggctaaggttgaggtctgggaatcaccaggcttgtcagtaggtttacagggcattttgttagacagtgttggttttgacccagttttcctttagggttgtttctgggtctttccacagacaggcctgggctgctcagggggttggtgggcatctgccagactaaaatgaaaacaagtgatttcatacttagaagccatggaccatgggtgctgttgtttgaatacagtatgtttgtgtgcatgtgtggtgtgagcttatatacgtgaaaaatacacttttatttaaaactaaagtaatacatactcattagtgaagaattggaaaacacagaaaagtaaaaattagaatataaaaaaatgtcttcatagtcccactgttctgactgctaacctggaactagacaatacaagtttgtatcctggtctaccacttactagccctatggccttaaacaagttgttcaaactctgtgtgcctcaattcccctatctaaaaatgggtattataatagtacctagtgcgtaggattgttgtgagaattaagcaagttaataaatgcaaaagtcttcttgaatagagcctgacacagagtaatcacttaataaatgttagccatcagcatcatcattattgcatttcttactatcattatcagtggtcaactgaattctataatatgtttacccagtcccctattggtagatgtttgagttgcttcctgattttctttattgtaagtgatgcaacaatgaacacctttctgcatggagctttctctgaatttcacattacttcatcagaacagtcacaaaagtcagagttattgggtaaaagtataaacagtgttggggttcttcaaatatctaattccaagttctgggagctgccttactgggtgccattctgtgcttccccaggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggtaagtgggaggcctccatttcctctgacccatgtctcttccccagcccttccccaagatcgtgggatcccattaggaagccaagaagttgctggtaacagagaaagcaactccatttttatcctaaaagggaattggtttgccaccaataaacttggggataaatgaacttgatgcaagagatgattgtgtgcctgttccacacagcttgaagtggtggtggaacttctgcaaagcaagtggttgcttcacagcctgaccttaccactcaccagaatgtggccttaaccctcaatgcccctttggtaaatgacagtaataagcagtacctcctcccaggtttaatgggaggattaagcctcacagtttatgtaagaaagcacagaacctggcacccagctggagagtgacaaccccttctctgacacccctgggtctttcttcagagtgaccaaggcctgcatcctgagatctcctgccctgttccctggtaggatgctcgggcagtggctggagcctggtggggtagtcaagcccgctccctctctcctttctgtcctgagcttaggctctttcccccaggaagtaatgcatgccttgagacagacatggcacaccacctgcttcgtctgtgcggcctgcaagaagccttttgggaacagcctcttccacatggaagacggggagccctactgcgagaaaggtaggaacacttcgatggcatgtggggaggccccacagcctgggagaaaggggcaggcacagggaactaactcctgcctaatccattcacatccgaccacccagaggcctttatttctggaagaaacctttgtttttgcttttaatggcagaatcatgctaatatcacacaaaggaagttaactatctcccctgcccatatggttgcagctttggggagagtgaggtgcagagtctatagcttattttatgcatcaaatatgtggatctggttaggtgaggtggctcacaccttaatcccagcactttgggaggccgagacagaagaattgcttgagcccaggagtttgacaccagcaacatagcaagacccagtctctacaaaaaatataaacattagccaggtgtggtggcgcgtgcctgtagtctcagctacgcaggaggctgaagtgggagggtcgcttgagtccaggagttcgaggctgcagtaacctgtgatagcaccactgtattcagcctaggcaacagagtaagatcctgtatctcaaaaaaaaaaaaaaatgtagatcacaagttggcatcttatgaccactgggaaacctttcaggttattttgatttggagaccacaaggtctagtctgaaaaggccttggctgtggactttgtccttcattctattcctggttccactttgggctgctttgtaaacctgagcaagttactaaccttctctgagccttactttcctcgtctgtaaacacctgccttacagagctgtggtgaggattaaaccagagaaggcgtgtagagcatcaaatatgcgagaccccttcctctgcccctgtgatatttatcagactttgatgttcctgcagattcctgtaatctcacggagtgaattcagagtttctctgtacccccaaaatgctatatgttatcttaaaatgctaagtaaattattgtaaattcaagagacaaagcacttcattagataggtggaagtcagtcactcatttattcagaggcttcccccttcagaaaggatttgaagcaggttccagaaaaggtaacacagacatgaaggctaagacagtagaaccagaaaatcagaggcgggaaaagcaggcatgctgattatgaagaataacagagctgcagggactaactgggtagcaaatttgagggcaaaaagagaaacacagtaagttagtttactttaaaatcagaaaggagaaaacattcagttcctcaagggaaaaagcaaaacaaaataaaacttctttcccctgactgtaaattagaaaataaacgttttggctgggcgcggtggctcacgcctgtaatcccagcactttgagaggccaaggcaggcgaatcacctgaggtcaggagttcaagaccagcctggccaaaatggtgaaaccccatctctacaaaaatacgaaaattagccgagcatgatggcgggcgtctgtaatcccagctactcgggaggctgaggttgaagaatcgcttgaacccgggaggcagaggttgcagtgagctgagatactgccgttgcactccagcctgggcaacacagtaagactccatctgaaaaaaaaaagaaagaaagaaaagaaacgtcttgggttcttgtactagtgaatgcccttcccagctctgaagttaactgaatgacctgaaacaagtcacttactctgtgcctcagtttctatatctgtaaaagggagaagataataccagacctttcctttctcatgagcatatgatattgatcggtagttaaagaaagagctgttatgcttatacaacttgctgttattcttctactaaaagcattataacttctattatttgagataagccgcaatttgtgtctgaggcttttgaaagaatgatagatttccattatcactgctgcccctcatcatagcaactcccccgaaaagattctcaaaaatgatgttttgagtaagaagatccaggaagaagacggtctagtgttaagagaagacagtgaggaagcagatttaccttcagacctaggtaactggagagacccagttgatcctcccacctcagcctgtagatggaactttagacatccgctaccatgcctagctaattttcatcattttttgtagagatgaggtcttgctatgttgcccaggctggtcttgaaatccagggctcaagcaatcctcctgccttggcctcctgaagtgctgggattacaggcatgagccaccgtgcctatttttgattctgttctatttttgattttgtaaggaacctcatactgttttccataacggctgcactgtgttacaaacccattaacagagaataaaggttccaatttctccgcagccttgcaaacacttgttattttctgttttttaaaaaatagtagctatcctaacgggtatgaggtgaaacttcatttttacgtctcgtcattttaatcaacaatttggaagaagacacagaagggagtcctgtcaaatctgcagattgagccagaatgatagggtctaggctgaaaaatgcttcagctggctgcaaagataagctgacatctgcatataaagaagagagataggtgggtcagcccttcacagatgaacctgcacccgagcagttcccaaacctggcatcatggtcacctagggaacttaacaaactagagagaaaatagattgtttcagacctacctcagacccacagaagcagcatttcgtagggtgccccaccctacccaggtgtttcagttaggtgtgggaatcagaagtgtttctcaaagtgtggtcccaacaccagcagcaacatcacctgagaacttgttagaaatgcagatcttcaggccccaccccagatctggtgaatcagaaactctggaggggagcctggcacgctgtgtttcaacaaaccctccatgtgcttctgatgtttgggaaccattgctctagaaaagtaccaagccccttttcaacacagagcacctgcaatttgatggacagaaatccttttacaatagcaataaaatccattaaatgtgagggtagtaattcagcttgggacaagagagagtcaaagaaaattagaaagacttaaagggagaaataaaggaaggaataaatatatgaggagctagattatactccttgtggaaaaggcccatgcacagactttgttcggtaccagcaatgttctccttttgcagaaataacttttgcagaagttgtgaagaaaaataccaacttaaacaaaaatgtgttagtatcagacccatgctaccaaattttaaaacaaagcgataattctccaaatcatatggaatcaaatttaaaacagaaaaatgaatcagtgggcaagacaaggcattccagaggtaaattcaagcctttgttttgttttgttttgtttttgagacggagtctcgctctgttgcccaggctggagtgcagtggcgcgatcttggctcactgcaagctccgcctctggggttcatgcaattctcctgcctcagcctcccaagtagctgggactacaggctcccaccactgcacccagctaattttttgtatttttggtagagacagggtttcaccatgttagccaggatggtctcgatctcctgatctcgtgatccgcccaccttggcctcccaaagtgctgggattacaggcgtgagccaccgtgcctggccttttttttttttttttttttttttgagacagagtcttgctctgtcacccaggctggagtacagtggcatgctatcttgactcactgcaacctccgccttctgggttcaagcaattctctgtctcagcctcccaagtagctgggattacaggctcccaccaacacgcctggctaatttttatattattagtagagatgggggatttcaccatcttggccaggctggtcttgaactcctgacctcgtgatctacctgcctcgacctcccaaagtgctgggattacaggcgtgagccaccgcacctggccaattcaagccactttaatagcttaatctgtgaaaagccagtaagagaaggaatcactatttaattaggttgtttgaaccatttaatttaatttttatatttatttaaatatggaacacagcccagcttggtggctcacgcctgtaatcatagtactttaggaggccaaggcaggaggaccccttgagcccaggagttcaagaacagcttggacaatatagggagaccccatctctaaaacaaaaaaaaattaaagtagccgaccgtggtggtgcacacctgtggtcccagctgctcaggagcctgaggtgggaggatggtttgagcccaggaagttgaggttgcagtgaactgtgaccacatcattgcactccatcctgtgtgacagagcaagactcaatctaaaaaaaaaaaaaaaaaaaaaaaaaaggagatgatggatgaatggataggatgcatggataaatggaggagggaaggccagggaaagccttcagcaaggccatctcatcactcttggttggggtatgtagggcatgaagacttccctgaaggacagcctagcacaaaggattgcagagattctctcaggtacagaaagtggggatggtttttcaagcccagggcctggtttgcacagaggcatggaggtgtaagagaaagtccagggcaccatgagaccacctgggagtgatgagaaagaagtcgtaagtgggtgcagggcttgtcctcaggtggagacgggtcagcccataccagatagtagtaagttcttgcagagcacagagtgaactgcaacctgggcggtaactttctaaaggaagcagaacgatgttttcttagctctggcaaggcaatgcatttctgcctactaaagaaattaagtgttccatcagagaagattgatggactgggatacataagagcatttgcatgacaagctacaattaagcacaaaaggggaagctatatattggaaaacacatgcaagagataagtgtaactgatcaaagctcaatgccatgctgataaggagctggagacagcgtaaagccatagaaggaggatgaacattggagtccatcaggactggggctactccttatgacttctgtgatggaacctctccagtcagtttcctcccctttaaaattggaatactaggctgggcgcggtggctcatgcctgtaatcccagcactttgggaggccgaggcaggtggatcacttgaggtcaggagttcaagaccagcctggccaaaatggtgaaaccccgtctctactgaaaatacaaaaattagccaggcgtggtggcacatgcctgcaatcccagctacttgggaggctgaggtgggagaactgcttgaaccctgggaggcagaggttgcagtgagctgagattgtgccactgcactccacctgggtgacagagtgagagtccacctcaaaaaataaataggctgggcgcggtggctcacgcctgtaatcccagaactttgggaggcagaggcaggtggatcacagggtcaagagatcgagaccatcctggccaacatggtgaagccccatctctactaaaaataaaaaaatatagctgggtgtggtggcgcgtgcctgccctcccagctacttgggaggctgaggcaggagaattgcttgaacccaggaggcggaggttgcagtgagccgacatcatgccactgcactccatcctggtgacagagtgagactccgtcgcaaaaaaaaataaaaataaaaaataaataaataaataaataaaataaatagataaataaatagggaatattatctcttcacagagatgtcatgaggattaaacaggaggcataatggcactcaaatcattgttcctttccctctttgcatcagttatgaagactttcaaaataagagccaacatttttgagtgtttgtgccaaatacttcacttacattatcttatttaatccactcaaaaccccatgagttcggtacaataattattcccattatatagatgagaaggttgaggccttgagaagttacgccacttgccccaggtttgaacatttcttaatagagttgggatttgaacccagctcttcctttattcagagtccaattttgtaacccccatggcacactggcactcagtaagacgtggtctaagacaatgaatggacatactatccacaagaagaacaggaaatcacttaagaaaaagccaactgtggaagagttatggaggaatgcgtacacttctcaggagggatgaaggctttgtaaacgggatggagcttttctagaataatctagagatgttctacagtcagtgtggtagaactgtagcccctttgggcctagagaggacagctgccctggtgaaggagcacagaacctgacccactgtgcttcagctgtgggatgctggctgggcccttcacctctttgagtctcaattttctcatccacaaaacaaaacaaaaagataataatagttcaatttctgagggattttgtgatgatcagtttcattcattgatgaactgattgattggttaatgcattcattccctatatatgttttggatattgactgtgtgtcaggcattgtgctgggagtgcaaagaaagctaagatgtagtccctgacattgacatacttgtaaataacaccatccatgtgaaaatgcttggtaaattgcaaagcatcatatcaataatatttaatagcattatctccttggttgggggtagggaaggaggaggaggacatgccccaataaagtagttcaaatactgtttatagtagtaaaaacttgttgtcaacacaaatgccccatgacagaagaatggccaagcaaagaaaattctataactcttaaatacgttggacccacattcttccaaactaagcatagatgtttggaaatgtggattgttttctctttggggcttgatccgtttggtctattagaggtgacagaagcagaggagacaatctccctgcagaaggttgatgacaattccagaaagtgtttgcaaatcaaaccagcacaagatggtgtctaagcctgggtctgaacaacatcaatgcaatgattggaaaatggaaaactatcagtcatgtaactgagtatttcatctgtgagatgacaaacaaccaattagatttcaccccctgcttctgcccactgatttggggtttgtcttggctttgggtccccgctgcccccactgggtgcggggtcttcactctgcttttcatttcagactacatcaatctgttcagcaccaagtgccatggctgcgatttccccgtggaggctggcgacaagtttatcgaagccctgggccacacttggcacgacacctgcttcatttgcgcagtatgtctctagcttggggctctggctttctgagaagaggcaggagggaggaagtgggagccagatgaccaacctctacataccttgccacgctagctttctgacatcctgatcatttttaaaagctggcaaacaccatgatgcctcgatacatcacagtcgaacaaagtttcattcctaataattatttataaaccaatgtggctttgttactttccatttcgttaaggacaacagagtgtcccagggtttggcaaaccagcggcttgtctcaccagcagtgttgtcagcgggcaaaagcagcagatgatgcttggctttgagaggggcagttggcttcccatggttatatgtcacttcagatatgatggagtgacttgaaggttttcccctccaaattgttaccccaaacactagattggagctgactaatcctatgaaaagctgagatagggtttctcttggtagcacctttggaaagcaagactgagtaccattttattttcctaagtggtcctttcctgatatatagctgccaggagataagccctggattaactattaactgtgtgctacttatttctgctgaacagccgggtcacttttagtatgagactggcattttccttctgagggttttgggttggggtgggcacatgatggtgagcctacagacatttagactctgaaggagaggtaggaaacagtcatccctgagaaagccccctaatgtcaatctgtcattgcctaatctcgatttgagaatttttttttttttttttttgagatagagtttctgctcttgttgcccaggctggagtacagtggcatgatctcggttcattgcaacctctgcctcctgggttcaagcgattcttctgctttagcctcctgagtagctgggactacaggcacatgccaccatgcctggctaattttgtgtatttttagtagagaggggatttcaccatgttggccagactggtctcaaactcctgacctcaggtgattcacccaccttggcctccccaagttgtgggaatacaggcgtgagccaccacgcctggctgatttgggaaaattaagacacctctactattttttttttaaccagagtgtctcaaggtaaattttggaaatgtatgaaatatctgtacagtttttacttgaataatttttatagacttctgacataggatgaccctagtcataaagtttacggccatatacttttggttccacacttcgcttccataccccgccatctgtgggacacactgtattcactctgtgtgtcggtttgctagggctgtcttgacaaattactgcaaactgatggctcaaacaacagaaatgaatgctttcacagttcaggaggccagaagtcctaaatcaaggtgctgacaggaggccatagtctctctccgagctactagcggttgctagcaatccttggcatttcttggcttgcagctgtgtaactccaatccctgcctccattgtcacaagcctgtctcccctctgtgtgtgtcttcacatgacattctcctctgagtgtgtctgtctctgtgtgggtctcctttttttttttattttttttttgagatggagtttccctcttgttgcccaggctggggtgcaatggcgtgatcacagctcacggcaaactctgccttcttgcacgtgaattttgtggaatacaattcaaccccttaacactctgattttctagctctttgaacagattctctagttgtcttttagggtgttttaaatacatcccctccaaaaagagacaatggtgtaagtatactggctttgggtttgtcccctgcagagtcatagctcccctgtgtcaggcacagcacaggggtctctgaaccttacattcaagccatggcttgtctagtcctgaggcactgcctgcacatctggttacccaacttctggaaggatccaagagacttggggaaggtccaggaagacagtggcacagaaggcctgttttccatgggcaggctgatgagaggtctgtgtcacatgcagagggaatcgtggcaaaggtgagtgtgggtctgcttctgcaagcctcgcaatttcagctgagtcacaacagcaaaagtccaagagagagaccagaagaaggcgtaaagcttggggtggctaaggctgatattacaaataagttccagagagtgaagtccagcctgtgagaggcccatagcactgccctttagaggatcaacatggagatcgttaggtctccctccaaaccagcctgcatgatactcactgctctgtcaacatatagcaaagtggaacatggttcttttgtttttttttttttttgagacaaagtcttgctctgtcgccaggctggagtgcagtggtgcgatcttggctcactgcaacctccacctcccaggttcaagcaattctctgcctcaggctcctgagtagctgggattataggcgcctgccaccacacctggctaatttttgtatttttagtagagacggggtttcaccatcttggccaggctggtcttgaactcctgacctcatgagccacccacctcggcctcccaaagtgctgggattacaggtgtgagccaccacacccagccggaacatggtcttaacattaggaagaaatcttttgattggaaaactttgagggacttgagggatttttttttttttggtcctctttctatcacttcatatttccaaatcacttttgatgagcatgtattttcctgtaacttccaaaaaattagtaagagaaagatctggggtagctctcccagctgatgtgctgttttctaaccagtgagatctcaggatagcacattctttagactaactcagtttaccaaatattcctggcatttgggcagtacaagagtgttccagaacaagtctctaccctgacggaatctagaatcttgaaaggtgaacaaagcaacagatgtgagcaattcaaaagtagaacaggacagtatccctcaagtccaaagcatataaagtgaaggctgggagcctgagaagtgcactgtgggtcagggtgaaagttaagcttctgtctggcgtcgacacttgagttccaatggaaagggtccgaccttagtggaggaaaaatgtcttacccatccctcttttgctctaagtcttgcccttccccactggtgtgggtatcaggaggggatgggcagtaatataacttttgtaggcagacctaggggctgctgcagctggcctagtttattaccctaactctgctgggacttgcagtcagcactgtccatggtcgctacccttttatagccaggccctgatgtcacccagccacagagcctgggggttggaccatccctgttgccccctgtgctgggtgggcagaaggcctcctccactatgaagccaccttgcaccaagaagacactgggcacaactccttatgagggttcccaccctcagccccatctcacctatgagccatctttgaggttctgtccctttctcatttgttggtcttcagtccctggacaccttctctccccagcctgactcatcccaaagttctcacaagcaaccagcattgtcccagtccaggtatggtctcccacccacagctgcagtcattgacaggctgactcattccagagatgcctttctgtcttccctaaagcccattctcaccagttagatcttggatgtccatctttttgcatagtctttaaattgtcaccagcagcttgaggcctccacacgagcctggttatactcagcatcactgcatccacctgggatgttttcaaacacttttgcagctcattggctcccagaacccaattggaagccctgtgtgatcctaggtataacgtccccaactggaccatcagagccttgcacatggggctagcgtggtgcccttttcctctccaactctcttggactgaatacatgcatattgccccaagctcaactcaagggggtgatttctctgtctccatgggggatacctgtatgtggggactccacgtgcactcctcttgatgtcagtgtcctggagatggctcccaattctgccccccagcagggatcttcactgccctctcctaagctgggacccatgccagccaatgtgatttcctggcagactctgacctactggcatattgccaacccagggcccagcttacatactagtagtccagcaaactcagagggctacatctgtacaaacccatgaacccagatcaatttcaagtaaacacagtccctttcttctatggggtaggggaaaaattagcatagaactggagtcttacagacatggacagagattcccagcctacaacttactaggtctgtgacttaaggaagacgtatgggccctctgagccccagttttttcagctgtgaagtgggagaaaggcttacctaccttataaggttttcatgagaattaaatgagctgctgtatatagagtgtctggcatcctgcttggtccatggtagtccccacaaatattaattagttctcttctttctgggatgcctccagcctcagactatatgttgtcatcatggggatatagaatttcatctcttgggctgggcgtggtggctcacgcctgtaatcccagcactttgggaggccaaagcaggtggattgcttggggtcaggagtttgaaaccagcctggccaacatggtgaaaccctgtctctactaaactacaaaaaaaattagctgagtatggtggtgggcgcctgtaatcccagctactagggaggctgaggcaggagaattgcttgaacccgggaggcagaggttgcagtgagctgagatcgcgccactgcactccagcctgggtgacagagtgagactccatctcaaaaaaaaaaaaaagaatttcatctcttttgtttttttgtatatttctctgcatacttttccatatctacctttttttttttttttttgagacggaatctcgctctgtcgcccaggcttgggtacagtggcatgatctcagctcactgaaacctccgtcttccgggttcaagtgattctcctgcctcagcctcctgagtagctgggattaccagtgcgcaccaccacacccggctaatttttgtatttttagtagagacaaggtttcaccatgttggtcaggctgatctcaaactcctgatctcgtggtcctcctgcctcggccttccaaaatgctgggattgcaggcgtgagccaccatgcctggcccatctctctttttaaatggtggcattccattggaaaaatacaccatgaaaatttactgaatcatcttcctattgagagaaattttactagttttcagtttctagttgagcacaggttgttttgttgttctgcagagttgcttctgcaggataaaattctctagcgtggcattactgggttacagggtagtcacatctcaatggttcttgttcaacatggccagattccctatggaacactgagctcactcacatgtctctagcagtgcacgagtaggccttgttcctttttggcattgctgatttttgattgaatactttttttttttttaagctttttggctacaggcatattaggttaaaggtgacaggccattgaggtttttttgttttatttgtcttgctagattaatatgtgtctagtggtatctcagggcagtttttcttgtaatttttttaactaattttcttttctttctttctttttctttttttttttttttggtagagacagaggctcactatgttgcccaggctggtctcaaacacctggcctcaaacgatcctcctgccttggccttccaaagtgtagggattacaggcatcagctactgcgcctggagtcaggggagttttaatttgctttttctttaattattagtgagtacaatcttctctgatgtgtttgttagtttactaatgattttctttagacgtgaatcctctctgtggtatattgacttgtgaacttgtattgactctattcatgctattttagatagcatgaattggtcagcttcatagtgtatattttctctattccattaaatttaattaatttcatttgattttattctgttcttcaggaatcttagtttttatatagtccaactcatgtactctgcttccgtcattaagaattcatagtgggagaaataggctgttgccttttctctagaatgcatggggcaaggctgtttgtttgtttgtttgtttgctttagacagtcttgctatgttgcccaggctggagtgcagtggcacaatcacagctcactgcaacctctgtctcccgggttcaagagattcttctgcctcaacctcccgagtagctgggattacaggcacatggcaacatgcccctggctaatttttgtatttttagtagagatggagtttcgccatgttggccaggctggtcttggactcctgacctcaagtgatctgcctgccttggccttccaaagtgctgggattacaggactgagccaccacgcctggccagggcgttttcttaaaaaagtgattgaaatctgctcatgccctgtgccacgtgggtctcacgcaggtctgttctctgctccaggtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 37890 - DNA, 21088 bp, Homo sapiens
atgaccccaatttcacaagtaaggatgaggaaaggttctgcccacaccgccgcccagcctggcagactaggattgcatcctgcgggtgccactgcgcatgcctgccggggaatgacgtcaatccgagctcgtcccggcctcaccagcgccatgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggtgagtgcgggcgggcgggcagcccgggaatttgcaagtagcagcctccgagtcggctccgcggagctgtccgcggcggccggccggggcgtgatggaaatgagaacctgaaagcttgggcttggctgccgggtgccgtgcgccctggggcgaatcacctcgggacactttgaaatgagagcctgaaagcttgagcttggctgccggctgccgtgcgccctggggcgagtcacctcaggacacgcagtcgggacagtctcctaaaggacccgccagtttcacgtctgtctgcatcctgagcacctgaagcgggcaagataattctcattccacaaacacttgtttaaatggtgactcaagcggaaggttccgttctcgtggccctccttcatttattagaatgtttgatcctccccgcaatcttgtaaggcccacaaagacaatccttaagacagttaagacgctgaggaaactaaggctcctcgtcagagccagaccagaagaactctgtgttttgatgctgagtcggagctcttttacctgcatcacccataaggcaaagatttaattcatttgaacgcagcagggacagcgcttacggactgcctgtcagcttacaatcgcccccgacagaaagattttcctgaccttcctatcttaattaacacctaccaacctcactttctatcgctttatccgcaatttttcttaatagcactcaccactaactaaccttatgcgcttgttgattgattggcttctccagtagtgttaagtgaattaataagttcctactacgttgtccggccatagagatagaaaaagctatggaaaccctttgctttcaaggaactctggtctagttgaaaaagactatttggtgagctaggaaaatatggatcaaatatgagtgatacaaaagcaagtgctacaggaaaaagagaaattactgtggatcccttgctggaaagtttcgagaagaaattatactccaaaggacaagttgattttgcagaggagggaagagatcttagtgcgggaagtacttttgcaaagacccaagggtggagtgttagaacactaagaatacgagcctgacctggaacaccaagtgggtgtggaaaatgggaaacgagactagacaagaacatatctgaagaagctggatagcgtggaggaagaagtgaaggatgaactccagccaatctagatgatgacatttgccattgcagtgtatggagatgtagtcaaaggcctaggtacatttactccacttttgcccgtacaagacccgaattaggccttgcttttggtattctagatttatgcacgacctatttgggattagagcactaagttataacaatcagctatcaaagcataaaagcctactgaatgataggtacagccctgccatcattgggaagctgtgtatgacccccatgagttttggggccacattcacgttgagaggcatgcatttccaagcccagttccaatctgaagcctggctgtaattctgttcttggagtctgtggcatggagtggcagtgtagccttatagatgaacatctgccattattcccatttccccagttaaacctctggcttctatcttagtggctggaccttccgccatgtaacagaaggcaacaaaggggttatgagcaaaactttggagccaaacctcttggatgtgaacctccaccctgctcatctgagggaccttggataaattacttcacctctctgggcatccgtttttcatctgtaaaatgaagatactattaatgataatatggacgttatgaggtcacgaaaattcattaatatatgttaagtgcttagaacagtgcctgtcataatatgtgctgaagaaatagccattattatcttagaagtggggaatggagaaaattgtacttacagattgtgtatgtttggaagataccagcctgcatggtttggttctaaataaggtgatcattacaggatttttcagaaaactaaatagtactatgttagaattcgctcaacaaatgtattttgaacccctaccatatgccagaaacaataattgacaggagtagaattccaggtttgataattctttatttaaattcttattttgtgggataattatgtgttcgttgttttactttgttgaagttatatcttgttaccttcattgatcaatagtaggttttcgttgtttttgagaaggcaatacagcttctttcaaatgggctaaactaccttattccagaaagtgtcagcaggtggcactctttccaccaaattggaagtgtaattttttgttttaccacgtttatgggtgattatgttgtcttgaagatcatctgtttttgatctgtccatcacccctcagaacttgctcattttatttcatctcccatagagtttttcccttttctacaaaaacatttctttttgcaatctacttgtctcttgtctttgctacctctgcgtctttcttcacagaaaagtatggggaatgaaagtgtcatatggaagacaaaaaaaaaaaaacattgctaggaatcagtagggacaaaagaacaggtgaaactgaagtgtatggagagatttagggagtacagagtgacagcattggacttaggacacagactgcagccagactgtctgggttggaataccaccttagcctttttttacctgtgtggtcttgggcacaattactccctctctgcgtcagtttctgtatttgtaaaatggttgtaataaaaatagtgcctatcgaataggcttgttgtgagagtcaaaagtgttctgtgaaaccacctggtacagtaagtgccatgtatctgttattacggttgtcataacatcattaatattgtcatctcttaacgactctgtgaggtagctgttctcttccctcatttacagatgaaacaaagacttaagccttaagatactttactgtctagtgtcactcaacttacaagtggcagacatagaactgagaagtcttcttactttccccttcactgtaggaacccttgtcatctgtaggggagctctacagattcctatcagtaagtgaatacggtacttttaatacagatttttggccaaggaagttttgttcctgacagaaaacactataagtggttacacgtctttctgtctagaatttttttctttttagtggaaccttctgttctaattgtaccaggaaataatagctgtgaagtggtattctctcttctctagcctaggaggataggatcagctactcctctgtcccttgtgaactatactcatagctccagggtaaagaaagtagttaaacctactgtgttttacttaaaccactctgtttatctgtttcctcatctgtaagatagggttattaacagtacctactatgtaaagatgttacttgggaggctgaggtggaagtattgcttgagcctggaagtcagaagctgtagtgaactatgaccttgttactgcactccagcctcggcaagagagcgagaccctgtctctaatgtaaatatataaataaataagtttaatataaagatgtcattgaagattaaataagtttagacatataaagcatttagaacactgcctgatgctttgtgagcactccgtaaatattagccattgttactgtggagtgcaccaagtatgagtctgtccaggacaacctgaattcaggtctggactgaccatttctcaaggttttagcttgaggcttctccttgacttctctgttgtgtaaatttagatcccctttggaaaagaccctctgattcctctctccctcctcctaaaactagctaactaacttagatagttttgttttatgcctttgcaggaccctgtgcttgtcctgttgttggattgatcttttattgttattgcttatttaactgtatttctttcttttgatttatgagctgcatgaaggcagaagccccctttctcttagccaccattgtattcccagttcttagcatagttctggcacagagtatatgcttcataaatatgtctaaatgaataaagcttaaacttagtgaagcttaaacatgattacagggactttagtcatttgaccatttttcttcaggatctgaactttctttagccccaaatcccttttctcttgtatccctctatagggaaagaaagctcagaatttatctaataggcagcatatccaaacatcagttgaaagactttcttttagaagtagaatattaaagttcatatttgaagtcttttatataatctatttgcttttatcttaatttcctctagtttattggttaagtactaagaactaaccccatttgtacatgtagctgcaaagtactcagttcaaaataacaaaaaaactaacacttaaaatcccagcactttgggaggccaaggtgggacgattacttgaggccaagagtttgcaactagcctgggcaacataattccctgggcatggtggcttgcacctgtagttccagctactggggaggcggaggcaggaggatcacttgagctcaggagtttgaagccacagtgagctacgattatgccattgtacgccagcttgggtgacagagtgagatgctgtctcaaaaaaaaaaaaaaaaaagactagaccgtctaagtgtattgtactaacaatggtaaaggaaattttgctaacttttttgagtaggtaatgtgtgtatatgatacaatattcagaaggtgccagggtatagagtgaaaggcaagtctcttactcctgtctcctgtccatgcagttcccctactcagaagcaaccattattatatgtttctagtgtgttcttcctgacagtctttgagcatattaacattgacgcatgaatgttttatatgtaggtacgtatatatatatatatttatatacacatataaacacacaataaacaatttttaagttgtccttcacaaaggtagggccattttgtaacctcattagaaatacataagagtattcaactccctagagtgtgttgtcagatgtagggttttgccagtgataggtgaaaatttttatctcaatttagttttcatatgtgtttctcaaagttgagtatcttttcatatgtataagagccatttgtatttctttttatgtgaatttttattatgttttgtcttttttaattggactgttgatctctttcttctaggcactctgcgtagtaaggggtcctttgtgatttgagttgcaaatttattttctcagttttgtcatttgtttttttgacttatagtgttctttatttctttggtatgtgatgtttaaacaaatgaaaacagttaactgacttaaatttgtaccttttttgtctttttatttttgcttaggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggtaatttcatcctgaaaaggaatagagaggctcttctcaattctgcagaataacatagtggtatcacttttgaatgccatataaagcaacaagatcattcagtgaccacagaaatccagcatggaaaatgccaggatcagttgaatagctggtattgcaaagtgcagagtacaatatttcctttctcaacacaagagtggccccaggggcaaggtgtgtactttattattataaagtgaattgagaatttggaagactgagggtgagggagttaaaggttaggagtgaaagtgaaaaatccatcctgaaccttcaagtgtccaaagatctgtcatcccttcctttaagatgtattttagagccctaactattcttacgtaaatcaagtgaatcaaggcagcacttgttagtgtttcctataattgtttcttttaaaaacataactttacccattttttctccttagaaaaataatacatgcttgttctgaaaaatgtagataatatagaattgcaaccaatgaaaagtgcaagttgtccttatctcctcctcttatctcctagagaaaacttcggttaagaacttgatgcattatttttcactggattttttttttgtacctgttctaatgcatgtgtataattatttccttgttcttcaacagacagttattttctcaaggaaaggggccatcttatttgcctttttatcttagcaactatgccataattagtacaagatcattaaatgcttgagtaaataatcaattgaaatttgattttaaaagaaacccacattgaattataaaaagtgaataatcttatataaagttaataatcgatcctagtttaccttttatgtagtctgaattttccttaagcaaggcagacctataataatttttagttaatagaatagtgttacgtgtgtgtgtgtgtgtgtgtgtgtgtgtgtgtgtgtgtgtgtgtgtgtgttttgagatggagtttcactcttgttgcccaggcctggagtgcagtggtgcgagctcagctcaccgcaacctccgcctcccaggttcaagcgattctcctgcctcagcctcctgagtagctggggtttcaggcatgcaccaccatgcccggttaattttgtatttttagtagagacagggtttctccacgttggtcaggctggtctcgaactcccgacttcaggtgatccacctgcctcggcctcccaaagtgctgggattacaggcatgagccaccgcgcctggccattaatctattttttaattcaaaaacatttattcagtacttgctatgtggaagaaccagtggcaggttctaggattgcatcgatgaaatacaacattcctgacattcagggtttagttattataaaacagtagaagtcttttgagaatagtgttcaccagagaacttgctgaagaccacttacctcaacctaagggagagggttagagataactttccaggccggggtgacctttgaactctgaaagaataggatggcaaaaaaagagtgggctagagggtgaaggtgtctctagacagagggaacagcaggtccagaggcacggctgtgagatgagtatgcgtttgatagcagcaactacatggtctgtgtgtggctggaggatatggggtgtagtagaagagtggcaggagctgtatggtaaagcatttctctgacacaactgggatgccttaatttgccaagacatgcacactgtcctttttttttctttaaaaatgtttttgtttttatggatttaggggtacagttacagtcaggttacatggatatagtgtgtagtggtgaagtctgggcttttagtgtacccatatgtagtatgacctaatgggcagtatttcatcctgcactcccctcccaccctcccaccttttggagtctccagtgtctattattccactctgtatgtctctgtgtacccattgtttaactcccacttataagtgagaacatgtggttttgactttctgtttctgagtaatttcactaagaataatagcctccagttccatccatgttgctgcaaatgatgtgattttattcttttttatggccttgtattccatggtgtatatataccacattttttaatctagtcatccattgatggacactttggttgattccacgactttgctattgtgaataatgctgtgataaatgtatgagtgcaggtgtctttttggcaaaatgatttcttttcctgtgggtagatacccactagtgggattgttgaattagtagttctgtttttagttcttgagaaatctccatgctgttttccatagagattgtactaatttacagccccaccaactgtgtataagtgttcccctttctccacatcctcaccaacatctgttttttgactttctaatagccattctgactggcgtagaagatggtatctcattgtggttttaatttgcatttctctgatgattagtgatatctgactaagtccccaaaaggaaacacaacagaaacaaaaatagacaaatcagacttaattgaactaaaaagcttctgcatagcaaaagaaataatcaacagagcaaacagaccacctgcagaatgggagaaaatatttacaaacaatgcgtccaacaaagggctaatgtctagaatctacaaggagctcaaacaacaagaaaaaaataaccccattaaaaagtaggcaacgcacatgaacagacatttttcaaaagaagacatacaagcaaccaacaaacatatgagatacacactttcttgatttggaggttcacacatcctggtcagttttattctgtacactctatatgtatatatatgaatatgtatatatatattatatataaaatatatattatatataatatatattttatatattatataaaaatatatattatatataatatatattctatataaaaatatatatgaatgaggcttctggcatgtatcacttcaagataattcttgaacatgttaatagtagttcttcactttaaaaaatttgtagcttagtataagccttccagaaaatgaaaaatagtcccataaattagtaacagtttatgaagcatgggtctgtttagataactgaacatttgagattaaatatttgaaggcaaactgcaaaattctgaattgctttatcttatttggtagacagactctcctctaaacgtttacatcccacactcttgactagagttaaaactaattacatagattttgacttctgcttccaggaagatggaatagatgtattttccctattctttccactaagtatgtctaaaacacctggagattatacataaaacaaacataagaggactgtggagaaaaggtggcagactggctagggacctcaggacccaaagaatttcctagattttgtttttcttcatatatcccagacttggaactgaagaagccagaaatctggaaatgtcattgggcacagataggaaaaaaataaaaaataattaaaaaaaaaaaagcctacttggcaggggccagtggaaaccaggttgggaacgtgagcttgtaaccccagctggtagcaattaggcagcatctcccacccccttcttttgccagagcagtgtcaaaaaaagtcaactgaaataaaaggtttaaataagattcatagtctcatgacataatacttaaatgtccagatttcagttaagaatcatttgtcataccaaaaactaggaaaatctcaacttgagtgaaaaaaagacaatcagcagatgaacaacactgagatagcagagatgttaggatttcttagaaagatttttaaagcagcaatcataaatatgcttcagtgagcaattacaaacattcttgaaacaaatgaaaaataccacctctcagccaagaaatagaaaatataaaggagaaccaaatggaaattttagaagtgaaagatataataattgtaataataattcagtggatgggcccaacagcagaatggaggggacagaggaaggaatcagtgaactggagatagaataatagaaatgacaccatctggaaaacagaaaatagactgaaaaattgaagacctttgaactataacaaatgatctaatatttgtttcatgagtcttggaaaaacaggagaaaggggttggggctgaaaaatgattgaagaaatattggctgtaaaagccccaaatttagcaaaagacataaacctacatatttaagaaggtgagcaacctccagacacgataaacacacagaatcctcaccttaatacattatagtcaaacttctgaaaactaaagaaaattttaaaatcttgaaagctgtgagaaatacgaaaagcacaacccataataggaaaaattgaatttgcacatcaacaaatttttatctgttaaggaccccgttaagaagattaaaagggctgggcaccgtggctcacgcttataatcctgccactttgggaagccaaggcaggtggatcacttgaggtcaggagttcgaaaccagcttggccaatatggtaaaaccttgtctttactaaaaatacaaaaaattagccaggggtggtggtggatgcctgtaatcccagctacttgggaggctgagacaggagaatcacttgaacccgggaggcagaggttgcagtgagctgagattgtgccacttcgtaaatattttaggctttctctgtggaaattgaacatgttatagctaaatagctgataaggaagttgctttgttttttatttatttatttatttgacacagggttgctgtgtcacccatgctggagagcttggtgcaatcatgactcactgcagcttcaacctcctaggctcaagcaatcctcctacctcagcctccccaatagctggggctacaggcacacatcaccatacctggctaattttttttttttttttttttttttttgtagagacagcgcctccttatgttgcctagtctggtcttgaactcatggcctcaaacagtcctcccacctcagcctcccaaagtgctgggattacaggcttgagccactgcacccagccaggaagttcctttgttttgtttgtttagagatggggatgggagaaaagagaatgagtgatgggaatttttagttcttttcaaagctattttaaatgtgaagttttgatttctgacagtacttaaaatgttgatttctctcttcattcatatttgtgcctaccatgggccagtctcttcattaaatgtttaaataaatgattgagtcattacatgaagctaaggtatctgtttttatgttttaaggttacaagaacagccaatcgtccaatagccgctggagacatttcaacttttcagtcctttgtttttcttgggggacagctaaccctggcactgggtgttcttctgtgtctaaattactacaggtatattaaacgttttccacatcatgtataaaatctctcctttgaaatggagaaaataggaataaaatgaaatatctttatcacaaagttgttcatttgctacttattaagcatctgtaagttagcaagtgtaagtaactcaccacacatttttaaatctgcttcaagaatgctttcagccaaaggagttaagaaatgaacatttaatttgttttgaaccaccttcagtatttgtactacattccctaagggacacaaggcaatttcataggttttctaagtgcgtgcatggatgtgtgtgtatacacccacacatatataattttatttatgttgacagtatctctaaagtagacttaaagcagaagtgattatattcattttgcaaaaagaggaactatgtctttcccagggtggtgttactaatcaatgactgaagaaagaagtgggaggactcattcctgtatctcttaaacaagacaaaacgaaacttttgtgtatcagattgcggtttacaaagtgcttcaatgcgagagaagaaagacaaaaagttactttatggagactagacttaattgcgtgccttgccctgatagcatcaattacatgacaatacctttggaaggttatttctggaaggggtagtgttagataaactttgaggtcctaagaacgtcttattttatcacattttcataggtgtttccttttttctagaaaagtaacactgcatcatatatataaggagggatatcttgactctaattattagttaggacatcttagtttattagatgccttaatgtttgcaaacagttcagagaggcagtaacatttggtagttaacatttggtggttgataggttggactctggagccagactgccttaggtttgaatctaggctcttctatgactagctatatgacaattagcaaactacttaatttctttgtgcttcagttttcccatctgcaaaaaaggaagagaataaaactttatattataatacctgccttttggagtcattgtgaagattataatgaattaacaagtgtgattcacttagaatagtgcttaatacatgatagtactgtatgtgttagctattattttgtttgattgttttataacatttaaagtagttttctactcatcctttataatagggaaagtcgaaggctaggaagataacttacataaaatataatttaagataaaatatattttccaattagtattacttatgtcattgtcttaaagtatttcgtggtttctaagaggtagtggtaataatcactttaatggtttttcctcttttcagtatagctctgggagcaggatccttacttcttgtcatcacctacccactaatgaaaagaatttcatactggcctcaactagccttgggtgagcttacaataactaaaagtatttcctttgatatttgcaaactacacttttatggagagataggtaaataggtaaagatgaaatgacaaatcagtcatgtaattttcctaaccaatagtagattttcgtactttaaaggagagcagttagctatttttattagttcagaaatattgcatatttattagggttatcatcatcatcattattttttcctctcctctctcccccactgctcccctcccctacactctcctctcccctcttctctgagacagggtcttgatctgttgctcaggctggagtgcagtggcaccatctcagcttactgcagccttgacctcccaggctcaagtgatcctcccacctcagcctcttgagtagctaggattacaggcattgacaaccctgcctggctaatttttgtatttcttgtagagacagggtttcgccatgttgcccaggctggtctcaaacccctgagctcaagcgatctgcctgccttggcttcccaaagtgctgggattatagatgtgtgccatcacgcctggccattgctttctgaaatgcttttttaaaaatctaggtatgtcatgaaaaaatgtttgatctagatgccctgaagaatttgggggatggggtaggaagcactctgtggcaggaaaacaagggttaaagtgtatgtgatagcttagacagctcgtattctgtgaagcctctcaggaagaagttagacagtctcttctgggctaccataggattctaatccggcacttacttatttcagcagcattaattcaaccaagaatacgttgagagcctcctatggtctccagttaataaattgtggcccagcatttagcatagcacttggtgcggtgtaggtattgaatacatacttgttggtgaaaagaaagaaacatagttaggtaagcaggtatcagaatctgctgcaaaaatatctattcccagacttttctattctattcctagaatgattctagttctttgaatcatttttttcagtaaatgaaagaactaaaagcaactcaagaaattgatgtgagcctgatttgtgggaaagttgtggtagaatatttatctttttctaagatcctctcattgaatgttctctttattaaatttgaaattatattctcaatataagcatttcctatctataagataatattaagaagctggtatatttactccaaacatttactgaacccctacatttacttcgtgctaggaattgcagcaggtactgggaaaataaaaatgactaaaacaccctgaccatctttaaggagttggagatggagatgacagataaacaggtcattgcagtacaacgtgtcaggcaggagtgctatgggaccacaaaggagaggcacttcatcagttaaggaggggacatgagtggaaataggtaatacaggaggagaaaaggggtttctgagaaaagatatctgggacacattgagtttaaggtacatgagcaacttgcaggcagagaagtccagcagactgttcagtatgcagtctggagcttaggagagttatcaggcttgcaagtggagatttgagagctgtcaacatgtaggtgtttgtttacagtcctcagagatgatgccattgtggaatagatcagtgttcgtatgtatattcatgtttcagtagctgataggggaggcagagtggtaacagaaagaacatgggtttttgagtcagagagatgtaagttcagatcccagcatcttctgttattggtagtgccgtgcaccatattaggtgggataaatcttctctttaaacctcctatttacttaattaggggatattattctttttattagctctgttactttagttgttaattaacctctctgagcttgttttgttttttgtaaaatggagctaataagtaccaccgagagttgaaagggtttaaggaaggaacccacagaaagcagcacacacagagtctgatacccaggagcactgaacacactccgatgccactccttccctttaggattctaaagtacatacagactttccccctttttgtgttttgctaattgtaggcttgacatttaattggggagcgttacttggatggtctgctatcaagggttcctgtgatccatctgtttgcctgcctctttatttttctggagttatgtggacactaatatatgatactatttatgcccatcaggtaaagaaattatcttttcttaactttggtttagttgttgctgtttttaaagaaccaaattaaggagaaagcatttttttctaaaatttgttgttgttttttaagaactttaagaaccaaattaaggaggaagaattttttttttctaaaaagaaagtcattcacagttccatggctccaacaaaattttttttatgtttatgtgtgtttaccaaaattcaactcatttattttatttacaagcaataaagtagtatttactatgtgccaggcactgttttaagtactttacagacttaatcccccaacagtctttgaggaaagtacttacattatcctcatttaacagaagaggaaatatgtgaagaagtatttgtccatgtcacacagttagtgggtggcagaactgcgattcaaacccagtgttcagagactgcttttaaccactacattcttctgtccctctaatcattgaattatgcaacttttttacttggtgtagttagtgaacattttcccatatttttaccaattctttgtcattgtcactttaagactatggactatgagatagtccatgccccaatttaacatgccataaattcgatgtaccataattaaaaaaaaattcacagtttctctattttggctacttgtttctgagttttcacaattataagtaatattgttctaatcattaatacttcttgaataggagtttttcagttaaatttttagaagtggtattattgacttaaaggattatatgcatttttatagcttttgatattgcctttttgataaattccattttaaaaactcatttttttcttttacatttataaactctcccccagctttaatgagaagtaactgacaaataaaattatgcatattcaaggtatacagtgtgatgatttgatagtacatgttctgagaatacatttataaacttttcaaaaaagtttttctcagtatttttctgaaatatgattatatattctcagtcatttacttgaagaatatgtctggatttcattctgttttcttccactaaaccccctatgccctgctacatttgtagtatcatgaaaaggcggatctgtaatcagtcttacttccaaagtgaaacttgacttacaggttagaagagatgcctgtactttttgcggtaaggtctggaatgagtgcttaggataccagtactccaattagattaacaacttcaggaaaacaccacatactcattggcacttttgtggttcacataataactatagacacagtttgcaccctgaaggtgattctagtatgaaaggaaaaacagaaacacccacagtcattgttatttggatttgggccccaaaagagagcctgtcaggttgctgtctgccggtaggtcagtgcagagagttcagcatacagccactgatactacgtgaccatcattatttacaacagtatatggagatgcttacaagtaaacttgctgggagaaaccaggcagctacatgtggttatatcatcaagacctagctctacctaaacaggatttgataggaaaggcaagggataggttgggctagaagtgggaaatgagtggatgtggttaggtggtaagtgagcatttttctacatctgtgacttttgcaagattgaaactaaaatgtataggagattattgagatttgagaactctgaggtagagaggagctatgggaagaattagagctgaattttaatcctaacactaaaaatatggttaagagtcattataggattataacaaatataatggtgtatagaaatgaagctggatggtgattttagcagtggtgtttagctttgattggcctgcacattcattactgatcagcctgtttctgagttactgtcatctttcaccgcttatggtatatctgcatgttctttaaaagacaatttcttctgaaagtagttagtggtaattggttgcacaaccttgtgaatatacaaaaaaacactaaatctgatacttcaaaatgtgaattttatggtgtgtgaactaaatctcaaaaaacagtttatttttctttctgatattaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccaggtttgacctttttcttatttgtccctcatatttccttggtataaattataaaaattatttaaacagtatgccctctgtgtttacctggcaaggaacttcttaaacaactacttggcttctactacctttaacagacccccctgccctccggcctcaacttataagaaagctagctctagtattttattttatttttaaattttttttgaaacagtgctgtccagcctgtcatccaggctggagtgcagtggtgcaatcacagctcactgcaacctctaactcctggactgaagcaatcctcccacctcagcatcctgggtagctgggactacagtcatgcaccaccatgcctggctaattttttttattttttgtagaaatggggtcttgagattttgcccaggctggtctgaaattcctggcttcaagcaatcttcctgccctggtctcccaaaagtgctgggattaccagtgtgagctaccaaccccagccaaggtatattattttttaaaaataatataggcctaaatccaaattttcccatctgattttcctggaattacttctgattcatgtctggaaaaatttcagtgatatctgaagcttgtggtttgagttgaattactctaaaagcaaactgacagataaagcttttaaaaaaaaatctgggtttctagtgatggttagtagactaattattcataaatttggtttctgctggcataaagaccaaggacagataagacatgaaatgcggaacatgtcaaagttctgccagtagagagcaggaagctgtcatttcaggatattcacccacaccacatcccctacctgtcagaaacttatgttgagaatctacattgttgacttgtaaatgaatgaactaaatctaattttgattaaatcacttgctaataaattgactatatttttatatcagtgttattgttattttcattaaacagaatcaaaaaggtattcatggtggatcacctgaggtcaggagtttgaccagcctggccaacatggcaaaaccccgtctgtaccaaaaatataaaagttagctgggcatggtggtgggcacctgtaatcccagctactcaggaggctgaggcgggagaatcgcttgaacccaggaggtagaggttccagtgagccaagatcacaccactgcactccagcctgggcgacagagcaagactccatctcaaaaaaaaaacaaaaaaaaaagaagatattcatgaagctgtatttagatgactgattttatacagattattgccaattactatcagtataggcaagactcacataacatggtatgaaggaaatcagaatctgatgtctgtaaagtaaaccatatgctgtgtcccctccactgttttcctcactgtgaaaactaaaatgtgaattggtgactttccaggatgtcaccatttttcccttcagaatttctcagcatccctttttggtcatagctcagctccatgagggctgacattgtcatttgattgtctggtctggataatgggtatatgttaatatttaaacacctgaatattaaatagtacaggaaggcaaaaattattaagacaatcacaaatactataaggaatattcggccaggcgcagtggctcacgcctgtaatcccaacactttgggaggccgaggtgggcagatcacttgaggtcaggagttcaagatcagcctggccaacatggataaaccctgtctctactaataatacaaaaattagctgggcatggtggtgtgcacctgtaattccagccactcgagaggctgaggcaggagaatcacttgaaacctgggaggcagaggttacagtgagccaagatggtgccactgcactccagcctgggtgacagaaggaaactgtgtctcaaaaacaaaggaagaaaaaagaaatacttggagcccactttatattttaaatcacatttatggtcctctgtccagttttgttgttgttgttgttgttgtttgttttgaaacagagtcttccctctgtcacccaggctggagtgaagtggcacgatcttggctcagtacaacctccaccacctcctggtttcaagcgattctcgtgcctcagcctccgtagtagctgggatcacaggcacacgccatcatgcccagctcatttttgtatttttttagtagagacggggcttcgccatgttggccagactgatcgcaaactcttggccttaagtgatccgcccacctcagcctcccaaagtgctgggattacaggcatgagccaccacgcctggcctctctgtccagttttcgatacagtgtttaaagatggacgtagccttttagtatttaaagagaaaggaaatcatgataattgtaagtctgcagaccacataataaagaatagtcccccatgcctaaggaagataggaacatacgtgagacttccttagtgtatttgcagggctaccatggggaaaaaggagtacgcttgttctagattactagcaacagatttaggtctctagctccccttccctaaatgtaggtccctgaacaggagagatttagaaatgtgggagggcatttttggttataataaactaggaggggtgactatatggatgatggccagatacagtcaatatcttgtgctgcaccagattgccctgcattagagttgtcctgcccaaatgggacttgttctccattgagaaactttgctgcagacgctaaaaccagaactggagggtaggagttgcagggagacagactttagatcagtcagtataaggaagaacgttctaaatcgttagaactaaaaacagtatgggttgcctcacaagcattcatgcaaccctcaaccgaaaattcttaagaaacagcttggatgattccaagtgaaaaatatggtaaatttttctttttctttttctttttttttgagatagagtctcactctctcacccaggctaggagggtgcagtagggtgatcatggcttattgcagccttgacctcttggcctcaagcaatcctcccacctcagcctcttgagtagctgggactacaggcatgtgccttcgtgcctagctaatttttcattttttatatttgtattttttgtatttgctgttttctcctccgtgttaacatgtttatttgttatgacccaaagtccagactaggtattaatacaactttgtattcctctcttgcagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgg

SEQ ID NO: 37891 - DNA, 26215 bp, Homo sapiens
gcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggaggtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcaggtccgtttttctaggaaagttatttctttttcacttttagattcaagtgctcattttcttcttcaaatttagagcacttcagtatgaacaatatttcttttgttaaaaaatatttcttggaaacaacttattgaagtttcctcagagtggccaaagccgatgataattttattccagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatgggggtgagtagctccacactaagcccttggagggccacgagcatctggtccctctggtgacggactgcagcgccctggagccccaggtgggacagagagagcaactctcagactaaccctgctgctgcagaactcttggatgccgacgagcttgttttgcttgtgttttcacaattatttttattaatttatgggtgtctgttgtgccagccttgagctgctccaggttgtggcttagtcccaccagggtagggacagtcccagggccatgaatgggccccaggagtctccatgaccctcggctctgggggcccagggtcctctgaggggtcacctgcaaaggtgggaggaggcgtctcaggccttcaggtcggccctcacagagagaacctcagggacctcctcctcctagggagggcctcaggggccggctgggagggagctggggaacaaaggaacaggtctggggtggacgggcagcgccagatgtccgagggatttccctggggtcctggccattccctgcacagtcgtgggcacagagatgattggaggagccacttgggcctgagtgtgtgcagctgctcagagccatgctgcaggacaggcctctatgcagggacccccggttccgtgtagcttgggctgagaatgagatccaggctgtgatttctcccctccctgtgccctggcctccgccggcagcccctgcagcacccacagtggtcctgcccacctcccgtggcctgagcatgccccaccaagacaggcgtctgcctcggagctggggacagaggcggctcccgggtggtggtggccatctccgggctctgccctcctccacctggtgccctggacttggtcgcagcccctcccccgcccaggccagatcccctctgccccagacctcgcttcctctgccaggaccctgggtcccagtgacctttgatactgactcccctcagactcaccccgggggtgctgtgcgtgagagagagccccctccccaccgcacccctgcagtgctgtgcgtgagagagagcaccctccctgcctcctgctagggtcttccctgctcaggagcccctgggcctggagcccctgcctggagggatcttcttccagatctggaaattaggttctgcagacggagggggatgggcagttgttttccagtctcgtgtctggacctgggtgtgggatctggaagactgcacgcacaacatgttggggcaggagtattttgtggggagaggtgccattccttgctctaaatattggcagatcccctttcttctctcctccagataacagcgtggggggtccatgctccgacatggctgggggaggctggtccatgtcctgggctgcggcggggctgcgtctgtcctacaggaggagtccaggatgggcgggtcccaggtgcgggtgtggttgatgctgggggacgtgggtgagtcaccaatacacagacagtgaagcagaagttgaagggtcagggtccagcctggggacggggcgcgttgtaacctgggattctgtcgctgtcttgcagagctgcctcctggtgacctcggggttttcgctgtacctggggaacgtgttcccggctgagatggattacttgcgctgtgctgcaggctctgtaagcagcttcctccacgcctctgccagtgcccaagctcgccggcacgtgctctggtttctttgttctgagatgtgcaggtttctgtcacctgtacctcattcaaacctcttcatatgggccgggcacagtggctcatggctgtcatgccagcactttgaggggtggaggtgggtggatcacctgaggtcaggtgtttgagaccagtctgaccaacatggacaaaccccatctctactaaaaatacaaaaattagctgggcgcggtggtgggtgcctgtactcccagctactcaggaggctgaggcaggagaatcgcttgaacctgggaggcggaggttgcagtgagcccagattgtgccactgcactccagcctgggcaatgagagtgaaacttcgtctcaaaacaacaacaacaagaaaaaaacaaaaaactcttcatatgactttagtttcacgtagagttcatcacctttgagaattactgatgaagcaggcctgaaccttgctctgcagacgcctgtgcagggaattgcgtgttgattctgagcctgcggctgcgtcctgccagagctggcagcatctgccctcaggggactgggacctgtgccccacatcctcccaaagcttcatgttgtgtttttagaaacttacacagtgccaaggccggtggaggcacccactgatcctcagagcaagggaggacagacaaccgctgtcccctggtcctctgtgaaccccggccactgcctccccagcgtcccggcagctagagcaccatgctggctgacccctgggctctggcccgcaagccatggaccccatgcccctctggcccgcaagccgcgcaccccatgcccctctggcccgcaagccgcggaccccatgcccctctggcccgcaagccgcggaccccacgcccctcctgcttcagctggtcccgagctctcccctcctctcgcttccacatgcctgctgggtctctggcccctgccctttctctagggacactgttggtgactgtccccagcagcgcccccgaaatgtcttaaaaacaaagtggatgccccgccccgtgctgtcctgggtctctgctcccttagaacaaagccctttggggcaggtgacccgtcccactctgctgccctctctggaagcttctccgtggcctttatcctcaccatgggagccgcccttgtcccagtggagctgtgagctgtgccccttcagcctcagcggctgccggatatgggcaagtgcccacccccgcccagccttggccccactcggccctgcccccggcctttcttctctaccctgggccctcgtggcacctgagtgggtgctgagctgagcctggctgtcctggccctagctctgcccctcgctcaggccccgacggggcttcttctgcctcctcacccagcactgctgtgctcagcccctcagggcctgcacccccgactcagggcccggggtcccatggctgcaggagcaaggccctgcacggcaagggccacaggcctgggctggcccgactccatccacctccctgtccctgacgtcccaacctccctccctggccctggactcctagccttggtgtggccctgtggggacaagaaggctgaggacaagaaggctgtgggactcctttctgcctccctcacatgcagagtcttgctacttcctttgctccttccttcctctttctttctttctttttttctttctttctttctttgacggagtcttgctctgtcacacaggctggagtgcaatggcgccgtctctgctcactgcaacctccacctcctgggttcaagcaattctcctgcctcagcctcctgagtagctgggactacaggcacccgccaccacgcccagctaattttttttgtatttttagtagagatggggtttcactatgttggccaggctggtctcaaactcctgactctgatccacccgcctcagcctcccaaagtactgggattacaggtgtgagccactgcaccagacctcctctttctttctttctttctttctttctttctttctttctttctttctttttttgagacaaggtctcactctatcaccgagtattcacagctcactgcagcctcgaactcctgggctcaagagatcctcccagctcagcctccggagtagttgggactagaggtgtgagccactgcacccggctgatactttttccttttttgggtaattttcagcaaagaccaggtcttgtgcctgcgtgagttacattctaggcttcaaagcttatccagctagaagagccttcattaacaaatatctttttagcacatcagaaaaataaaaacttctttcagaataaattattttgaagtacctgggggttgggcgcagcggctcatgcctgtaatcgcagggctttgggaagctgaggtgaacagatcatttgagcccaaagttaagatcagcttgggcaacagagtgagaccccatctcaagaaaaaattaaaactgagaagtacctgggggccttctagtcaagccaacccactgtgttgcatggactggcaacactgttttgtgaatatgattcagatccttctggaagcgcaaatgttagagtatttcagagtctcagttgctcaggtgagcggcaggctcatgggattccggtttcattccagtgcatcccctcggcaattgtgagcttcaccgtctccaggaggaacgccaatgtggtgagtctagcttgcaggcagcctctgccagggagaaagccggaggggctgacagacagtgtgcccatgtgtgcttgtgtgtgtgcccacgcacagacgttgtggcaccgagaggggcccccgaggttgccccccagacagtaaagctcctgcccagcccagcctttgccgcacagaggggagagcgggctgagcacgcaggactccccaccattatgtcctaatcaggataatttttagtgaatggcctgaagtgtggtttatctgttaccttttttcttttattattcaaagaaggaaaacccctcctgccttgtttttcagattcccaactttcagatattgtttgtttccacgtttgctgtgaccactacgtgtttaatttggtttggatgcaaactagtcctgaacccatcagcaataaacgtgagttcacacgagcttcgcgcagacgcctgacacccacagccccactcccacgaatggtgtcagcaaatgtttgttgagctggaaataggtggtaaatgttattcacagctcgtgagtttgactaaagttgagagatttatgcatccaaagaaaataattgtctttattgaagtctcgtgattctgcgggacagatttattggtaaacaatgtcttttccaacagtccttaaaaattaacagtgacataatactatgtttcatccaatctgtgtaagacagttgttcaatgcacctctaaacaaaaatgtgaaattgtagggggcagaggttgtgggagccgagatggcgccactgcactccagcctggaagacagagcaagactccgtctcaaaaaaaaaaaaaaaaaaaaaaagacaaaaatcccaaaggaaaccaggacctcatccgagatactgcaaggagggcctcctgctttgtgtgacatgtggaatgcacttgatgattggggaaagctggaggaggcttgagtatgtcctggccactctcgttgggcaggaaaaatgagcagacacaggaggacccagtgggaacacccacactgcctttttgttttgttttgttttgtttttgagaaggaatctcgctctgtcgcccaggctggagtgtagtggcgccatctcggctcactgcaacctctacctcccgggttcaagcaattctcctgcctcagcctctggagtagctgggattacaggcgtgtgccaccacactcggctaatttttgtatttttagtacagacaaggtttcaccatgttggccaggctggccttgtactcctgacctcaggtgatccatccacctcggcctcccatagtgctgggattacaggtatgagccaccgcgcccggcctgtgacgcttctttattaagacggagagcagatggggtgtggtccctgggtcagtggcttgtatctgaactgctcagaggcaagttactcactgtagctgtcggctggccctgggaggagctgtctcttcaggatcaggaaggagccagaggtcaaagcaccagaaatacagaaaataaaagacaaggttaatgtcacacttttctgaattttagagttctccttatgcttttgtctttttgatctgtcatttttttttttttttgagacagtctcgctctgtcgcccagactggagtgcagtggctccatctcggctcacggcaacctccgcctctcgggttcaagcaattctcctgtctcagcctcccgagtagctgggattacaggcgtgcgccaccgtacccagctgatttttgtatttttagtagacaaggggtttcaccatgttggtcaggctggtctggaactcctgacctcaggtgatccaaccgcctcggtcccccaaagtgctgggatcacaggcgtgagccgcctccctctgcctgatctgtcagtttctaagaaaagtgtttcaagtccttccccacctctactgatatatctacatcttcctgtggctctgttatgacatcatatatttcgaggctctgtttttagttgaatgtggttctgcactctttcttttttaaatgtattttaaaaattgtcaggccgggcgcggtggctcacgcctgtaatctcagcactttgggaggccgaggtgggcggaacacctgaggtcaggagttcgagaccagcctgaccaacatggagaaacccctctctactaaaaatacaaaattagccgggcgtgctggtaggtgcctgtaaccccagcttactcgggaggctgaggcaggacaatcatttgaacccaggaggcagaggttgcggtgagccgagattgcgccatttgctctccagcctgggcaacaagagcgaacctccgtctcaaaaaaaaaaaaaaaattgtcagacagctacactgactttttaaaatgtatgcttctatgaatattaacacacatataaattcatgtcactgccaatacggtcagggcctgcagtcgtttcattaccctccaaaaaaccttatgttctcagtgcttgacaatcatgcatgaagctactctaaacattccgtgaaggcttttgtgggaacaaggagcgttcagaatggggtcggtagaccagagcccaaggccaaatccagccctggcctgtgtttgtacagcctttgcactaagaatggttttaaaaactaaaagaccccaaaggcccatgtgaggcaggagagtgtgcagcccacagtgcctcacagctggccctggatgggaaaagtggggaccgtggctgagagtcctgcgcagcctgcccgtgaggtggtccggtggacgctgaagcgcggtggcgtgagaaaggcgggcccggtgctgaagcgtgtgtgccccttggcagatcaacttcaacctcatcctgctgctcctgctggagctgctcatggcggccacggtgatcatcgctgcacggtccagcgaggaggactgcaagaaaaagaaggtgggtgcagcttctgaccccgcagggcagggggtgcagaggcatcaccccagggtgagcgaggtgggtctcagcgtcaccctcggagggccgatctgggctgctccagggcattcccatgagacccctctctcctgggtctcagaaaccccggccaggaggggctctggagctgggtgaggggttggcggccgctggctacagggaggtgaagacagatgctgtaccctcccctccccctaagcctgactcagtccagtgctcgtccccaggggatcaccaggagacaccacatctgctaattttcatatgcaaggacaatgtgtgtgaacatttcctcaagcccaaagatccacgggcgcctccaaggcggtctcgcatctacacggcaggctgacctgacccactgcccacggcggccggatgccagcggcagtgctgagtccctgtgcccgtgcacccggggtgacagttctgtttcttcgtagggctccatgtctgacagcgccaacattctggacgaagtgccatttcctgctcgggtcctgaaatcttactcagtaagaaaacttcccttctttctcttttctctcatactctgtcgggggtgactgaggctggattaaacgtcacgtttcgattccgagttggcgaagagttggctgtctacaccgcatggcggcgtgcgcctcatctgtggagactctagtctgttattggtatcattggtaataaccttccttatcgcgaaaggtgctgctggtgtcctgtaatttttagggggagtttgttactgccgtaggtgagttgacactgttgtccccgaggaattttttttttttttttgagacggagtctcactccatcagccaggctggggtgcagtggtgctatctcagctcaccgccacctctgcctcccaggttcaagtaattctcctgcctcagcctcctgaggagctgggactacaggcacatgccaccacgcccggctaattattttatttttagtagaggcagggtttcggcatgttggccaggctggtctcgaactcctgacctcaagtgatccacccacccaggccttccaaagtgctgggattacaggtgtgagccaccgcacctggcctctttctccttcttactttcaacttttcttgccttgtactttggtataattgttataagcagcacgtaactgtattttgttctttatcttgtcattctctctccctagctttttgaatgtagcccatttcctctgagagttattactgataaatttctacttatttttaccatcttttgagttttccattttccctgattttgcctttttccctccttccctgccttcttttgaattggcagaggctccgtccttccttttccctctaattttggatgggaaatttttcagtattcttttgggggttgcccttcatattctaatacgctccttgataaacagaccatgcggggtctgtcccccttccctccgccttggccttgttgtctagcttgtgacatttagtgacattttgcctttttactccaacaatgggacagcctcctgtgtgcttgactgtgtctgtgtgtgtttcccagtgccttcacttccccttatttagcatttcagtcctctcttaggttccatttccgttctgcttcttttttttttttcctttttttttgagatggagtcctgctgttgcccaggctagagtgcagtggtgtgatcttggttcactgcaacctctgcctcctgagttgaagcgattctcccgcctcagcctcccgagtagctgggattacaggtgcccgccaccacgcccagctaatttttgttatttttagtagagacggggtttaccatgttggccaggctgtactcaaactcctgacctcacgatccgtctgcctcggcctcccaaagtgctaggattacaggcatgagccgccgtgcctggctgggaattcagctttatttgtgcatctggagttttgtgccttctggacgcaaggcctggctgcccaggtcccttccggcccccaagcccttgctggcccactccttatgcctggctttcctgctggccacagctctgtgtttgcgactcacagagatccttcacgggagcaggttttcgggcgtgtgtttcttccccagccctccctgagtctggcggtgctggttgcggcccctccctgagtctggcggtgctggttgcggcccctccctgagtctggcggtgctggttgcggcccctccctgagtctggcggtgctggttgcggccctgatggtgccgggcagatgagtccacaaccagggcttaggccagcagggttcttggctttgtccaggaaagaattcaagggcgagctggaggtgacagacagcagctttgtttgcagtggcagtatagcagggctctccaaccggcaggtgcctcgagcagcagctcagagacagctctgcctcctatttatacccacttttaagtatatgctaattaaggggcagattatgcagaaatttctagaaaaggggtgctaacgtccaggtggttggatcattgccacggaaaggggtggtgacgtccagtgttgccgtggcaatggcaaacccacatggcacgggtgggtgtgtcctatgggaagctacttctgccccaggcctgttttcccgagtcccttcgatggggtccagggtctgagcaccgccgcctgccacactgtgagacagggaagggagtctgagggtcttggttttctgccctcaccactgtcaggtcaataccctcagtttctgtggacaaaagcagcagtgggggaaacacctctttggctattttactccaggagggacgtgaaaagccgcagctgagggcagagggggtctgggccaggtgaggctgggggtccatccaggtgggctcctccacggttagatctggggccagcccactggaccctgctcctgggggtccatgtctgcacagtgcattctgggaatctgggggtgtctccacttccttatgagccgatgctgtcctgtcccctccaggtcgtcgaggtaatcgcaggcatctctgccgtcctcggggggatcattgccctgaacgtggatgactcagtttcaggcccacacctctcagtgacgttcttttggatcctagtggccgtgagtaacccctctggcccgcccgccgccgctctgggccacactgctcagatcctgcgtggctgggccccgagctcagtcttggtgcattcagacagagagtcaccacagagggtcctcgctggcccccaacttcagaagaactggggagttaaggattaaatgagtcaaagtattaactgcttttatattagtttgtgtgattattttatattatttttcctgaaaaaaataccaattatttttattattctaatctttttaacatatgaatgtcaggctgtagatgtttattattctatataattttctaatatataatgcatttatattacactatgtgtttcatacaatgcagcatatttctgttattactttacattaaatgttactgcagcagatgtgtcacacagcacctgacacatgccacatgctcaatacatgggcattgttttatttattttatttatttatttttttgagatggagtctcactctgccacccaggctggagtgcagtggctcaatatcacctcactacaacctctgcccctccccgggttcaagtaatttgcccacctcagcctcccaagtagctgggattacaggcgtggaccaccatgcccagctaatttttttgtatttttagtagagaccgggttttgccatgttggccaggctggtcttgaactcctgacctcaagtgatctgcctgcctcggcccccaaaagtgctgggattacaggtgtgttccctcagaacagtgagtctagagcaacccctccacaccccagatcccctcacagcctgtagcccacccagagccaccacccacctgcctccggacgcagaccccacgaggttctcagcaccttgccgcgtagtggcctgcacaccggtgttgacggccagcccctggtttgtctcatgctgtgtggacttttagattttgcccctgctctcttatgtacatgagcaggaatggtgagcacccagcatcagctacaggctcctcctgggcagcagtggggctcttcctgaagctgccgaggcccatgcctgcctgggagcagtatggccaggtggactgccgagaaggggcccacgcctgcccgggaatggtatggccgggtggactgcggagaaggggcccacgcctgcccgggaacggtgtggccgggtggactgccgagaaggggcccacgcctgccaggtggacacatcccattggcagcagctgtgtttcagctccctgtgggggcgagtaggcacagagcaatgcccccagggcaccagtgcccgacctagtgggctgctgaggcgctcagagagggaaagagacccaggcaggaccgagctgggatagagccacacccccggaaggggtaggaccaggcccagctactgagacagagaactcacatgggtgcccacccaagcgggtctgtgacagagagaatgacgcctgcaggtgtgtacaactgaccctggggtctgaaacgcagggattacatcccgaagctgagggaggacagagaccacatacctccaaaaagttgagaatgaaaggcacttgccctacccccttccctgtccctgcagtcagccctcatcacagaggcccctcccatcccgcagacccctcctgcctcgggggtggctctgctctctccatcttcccggagagcaccccctgcccatcaggtgctgccccctgggcgcccctaaatccacccacactcccaaccctctcttcagggcaggagaccccaggaggagaggagagcgctgaggcatgcgtggtgagggacccagctccacctgcctgagtctggcctgggtgcggcagaggggcccaggccctgcaccatgggctggaggcaggtgctcggggctggagttgggggctgggctgcaggcctggacccttccagggcagggcccttgattgagctgccccagcccctatggctgagcttcctggccctctagggcaggggccggagtggccatgctgggtgaacggggaaactcccgccctcccatggctcactggggccctgaataggccaccctgaagccaccatcccttcctgtgccctcactgctgcttacagctagaaggccctttcagaagcaccaagcccaggagagacccctgtattgacacctcagcctccctggccagggccacacccacctcagcagctggcttggggcctttgcactggcagcccctcagctccccagtcttctccctgctgcccaggctcccctgctcggagcccatctctgtcctgcccaccctctcaccacagcccctggctgatgcagccccctccccagcaggccgggctggggtgctggcacctggacaccttcggggagatgaagaggatgaagagcatgcatcctccctctgcctacattgtgcggaactaaggcaggctcctcacaataagtgggaaaagggcatttcttggttataaaaaggaagaggtgcccatccaacagaggaacctacagatccccctaacccagtgagtcaagtcagcgtcatcaggaaggggcagtccacaccctggggcactgcagagtctcctccgaggctccccaaggctcatcatgaggaaatcctgtcccacacggaggcccgactgcagctgatgggctgcaccccccagaagcgaccaggtaacggaggtgacagaggctgagggactccccgattaacagggacccacaaggagactacgagctcaatggcagaccgaatccggatcaggagcaaacaaacaaacagctctagaaataacatgaccagggccaggtgcggtggctcatgcctgtaatcccagcactttgggaggccgaggcgggcggatcacctgaggtcaggagttcgagaccagcctggccaacaaggcgaaaccccgtctctactaaaaatacaaacattagcctggtgtagtggtgggtgcctataatcccagctactcaggaggcttgaacctgggaggtggaggttgcagtgagtcaagatcgcgccaccgtactccagcctgggtgacagagcaagactccatcttaaaaaaaaaaaggagaagaagaaagaaaaattattaaaaaattaaaaagaaagaacatgatgaggacaactggaagaatctgggcatggaccacatcggccccacgtggagtctctcgagcgtggtcctgctttgggtgtgtgcaagagtgtgccctgggctcagccagcactctcaggtgttcaggcatcaggctatctgggagagctggagagagcacagatatgaatgtcaaggactctggtgattttggggcctcagatgccccctccactgctcttgcagcttttctacaggcttaaaattttaaaccaatggttgaggaacagagagcacacaaaacctctgagaggctacccctgcttccctgcggacccgtccctgccccagctgcgcctttgggcactgcaccatcccccctgccccccacagcaagccagccaggcagcctgcatggaggggtcactggtgggagggcacatgtttggaattcgacttcttcgactatttcctctaaaatctttcctttttcttttctcttagtgctttccaagtgccattgccagtcatgtggcagcagagtgtcccagcaagtgtctggtgggtgaacccctcagccctgggtgccagggacccaccgagcggggccagggcctggcctagccctcccttggtgccatgtgaccaggctccagcccaagagagcgcagtgactgggctgcagggcctgcacaatgaggaaggtggggttgtgggaggtggaggctggcccgctcagcagggactgttctcagggacaggcagacctgaacaaggtggtgtagacactggaagcgctctctgtgcctaacccttggaaggagaccagtgtctgagcatcatctgcacctcctaaggctggtcgattgtttttttttcttttttgagatgcagtctcgctcttgtcccccaggctggagtgcaatggcacgatcttggctcactgcaacctccgcctcccgggttcaagtgattctcttgcctcagcctcctgagtagctgggattataggcgcctgccaccatgcccggctaatttttgtatttttagtagagacggggtttcaccatgttggccaggctggtctcgaactcctgacctcaggtgatccactcacctcaacctcccaaagtgctgggattaccggtgtgagccaccacgcccggccgaaactgccacaaactgaccgcaaacaattgaactggtcgatcgttaatgactgctgccaaaatgtggaccctgagtgctttgcaaggtgactgcccatgcttggcatgagtgaaggctgtctctgagacttgatgggtcaaacaggaagatttggggtgggttaaaaggacagacttcagagcagtgaaggaggtgacccatgcggaagggctattttttcaagagtggagaattgcaggtaaatgttttttgtttcttggttttgtttgtttgagacagagtcttgctctgtcacccaggctggagtgcagtggtacgatctcagctcattgtaacctctgcctcccgggttcaagcgattctcctgcctcagcctcccaagtagctgggactacaggcatgcgccaccacacccgcttagtttttgtatctttagtagagatgggggtttcaccatgttggccaggctggtctcgaactcgtgacctcaggtgatccgccctcctcggcctcccaaagtgcttggattacagatgtgagccaccttgcctagatggtaagtatttcaaaacttgtggcactgtgctgtgaatgaaaaggcaggctgctcatgcctgtaatctcagcactttgggaggccaaggtgggtggatcacaaggtcaggagttgaagaccagcctgacaatatggtgaaaccctgtctctactaaaaatacaaaacaattagccaggtgtggtggcgcatgtctgtaatcccagctactcaagaggccgaggcgggagaattgcttgaacccaggaggcagaggttgcagtgatcagagattgtgccaccgcactcctgcctgggctacacagctaggctgcctctcaaaaaagaaagaaaggcaggccgggcgcggtggctcatgcctgtaatcacagcactttgggaggccgaggtgggtggatcacctgaggtcaggagttcaagaccagcctgaccaacgtggcaaaacacggtctctactaaaaatacaaaaattagctgggtgtggtggcgggcgcctgtaatcccagctactcgggaggctgaggcaggagaatcacttgaacccgggaggcggaggttacagtgagccaagatcatgccactgcattccagcctggcgacacagcgagacttgtctcaaaaaaaaaaaaaaaaaaaaagaaaaagaaaaaagaaaaggcagaggtttcagcaggagtcatgcagggaaccagcttgggactatgcccatgagtgcccggccatgcccgcccccccagccctggccacgcccgctgtcctgggctcccaggctccggccgtggtcctgcaacccgcgctttttttccaggtggaggtcctgattgccataagcagcctcacgtctccgctgctgttcacagcctctggatatctgtcattcagcatcatgagaatcgtggagatgtttaaggattacccgccagccataaaagtgagttgtattttatttcagagccccccagacatgtggtgctctgcgtgttggcctggcccttgctggctttgcctgggactctgggggcgctggctccagggacagctccaggaggcacctcctccgctgttcctgggcagcggtgaccgtgctccccaatgccagcctggccccagggcctcggggcctcgattccgccctgtatctggggccaccacctgcttcacagggacctgggacccactctgtccctgagcccattttagaatctgtcctgggtttatgagacatgcttttcggatttgcatcagaactgcattgagtttaacaggtgaatttaaggagaattcaaagtcctgttactttgagctgacccagtaggagcttatctccaacacgacttctgaggctcaggcacgtgtagctagatgtatttcttagatacctagtgtttttttgtttttttgtttttttttttccagtataagtggttttgcacccaaatcattagaagacctgtattaagctgtttgctccaggtcaacatgcgtgtgctgatggggaatggagtcactgcctgatggggggatggagtcactgtctgatgggggatggagtcactgtctgatgggggatggagtcactgtctgatgggggatggagtcactgtctgatggatggatggagtcactgtctgatggatggatggagtcactgtctgatggaggatggggtcactgcctgatgggggatggagtcactgtctgatgggggatggagtcactgtctgatgggggatggagtcactgatgggggatggagtcactgcctgacgggggatggagtcactgcctgacggggggatggagtcactgcctgatggggggatggagtcactgcctgacagggggatggagtcactgcctgacaggggatagagtcactgcctgatggggggatggagtcactgcctgacgggggatggagtcactgcctgacaggggatagagtcactgcctgacgggggatggagtcactgtctgacgggggatggagtcactgtctgacgggggatggagtcactgtctaatggggtaatggagtcactgtctgatgggggatggagtcactgtctgatgggggcatggagtcactgtctgaagggggatagcgtcctcggcctcccacaggtgctgggattacaggagtgagctacaacacccggcccagggttttttcttcacttctcttgtgtttgcttcacccactcctactccaattattttgtttcctgtgacatttaatatatctcctacttcatgttgtcttacaatatgcatataattgttcacgattacaagagacaatattaccacccaggggccatctcctgagtgagcctgaggcttcccttttatcttcagcatgcattctgctagcaggggacggccacacgccatcgaagtcggcccctttctgtgtggggttatcctctgggttcgataccccattaagtttaatggcctctggttgtattccattttagggcttggtgctttttttctttttaaaatggtattttttgaatatataaaatatttatgtggttcaaaagccaaactataaaagacgagctcagaaaagctgtggtctcatgcctgactgacctgctcctcttatgggcaaccagatgataatttttttttctttcttacaaaatagcttgtatactagaatcactattctgtaccttgccatttttttttttttaagatagagtctcactctgtctcccaggctggagtgcagtggcacagtcttggctcactgcaacctctgcctcctgggttcaagtgattctcctgcctcagcctccggagcatctgggattacaggcatatgccaacacacccggctaatttttgtacttttagcagagacagggtttcactatgttggccaggctggtcttgaactcctgaccttaagtgatctgcctgtctcggcctcccaaagtgctaggattacagacgtgagccaccgtgcccagccatatacctcgctttttagttatgtatttatttattttatttttcagagacagggtctcactctgttgcccgggctggtcatgagctcctgggctgaagcgatccgcccaccttggcctcccgaagtgctgggattacagacgtgagccactgtgcccagccatgtacctcgctttttaattatgtatttacttattttatttttcagagacagggtctcactctgtcgcctgagctggtcatgagctcctgggctcaagcgatccgcccaccttggcctcccaaagtgctgggatgaggaggcttctgccaccgtgcccagccccttgcttgtttttttaaacttaataatttatcctggtgttttctcgatacccaaggggatcagagctcttctgaattccttcatcgctcctgactgcccggtcaacccagccagtccctagtgatggaaactgagttatttccaaccgtctgctactataaataactcctccgtgaacaacctgcacgcatcttccttttgaatcctcagcgcatctttaggatatccagctaggagagagactgctgggtagagggtaggtgcagctgtcatgctgataaatctcggcgacctcctcaatgggggccgtccaccttccctcctgccaatggcgtgaaggtgctcacttctccacagccccccacagagggtgtcacgctggagttcggtgacacgggtgggagcacctccgtctcaatgtgggtgaggacgaggacctcttacaaagcatgaggacgtctgcattgctttttcagtggactctgctcatgtctcctgaccattttccgctaaccctggtgccgggggagaccagctccatctgtgatggaggatacaaatggtggtctcagcctggcggctatttcttgttctgcttgttgtgatttttgttatgtgaaagctatttttttaaatagttaagttgattaatattttctttaatggctctggattttttttttttgagactgaggaaagcataggctttgcaataaatggtgtctcaacaaccgaagagcaaagaccacatggggcccatgcctttaccatcctccagggtaaactccagctgggaacacaagtaccagactttctaataattacttaaaatccaggccgggcgtagtggcacatgcctgtaatcccagcagtttgggaggccgaagcaggcagatcacctgaggttaggagaccagcctggctaacatggtgaaaccccgtctctactaaaactacgaaaattagctgggcgtggtggcgggtacctgtaatcccagctactggcgaggttgaggcaggagaatcgcttgaacctgggatgtagaggttgcagcgagccgagatcgcgccactgcacgccagcctgggtgacagagggagactgtcgcaaaaaaaagttttatgttaacttgagaagagctgttcgttctgtttcttctcttactttttgtagcagtgacattggatagatgtttggctcttttgtgtgttaacatttagttgctttgtttttcttgagccaacacgggaaagctatccatgggcacagagggttttgggtgctccgtggtcactctctggccccctgcatcctcggccgctccctccatcctcttccctgccgagctcaccgcgctgcctcctgccccttccttcctagcagctggtgctcaggggtgaagctgttgggggtctgtgcaccccatccccccaggacggctgccccctgtctcctccgctcaggatcctgctgacacggaacggtcagcgcttctgcctcccgcggacattctctctggctctgggactgagccttgcgcgtgttggagcaggaggggtggagcgacttgaccactagcagccagcactgtccacggggcctggcagtggctcggtcacttttattcctgtatgttgaacacaagctgatggaatttaaagcagaattgacctcattaattgagctagaatgattatcatcaggttgttgaaatagcaatgcgtttgggttactggggctccgactcgagccctggcacctgctctttgtgaaggccgtgggcacgagggagctttggtctcctgggctggagggcggctgggccactctgctcacacctccttccgcctgcagccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtgagtggcctgcagggggagggggcactggggaggtgagtggcccacgggggtgcccagccagggaggtgagaagcctgtggggtggggggaagctggggaggtgagtggcccacaggggtgcccagccggggaggtgagtggcctgcagggggagggggtgctggggaggtgagtagcccacaggggtgcccagccggggaggtgagtggcctgcggtgcaggtgctggggaggtgagtggcccatggggggcccagccagggaggtgagaagcctgtggggtgggggcactggggaggtgagtggcccacaggggtgctcagccagggaggtgagaggcctgtgggtttcaggggtgctggggaggtgagtggcccacaggagcacccgctggggaggtgagaggcctgcggtgggggctcctgtcctggtgagggcctccgagggccacacgacgtggccctcgaagattcattgtgccactttgtatttttaaaaacaccccagaaaaaccccgaagaagtaaaatgtctttcttttcttttttttttttttttttgagaaggagtctcagtctgtcacccagactggagtgcagtggcgcgatcacggctcaccacaacctccgcctcctgggttcaagcaattctcctgcctcagcctcccgagtagctgggactacaggcacccgccaccaagcccagctaatttttctatttttagtagagatggggtttcactatgttggttagactggtctcgaactcctgacctcatgatccgcctgccttggcctcccaaagtgctggaattacaggcgtgagccaccgcgcccagccgtaaaatgtcttttaaaaatacaaacacaaagcctgggtaaacccagacccatccctgggaaatattctggacttaatgctttcagatttgctcttagagacacagaagagggctttgtgaggactcccacaggtcctgaagtttccttccctggtctctggtggggacgcggttctgcagggaaggcaatgcccacccagcctggcacatggggctccgtaaagctggggtgtcaacaacttctggctgtcactgcctgaacaatgttcccccgggccctgcctactgtcttgctgcccccacatctgaaaggcagaggctcagcgtcttccccccaccgagctacgggtcctggtggtgctcccctgggcaaacctgcccgctgaccctcaggtgcagtgaccactaggactgtcaccttgatgcccaaacacctgggcagccactcagcggggctctgagtcctgccccacctctaggccatcctgggcggaccggccgctgctcttgccctgcacaccctgccctcctgtgttcagcacaccaccggcctcagaaccttggtgcagagcctccagtgcccgctaagtcccggaggacgctctcttgcccttggctcgtttctcagctgaccccgtcgcccccaccctccaccctccctactgctgttcccttaacctgcctcctcagttgctttgctgccatttttcctggctgtggtcagtctccctgctaggacggcagtccctgggcctgaaatgagacccgcctgggtttctgttgtgaccagcaaggcccagagtcagacgcatgaggtgttctccccagatcccagaactgctggtcccaggggctcagggtgggcggctggggctcagggtgggcggctggggctcaggatggacggctggggctcaaggtgggtggcttgggctcagggtgggcggttggggctcagggtgggcggctggggctcagggtggacggctggggctcagggtggatggctggggcttagggtggacggctggggcccaggggctcagggtgggtggctggggctcagggtggacaactggggctcagggtggacagctggggctcagggtggacaactggggctcagggtggacagctggggctggcgctgtcctcccttttgcctggaggcatctggttacctctgccttaagtgttttcttcctcagccgtcaggcacatgcccaaccttgggcggcctccccccgctccccgccccagagccagggcaaggggccgagtgaagggctgctccatcccaggctcggtagaaaccgtgtgtgcggggggggatgcaggcgtttctgggacactgaggaagtgaaggcttttatctctttccacagaggcccaggggttagtttccccacttccttcacattcgaagaaaacttctgaacgctggctgctcgctgcctgtggccgagtggcgtgtccaccttcccgccgcacaggtggccctggtgaagtaacacctttcctgtctcggttgcaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 37892 - DNA, 65080 bp, Homo sapiens
agcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggtgaggagttgcgcgtggctttggggagagggctgtcgcccgcgggaggttactagtcgccgctcgagagccggccaggcgggatccccttcccctgcgggacaggggcatgggcacaagctctggctggggcgctctcggatcgagggtccgaaggagggctgcgagctggtgggagtgcccgcgacctggcggggttggtgcctgggggaggggtgcagcgcggagctacgggtcgccccgaggctcagccgtggggaccgcggacgcgcttagcctaggtctggcctcattcatttcactcgcgcgggcttctgggccaggcggcctaaggttctggtcccggcgctgccccttactccgtgtgaggttttgggcagattgtccttctttgtgctgtagtttcccattcagtgaaaggggcaaagaaaaccctcacttctctctgggagcctggagcataagttctcaagtgacactctaggtgcaaacttgcagtcggccacgtattcattgtgtaacccaaagcaggttacttaacccctctacacctcagtttctcatctgtaaaataagttagtcaaattagtcacgttatctgcctcgttgagttgctttattaagtgaaataatcttcgtgcttagtttagaacagtgcatggccctaggtaagaactaagttaactgcattggaagttactgagtagacgctgtgcagggtggaatttcatgtagcctcatcgtaactttggaagcatgtactcttgttactaccatttgacagatgagaagttggaatcccacggaagggaacttacttgcccagggtgacacatgaatgagtcagtggctcaccgtttcattatttgagaagttcaggatagtaaagtggttaaaagcagactttggattcaaattgcctgaagtttgattttcagtgatgtgtcctagggcaggtaactacttctgagccttactttcctggtctgtgaaatgcagaaaatagccaccttgcttagatgttgtgaggatttaatgatttggtgtgtgcaaagcacagcatagcgtgggcatacctaacatattaagtgctcaacttttagtcagaaaagttactgctctcgttaacatggagtgagaagattaggattctgacacaggtgctgttttaggggaatttacggtctaggtgggaaaatgctagtcgcagccattcactagatcttcatatattgggtacccgcctgtgcacaaggcattggggattcagcattagtatcttgactccgctctctcttaggtctttctgtccattagcagtttctgataggctttgactttgaattctagccagactaactctcatcacttctcatcatgttcactgctgttgccctggtttgggccaccatcatcttctggcttggattatggcggtagtctcccaactggtgtcccctgctctgtccttgcacctgcatggtctgttctccacacagtattgtttattctcaacacagtaataccattagagtgtaagtcaaatcactcctctgcttagaactttccagtggtctccagccgggtgcggtagctcacgcctgtaatcccagcactttgggaggctgaggcgggcggatcacgaggtcaagagatcaagaccatcctggccaacatggtgaaaccccgtctctactaaaaagacaaaaattagctgggcatggtggcacgtgcctgtagtcctagctacttgggaggctgaggcaggagaatcgcttgaacccgggaggcggaggctgcagtgagccgagatcgcgccactgcactccagcctggcaacagagcgagactctgtctaaaaaaaaaaaaaagaactttccagtggcttccactacggtggtatacaaggccctctggatttgtcctctgctacctctgttacctcatctacttcttaccctttgcttattccactcaagctgtactgtccttgctgatctcaaaaaacactgtatgtgtacatactcctgattcagaatgtttgcatttggtttttcttttcttttttttttttttttttgagacagagccccaggctggagtgcagtggcacgatctcagctcactgcccactctgcttcccagatcaagtgattctcgtgcttcagcctccctagtagctgggattacaggccaagtcaccatgtgcggctcatgttttgtatttttagtagacatggggtttcaccatgttggccaggtttgtcttgaactcccgacctcaggtgatccccctgccttggcctcccaaagtgctggggttagaggtgtgagccactgcgcctggccatattgggtttttcttcttagcatagtttcccaccagatatctttatgacttgcttcttcttcagatctgtactcaatatgtttatttcttagtccttcatagactaccgtatttaaaatgcagcccttcccaaatatctcttctgtactttatttttttccatagcacttactttgtaatgtgataaataatgttatttcatgtgatgtcttttgtcactagaatagaagctctttgagggtgggagttttgtttcttttgtttcctgctgtatttttaacacctaaagtagtgtgtggcacatagtagctcagtatacatttgatgaatacaccacgtgatagattttttctttttttaatttaattttatttatttatttttatttttttgagatggagtctcactctgtcacccaggctggagtgcagtggtgcgatctcggctcactgcaacttccgcctcctgggtttaagtgattctcctgcctcagcctcccaagtagtttggattacaggcacccaccatcacacctggctaatttttgtctttttagtagagacagggtttcaccatgttggccaggctggtcttgaactcctgacttcaagtgatccgcccacctcggcctcccaaagtgctgggattacaggcgtgagctactgtgcccagctgtcttttatttttttgagacagggtctctctttctcacccagggtggagtgccatggtgtgatctcagctcactgcagtctcaacctcctgggctcaagtgatcctcctacctccgcctcccgagtagctgggactacaggcacacgccaccatgcctggctaatttttgtattttcttttttgtagagaaagggtttcgccatgtcgcctggtctagtcttgaactcctgggctcaagcatccgcctgcctcagcctccccaagtgttgggattacagaagtgagccagtgccgctggccaatagtgccttttttcaaggattctagttcaagcttaatttaacactaaaggcaaaggatttagggccactcatgttagcctagtgattatttgttactgctgttacttgggtgccagacaatgcactttatcaagaagcagcccattcaaaagtgttttttgttttgtttttttaaataaatgaagtagaaatgtaccactcctgcagcttcctgtcccctggggcatcatagatggggattaatttttcttttcatttattcagcaaatatttattcagtaactatgtgccaggcagtgtgcaagacttggaaatactgggatgaacaaaagaagcagtctttatcctcatggaacttacagtttagcagagaaatcagacattacgctgttaaagttgtagaaaatcccacagagaagtacagattgctatgagtggatataagcacaacaataataatagtagtagaagtagtagctaacattgatatagcatttgttatgtgccagtcattattctaagatttttttttttttgagacggagttttgctcttgtcactcaggttggcaacaatggcgcattctcagctctctgcaacctcttgtctcccaggttcaagcgattctcctgcctcagcctcccaagtagctgggattacaggcacctgccaccacacccagctaatttttttgtatttttagtagaggcggggtttcaccatgttggccaggctggcctcaaattcctgacctcaggtgatccacctgcctcggcctcccaaagtgctggcccggccagatctttctgtattaactcgtgtaattgtacctgaggtagatactattatcactttacactttaggaaactgaggcaccagctggttgaataactgccaagggcacattgctaataaatggcagaggtgtgatttaagcctggccccagagtctgggttcttccttacattattgtactggggaactaatcctagggagagctgcttaaggaagaggtgcttgagctgaattctgaaagtaaaaattaagccaagttgaggtaaaaacatggaaaaatgctgagcaggaaagaacctggcttcttagaggacagagaagaagccagagagcaacagatagcgggaagcgcgagggaggagatctggttgagaggctggcaaggtgtgaggattcaggattgggtttgtccttagaggcagaggacttacagacatctttcagatgggaatagtaggataaggcctgtgctttagatgcttggaggctgctgggaggactgtccttccaccagttgaagagcaggctccctgccttcccaaggcttctcctcaggttaaacccctggattccctcgcccttccccatgtgatttggttcccagatcttggtgtgcatcatcattgggactgtgtatagcaccttggaagagtgtagagtgtactgaatggttgtttccccccaaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaaggtaaggctgcttttgtcctggtggtcagggtggttcaggagaaccttcatcccctcactatattcctttggggtagttcaaaactaactcttgctcatttgaggataaccaaggttaatccaatataagaaatatttggccaggcgtggtgactcacgcctgtaatgccagcactttgggaggtctaggcaggtggatcacgaggtcaggagttcgagaccagcctggccagtgcagtgaaaccctgactctgctaaaaatagaaaaaattagctgggtgtggtggtgcatgcctgtaatcccagctactcaggaggctgaggcaggagaatcgtgtgaacccaggaggcagaggttgcagtgagctgagatcccgccattgcactccagcccaggcaacagtgtgagactcagtctcaaaaaaagaagtttatttcagtttgacagatctgtttttgtttttgtttttttgcctaatgtatgttaaggatcataccagatcagttatttttagtgggatgtcaagaagagcaagcatagatcatctagaaacttttacttcagctctgggagtgagactgtccaataacacatgtacttactaagtgcccccctatgtgtgtggctaataataagggaattcaaggtggaaggcactcacatgtattaaataatggtagtcactacatcaggcaattttgatacatgtttttggacttctggtgaggaaaatgcattatgattaaaacctttcctggattcgggacagtctttttttttttttttttgagacagagtctggctcacccaggctagagtgcagtggcatgatcatggctcactgcagtctctgtctcctgggctcaagccatccacctcagcttccctagtagctgggactacaggtgtgcaccaccatgcctggcaatttttgtattttttcgttagagatggggttttgccatgttgcccaggctggtcttaaactcctgggctcaagtgatccacctgcctcagcctcccaaagtgttgagattacaggtgtgagccaccacctgaccaggaacagtcttaaagtgaatttacattttattcattatagtagtatggacaactagactaaacaattttcctttgccaagtttctcatatctgccttagttttctttgactgaagaacaaattaccataaatgtaggggcttaaaacaccaccgacttattggcttatatggcttatagttctttattttattttatttaagagagggtctcactgtgttgcccaggctggagtgcagtggctattcacaggcatgattatagcacactataacctcgaactcctgggctcaagtgatcctcctgtctcagcttcctgagtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatggtgagtccttactcttcaattctctctgacttcctcttcagccaccagccagagaaaactgctattaaagggttcacctgtttgggtcagcccacctggataatctctgaattgtaaggtcagctgacttggggctttaattatacctgcaaaatcactttataacagttcctaaatttgtgtttaaatgaataatcagtggatggaaatccagggggaggagtatgaatgtctttagaattctgcctaccatttcttgtattagcatggaaatgactccaaatctgtagggactttaggcatacactactgcacctggcttgctggatggagtgtcttcaagcaaatatcagacatattgttgtacttgtatctcttattctatttatttatttattttgtagagatgaggtctcgctatgttgcctaggctggtgtcatgaactgacctcaagcaatcctcctgccacggcctctcaaagtgttgggattacaggcatgagccattgtgcctgaccaacagtaattctttaatgtcatttaattctcagtctatgttcagttatcttgagttatctcaaaagtgttttttacagttagttggcttaaatcaggatctaaagaaggtctacacattccattttttgctggtatctcttaagactcttttcaccgataatagttcccattccctcttttctccccataccatttatttgtggaataagtcaggtcatttgtcctggaatattttccacattctgcctttgattaattgtatcttcatgatgtttttgaacatatttccctatcctttgtatccctgtaaactgatagttagctcttgaggctaaattatattcagggttggttttcttggtgaaaatatttcacaggtggtgctgtggacttcctattaatagatacataatatctggttatttcacttttagtgatgatgaagttgtaaattaaggtgttgtcagactaatctatcgcttataaatagtatatagtagggatttgttttttcatccagtctgataatttctaccttttgattggggagtttattccatttatttttttattttgattctttttttatgtttaagatcaatcatttggcggggcgcggtggctcaagcctgtaatcccagcactttgggaggccgaggcgggcggatcacgaggtcaggagatcgagaccatcccggctaaaacggtgaaacaccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagatcaatcatttatgtttaattatattgttgggtttacatctgtcatcttgttatttgtttcctattggcttacctgtttttccctctcttttcctgtcttatttttatattttattttgttttattttatttttttgagacagggtctcactcttgtcacccaggctggagtgcagtggtgtgatctctgctcactgtgacctctgcctcccgggttcaagtgatcctcccatctcagcctcctaagtagctgggattacagacgcgcaccaccatgcctggctaattttttgtattttttggtagagatggggtttcaccatgttggccaggctggtcttgaactcctgacctcaagtgatttgccctcctcggcctcccaaaatgctgggattacacgcgtgagccactgcgcccagccccttgattatttttaaatattctgttttatatcttctattgactgttcagatctaatttttttttagtgtttgtctagttttgtttagagattttaatatgcatccttaatttctcacggtatatcttgaattattattttgccatgtcacaaatagtaaaagaaccctataactgtatttgcatttaaactctcatcatttctgctatcattgtcatactttttgtttgtttgtttttgtttttgagatgaaggcttactctgttgccaagctggagtgcagtggcgcgatcttggcccactgcaacctccgcctgctgggttcaagcgattcccctgcctcagcctcctataggtgcacgccaccacacccagctgattttttgtattttggtagagacgaggtttcactatgttggccaggatagtctccatctcctgaccttgtgatctgcccgtcttggcctcccaaagtgctgggattacaggtgtgagccaccgcgcccggcccattgtcgtactttttaaccttctttcaaggatcccagcctttgctgtctgttgttcagtgtctcaatttcatatatttcatacagttttatagttatttttggtaggaagggaagttcaatatatttaattctgtcaagggcagaattgatagtcccaattggtgtctttttttttttttctgagacaaggcctcgctctgttgcccaggttggagtgcagtggtgcgatcatggttcactgcagcctcaaacttctggactcaggtgatccttcacctctgcccctcgagtagctgggactacagtcacctgtcaccatgcctagctaaattttttttttttttaatatttgtagagacggtgttgccatgttgcccagggttgtctcaaactcctcgggtcaagccatcctcctgcctctgcctcccaaagtgctgggattatggacatgaaccactgtgcccagcctccaattgatgtctttttttgttgtttgtttgacatggagtcttactgtcatccgggctggagtgcagttttgtagtcttagctcactgcaacctccgcctcgtaggttcaagtgatcctccagcctcagcctcccaagtagctgggactacaggcattctccaccacgcctggctaatttttgtgttttttggtagtgacaggattttgccatgttggccaggctggtcctgaactcttgacctcaggtgatccacccgccttggcctcccaaagtgctgggattataggtgtgagccacccctctcagcaattgatatctttcaatccatttcaattgttatcctttttggtgctcaaaatgttccatttttgccaatgggccaaactgtgtgtgtgtatgtgtgtgtgtgtgtgtgtgtgtgtgtgtgtgtgtgtgaacatccattcatttacacattgggtacaactggttttcagtttaactgtagagttaaatagttactagactggccagaaagcctaaagtatttaccaactggtcctttacagaaaaagtttgctaatcgcagctatatgagatccagcttactcaaattttttcctgacaaccagctctccgtttctgcccaatgttttcttcctgtgtgtgactctattaaagatacagacgtttcctcatgattacactcttataaaccctaaaggtgaatgtacctcctgataaaattagttctgctcaaaagtaagagtatacccatcagagtcagttaactcaagcttttaattctggctccacctctctgcaaagggagttatgaagcctacctcactgaatcattgtaagaagaaagtgaaattacagtatgcccctcaaaggaaatggtagctattatcgttcttacattgaaaaggtttgcttctatttatactttgtttaggtgagttcagacaatgcctggcacagacactgtattcgcagtgccttttgtagtgatgcttcgtacttctgctctggtttttggtgatgtctttagaggccctggggagagagaaagagcaaattgactagaggttttgtattgtgaggtataggagataacattgaaatagtaatgttaacctctggcaggatttgaatgcaggatgaaaagtttctcctgaaggttttcaaacttttgtggaaccacaggattcggtgtagggggtcacggaggaatgaggtgctcccacttcatccagagcatgtcttttgatctgtgtcgtgatttggagttctataggagatttaggttgaacacatacccccaaagctattctctgccatcatcacaagtttgcgggatgttggttagggctgaagatgtagattgagaggcatccggccagctgccatgcagtgtgacttgggataattacatgattgggctggctgtggctttatgtttacaatacagacgctgaagtcagagtggttgccttcaaggtgttaacttcaaaacttcacacctgagtcacctgtgcagcttatttaacctttcaaaattgttgttctgtcatcggtaagatggagataataatactcagctcacagataatgtgtgcagggtagttagcacgttgatggcatgtggtaatacgtagtattacccttatgagtagtatgactatatataaatagtagtagcagttggtacacattgattgacatttttttttcagactgtcatcctcactgcttagcatacatctgacacacgggtgtctaacaaatatttgaactgtagactttagctcaatcaaaatgggagctctctaaatgtgcctgctaatcagaaaataaataggttaatcacatactccattctaattgcttatgaaatgtgctgtgttgattaggtggtgtgtgcattataagtaatggaagaaagggagttgtatgcatgtttcagagctgttgaatttcctcattagatgtgcaaactacataaatccattgagagatttatgtcattactgtcacttccgtgtagcggtgcatgtcctgctcagctgttgctgccttcagctcagtagagagaactccctgggctcccctagatacactgttgcctattctcacagatcgatatatttggagagattttggttattatctcgtaagaggttttagcagcaaaactgggagaaatggggtttaatgagaatagaaactatggagacagcagtgtggaatgagagttgattttaggtgttataaagtgtgagcatcggctgggtgcggtgtctcaggcctgtaatctcagcactttgggaggctgaggttggtggatcccttgaggtcaggagttcgagaccagcctggccaacacggcaaaaccctgtctttactaaaaatacagaagttagctgggcgtggtgggcatgcctgtaatcccagctactcgggaggccgaggcaggagaattgcttgaacccagaggcagaggttttgcagtgagctgagactgtgctgctacactctagcctgggtgacagagcgagaccctgtctcaaaaaaaaggccaggcgcggtggctcacacgtgtaatcccagtactttggggatgccgaggcaggcggatcacgaggtcaggcaatcaagaccatcctggctaatacagtgaaaccccgtctctactaaaaatacaaaaaaattagctgggcgtggtggcgggtgcctgtagtcccagctactttttttttttttgagactctgtctcaaaagaaagaaagagtgagcatttttcatttgagttatatttatataaaacataagcatgtcagaaaggtgattttacagatatcattatttagctttttacaagattaagaacatgctgggcacagtggcttatgcctgtaattccagcactttgggaggctggggtgggaggatcacttgaggtcaggagttggagactagcctgggcaacatagtgagacacccgccccccacccccgatttctgcaaaaagtaaaattagatgggcatggtggcatgcacctctagtcctagctatttaggtggctgaggcagaaaggcagggatattgcttgagcccaggagtttaaggctgcagttagctgtgatggcaccactgcagtccagcctgggcaacaaagcaagaccctgtctcaaagaaaccaaattactttaaaaaaatgcctcccttataaagcgttgtgagcattaaatgagataataagtgtaaagtgcttagtgtagtgcctggcacatgatgagtgcatatagtagtaagtatatttgtttgtgggtcaggcactagttcattcctggggatagcagagaatgaggcaatccttcacgcagtaatcatttatggagcatctgctgtgtgccagacattgtgctaagtgcagagaagacaagagagctcattatccattgagagtaccataatacagtgctaagtgccaagaggcagacaggctgtttgtggaaagtaccatgggagtccagcagagggagccggcactcaccctgtctgccaagaaagccacaatcttgcactggagtgctgccatctgtgctggctgctgcaggcttcatttggtcactcagcaaatatatagtgagtttctgctgtgcactaggtatagtgctaggcactggggatttactcttgagccataaagagggagagggcccctgcactcttaagaatatgttgtctaatagctgagacaggcattaatcatgtaatcaaatacatgcacgaatatttgcaacaatggtaagttttatgaaggggagatatgtgctgttataaataggggattttataggggtagaataggggactttgatttgccaggaaaggctttcctgaggaaatctccgaatttaaatctcattgtgggctgagtgtgttggctcacacctataatcctagcactttggaaggctgaggcaggaggattgcctgaagccaggagtctgaaaccagcctgggcaacaaaatgagaccctgtctctacaaaaagtaaaaaaaaattatctggtgtagtggtgtgtgcctgtagtcccaactactcaggaggctgaggatggaggatcgctggagcccaggagttggaggctgcagtgagctacgatcatgccactgcactccagcctgtgtgagagggcaagaccctgtctcaaaacaaaaacaaaacaaaccccaaacccaaaactcaaacctctctgcatcaccctaatctcactctactccttaagggcagggactttgtctattttatttgttgtgtatccccagttcctagaacagcacctggcatgtggtaggcactgaagtgaaggaagatgtgattgatctgaattctaaagggagaggaggagttaactgtgagacgaaggagagaagggacttcaggcagaggaaacagcctgtgcggaggatagagagcaggttacatttgagattgaaaggaggaggtgtgtggaacagagtgggagggagggagaggagtgaggcaggctggggccaagccatagtgccttggcccacataggaagagttctgatctgtttccaatgagcaatatattttaaatagctagtatcgtgattcaccttgcattttggaaagacttctctcttgctttttggaagacagactatagcagggggctacagggcaagattgaatgcaggaggggtacaaaagataatgcctggactttctgcttctgctgcatggatgggtagttgggccattccatgagatagcaacacaggaagacaatgaggtttgtctgggaaagatcacgaatttggtctttaccatggtgagcttgaaatacctttgagtcatgtaagtggctgttgagagaagtctgggctggaggtacgggtctgagaattatctgcatagaattttgggatgaagccatgggcatggatgggatggcctagggaggcagggggtggtgggatgagagccaggcctaggagctgagaaacagcaggagagctcaaaactgagggaggagctgccagagaagtaggagacccagcagggtgcggtggcatcccagaaggctacgggcgcgcatgtttcccagtgaggacgtgatcggtctgtccattgttgaggagtgagcactggaaaatgtcctctgcttcgacaatttggaggttgccactggcctgctgggggcagaagccaaattggaatgagtggaggtgaggacatgaagactggagcagtgtggctgtgtgggaagagagaaggtggcactggaggggagagaagggttgagggaaattgttgttgttgttgttgttgttgtttgaaagtttcgctcttgtcacccaggctggagtgctgtggctcgatctcggctcactgcaacctccgcctcccaggttcaagcgattcttctacctcagcctcccaagtagctgggactacaggtgcacacccccacgcctggctaatttttgtatttttagtagagatggagtttcaccatgttggtcaggctggtctcgaactcctgacctcaggtgatccacccgcctcagcctcccaaagtgctgggatcacaggcgtgagccatcacgcccagccaggaagttgtattttaaaataagtcttgagttttgttaatacattataggagaagttgaattgacgaggtaatgggcttccagatggagagacagggtgtacaaagcctggaggcttccaagtgcttgttgtgctttggggcagtgaggtgcttgtgcaactggagcagagatgggtggggaagtgcagtaggaagcacctggggaaaagcgggcctggttagaaagggtctggcgtggggccccagccagtgtgtgcctgggcagcacatcacagtaacaaagtctgaagagatgacaaagcacagtctgagaggcagccagagtagcggggagctgtttatggaggaaataggggaggggagggcagatgagagagatttgcggtcttttctataggcctccgtatttgattaggttcagggagttgtaggggaaaacctatgatggaagaaagcactggtgttctttgctcaagagggtgtttgattaattggggtattagcacagaaagttggaagcaagcagatcgggggtggacatttagggggcagttttcagccttcagtcgggaagatgagtctagaacgttggagggcagctggagtcagagtttccagtcccccgacagtagctggctgaagcctcagcactgggtgggctcactgagcaggctgagcatgttctgggaggtgtccctgcttctgctgctgtgtaaactccgccgtcaacatcttgggctttgaagccactgaacgccggactggtttaccttgatttgtctttgcaaagtgtaggaatgatgcttgtcttactccagaatagattgtttttagtgggctcttgagaagtggaggttttatagctcagacaccagagccaggctcttctggagccagggaattctagttcccctagttaaaagctgagtgactttggacaagttactttgcctttataatgcctcagttttcttacctgtaaacttaaggtgataagagtgcctgatccatgagatagattggggattaaatgagaaatgcacataaagcacttagaacagcgtttgacacattttaagtgctcagaaagaggtaatgatagaggtagaagtagaggtagtcattgttttggggtctccagtgttgtcgttccattgttaaagcaccagatggcgacaaagcacacattttcagctgccttgcattcccctgcttggactccttgagtagctttacttattctcttcagatccctaattgatgcaaagtgaagtattttgtttgtttcctttctctctctggcttctttaaaacttctggttgaaactcatttgttttgagactcttatttaaatttcattcataaaattaaaaaaatgctttggttggagtagcatgtacacacagtaaaacattggacaatacaaaatagctgttagtgaaaggcagcgtgctgcccttgccctccaccctgtcctactctccaggagcaccccgcgctttttttttttggtgggagaggagtctcactctgtcgtccaggctggagtgcagtggcacgatctcggctcactgcaacctctgcctcccgggttcaagggattctcctgcttcagcctcctgagtagctggaactacaggtgagcgccaccgtgcctagtctcccccccacctttttttttttgagacggagtctcgctctgtcgcccaggctggagtgcagtggcacgatcttggctcactgcaagctctgcctcccgggttcacatcagtctcccgcctcaagcctcccgagtagctgggactacaggtgcccaccaccacgcccagctaattttgtttttgtgtttttagtagagatggggtttcaccgtgttagccaggatggtctcgatctcctgaccttgtgatctgctcgccttgacctcccaaagtgctggtattacaggtgtgagccaccgcgcccagcctttttcttttttttgagacaggatgttgccctgccacccatgccagactgcagtggtgtaatcacagctcactgcagcctcaaacgattctccaacctcaccttcataaagtgttaggattacaggcgtgagccactgtgcccagccagcacccacttttaactgttattattaccacatctttttgaatagctgaattttatattacttcagccaaaatattggcagtctattgatttgatactgtttcttggagtcgaggagagtcgtagtagcgggggcttggcgattttgtgatgtgtttcctttgtgccagtcactgtgatgggcatttggcaaagtccctgatcttgggccactagtcactgggggaactagtaagtgcagtgtggtacgtgctttgggggagcacttgagagggtggatacctggcctctcctgggaggactgtcaggaagaggtgaacatctgagcagagttgaagataggacctggtttggcaggcaggaaggacaaggaaaaggtgctcccggcagggtgggtagcagggtcaaacacgtcaaatggcgagagcgtggtatagctgcaggaggctagagggtaagattttggagttggagttagggctatggtgatgcaggcagcatggagagggagggtcagtcttgagggcatttcatgctgtgtcagaagttggatcttgtctgagaaaaacagggaaccactgaagggttttaaaggtaaagcaacacggttacacttgtattttgtgaagatcagtcttgaagcagtgtgcagaatggattgcatggctttagaccgcttaggagatgactgactgggacaatgtaggtgagaaatggcaagggcctgctgtaaggcagtgacagaaaccagaggcgggactgggcctgagaaatgaaaaagaggtagacttgataggcttggagggtggggaaaagtcaaggatggttcccatgtttctggtttgggttgctggatgcatggtattacctgtgcatgagctgggaagtcctggtgaagaaatagaaggttttaagctcattttcttttttatttttatttttttgggggactgggtctcgctctgtctcccagactggagtgtagtggcatgaacatggctcactgcagcctcaacttcaagcagtcctcctacctcagcctcccaggtagctgggaccacaggcatgcgccacctgctctgctactttttgaattttttgtggagatggggtcttaccatgttacccaggctggtctcaactcctgagctcaagcagtcctgcctcagcctcccaaaggcctgggattacagatgtgagccactgcacccagcgttaagctcattttagatttgttgagcctgacttggccttggtgacatctaagtggagatgccagtaaagttggaatcagaagagactgccacttggtagctttgtcaccttcatcaggttacttgccaatttggagccccagtttctttttcaggtaaatggggatagtgataatctctaccaaaggatcatgttgttaaaaggaagagcttcctaaatacccagcacagtccatggccagacaggtgatccgggaagtggtttccttctttcctttctaaggttcggaaggactcaagcgccttcaggcttattgctctttgtacgaagtgagcaattttgggtaataccgtgtcctatggaaagtaactacttaactaaattcatgtagctcattccttaagccatctataatggctgagaatgttatctaaaaacgcctttgcttttcctggttcactacatgtgtcaccacttaacattgacttttccccactgtgtagaaagcatgtacctacatcagatctaaccttgatcccagcaatgtggattccctcttctacgctgcccaggccagccaggccctctcaggatgtgaggtgagtccgggttcctacgctgacaatgactttaactatttaaagtacatttttaaaggggaggagtcatgtcaaacatcctttttttaattatgagagtccattattgtgagtgggaattccattcctgtgattttttttttccttaagaaagtatagtttatgtttctcctaagtttttacttttcaagggttttaaataacctttttgtacagtttttgcttttcttctggtaggtcttgattttttcctttccatctgcctttaacacgtaaaaatgttcaaagtgtacccccacacgaggtttctggaagtcattttgttgaacataggagaaccatataagtagaaaggtaacttgtcagcatcttttcacatgggagtgttgtaccgaagttttgcaaacatttcatcctggtgtctggggattagagggggatgagcatgtgcgaggcggaggtgactttggcagctgctccgcattctgtctttgccatgcctgccacaaattgccaagacctgttctaaaactctgtgtctgccaattctttcttagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatccagttgccttgtgcggttggagggctagagcaagggcagataactgagaaggagccacgtgcatgtcttgttgaggcttggctagggcaggatgacatgttggcagtggaggctctgcaaagtgggggctctcaggatccctggaagttgtgaaagacagcatctggtgggtgaggtggttgctcagagggtggagtattctaggaatcagactctactactctgcaaaaggcttaggtgaaggagaagcacctttcctatttgttataaatggaaatattgtaacttcagggtgttttttgctaagctcttaagtgataatatatgtagttttaaatttttatttatttagagacaggatctcactctgtcacccaggctgaagtgcaatggtatgatcaaactcactgcagccttgaactctgggctcaagtgattttcctacctcagcctcccgagtagctggactacaggtgcaaactaccacgcctagctaatttttttttttttttgagacgtggtcttactctgttacccaggctagagtgcagtgacgcgatctcagttcactgcaacctccgcctcccgggttcaagcagttctcctgcctcagcgtcttcagtggctgggattacaggcgcgccaccacgcctggccaatttttgtatttttagtagagacagggtttcaccatgttggccaggtcttgaactcctgacctcaagcaatctacctgccttggcctcccaaagtgctgggattacaggcgtgagccacagcgcccggctgcccagctaatttttttagtttttagtggagatggggcctgtctgtgttgtccaggccggttgtaatttttttttttttaacacttaaactgctcctttaaaacaatattttttttgtcattttatttgtgttcaccgtttcactgcaaaccctgaaggagggtgtggagcaccgttctggaatcccgttcgttgtttagcaagaggttggtgataccaaatccccctttcaaaacagtgagattgtttcccaggtttttttgtttgttttttgtttttttgctgacaaccagattttctgtaaacttaaagctttgttaaggacagggttcacaggcaattgacattccctctctgtccctcctcacaccctccctatattcacatggtcaatcatcagtgactctagggctgacattttgtacacactttgtccagtgcttggcccttttgggcctttgatttcaggtgacatattttgatatctgcttttaatccctcatggggaatgcttctccagtcaccatcatctcatgccatgatgccactgttagtgcctgtgccttactttgatgctaccttctacaaaaaaaattcccatttccttccaagcagaagggaaaatccccttcctcaaaaccccagaaccccaggaagaagtacaagggaagtacgtccactttggagtcagacagacttaggtttgaacaccagctatttcattccttgtgtctgactttggccaaatttctaacttctctgagccttgcctttaaaatgaaacccataattcttacatcaaagcaactgacaggattaaatgagataataggtgtgaagaccctagcgcagtgcctggttcttggtgggcgtgtaggaaacggagttccttttctggaccatttgtttgttaggtccctaacaaacaggtcccccttcttagagagtttgttacttccttcgttgttgttatttgtatgttaggtcataagcttttttttttttttttttgagacagggtctcactgtgtcatctaggctgcagtgcaatgcgatcatatttaaagctcactacaacctcaaactcttgggcgtgagcgattctcccaccttagccttctgagtagctgggactataatcacatgccaccacacccagccataagctttacttgcagtgcttagagagcctggcacatggtctgtacccaacggagttaataaaggatgaaactatacttttgtgtttctgttgtcttgtagaaagctcataggtaggaagaacatacgctttggagcagaaagaactgtgttcaaatccattcttctactcaacctctgtgaccatgagtgggttgtttagcccgcctaaacctcagtgttctcatatgcaaacctggagaatgtctcgtagggtcattgtgaaatccaactggtaggttgccttatattactactaatttgcgctattaaaggcaagctgatataaattagaactcttctgaatgggccttctatatttaaatgggctttttctaggaagtgtatatttgtaaacttgtcttgaatggaaaaaaagaaaatacttgtagatttgaatgaaccacctgagaagatctcattgtagtctgtcataaatcaatttctctgaatcatctgctatatattagcaagataagatctgctttcttagtgttcgaatacagtactatgctccagagaaaaagaaattgctggctggggaataagtaattaaagccagtgacaaaactttctaaaactcagtggattaatttcattctaaaacttctgaggttgttaccagcacggcactctctcattccaaagagaaaaaaatgatatcttaattgagaagttctttctaggctatcttaactgccttttctgagcacagcgtttatcacgggcagatgtgtgatttttgtcttgtttggaaattcaggtttcattttctcaagtgtatgataacagcaagcatcccataggtgtcgttgaatactctggggcttgtctctctgtaaattgcgactctgctgttttccaacttgtcatcttaatggaatgagtttcccatggagagaatctaaattgttatgttcttgacataagcagacagattcttgctctacattccctgacatattgacttgataagtggtggttttacacaagggcccagtcatctcttaggaattaggaaaccattcggggtggaagcagcaatctgtttaaccaccagggggcctctcctctcccagtttcacccagaaaagcaccatttatattttccaaattatctgtattaagataatagaatctaataagtcttacatgtatacatctatcatgttccatcttaaaaagcttatcttccagaattatagataaaaatatatgaataagccataaaaaagaatgaagtgcagatacgtgctacaacatggatgagccttgaaaacattctgttgagtgaaagaagccagacataaaaggacacagattgtatgattccatttctatgaaatagcagaataggcaaatccgtagagatagaacatagattgctggttgctgagggctaaggggagacacaatggggagaaactgctcggtgggttttatctattttttttggagacagggtctcactctgtcacttaggctgagtgcggtggtgcaatcacagctcactgaagcctcaacctccctagctcaagtgatcctcctacctcagcctcctgagtacctgggactataggcatgtgccaccatgcccagctaatatttaaattttttgtaaagatgaggtctcactgtattgcccaggctggtttcgaacccccaggcttaagtgatcctcctgcctcggcctcccaaagtattgggattacaggtgtgagccaccgtgctcaaccaatgggttttattttagactgatggaaatatttgggaactagacaggtggtagttgcacaacattgtgaatgtagtaagcacccctgaattgtttgctttttaaaatggttaattttatgtgaattttgcttcaatctttttttttttttttttttttttctgagacagggtctcactctattgctcaggctggagtgcagtggctcactgcaacctctgcctcctgggcctcagcctcccaagtagttgggactacaagcacacgctaccatacctggctcatttttagtatttttagtagaggtggggtttcaccatcttacccaggctggtcttgaactcctgggctcaaggaatttgcctgcttcagactcccaaaatgctgggattacgggcgtgagccactgcgcccagcccaatgcccacggttcttcttgccagttctgttgcctgggttgccttctcagctgtgatgatcttttccaggttttgtcacatctgtcctaactggattataagtaaactccttaaaggctgagaccaacttgtacttctaaagaacaagagtaggatatttgtgaaagtgtccaagtacgggaaggggtgagtggatgaaacaagacttgccattcattggggttctactctttaccttccagaacagtccaggctctgcagacagcatcccacctgtcccagcaggctgacctgaggagcatcgtggaggagattgaggtgtgaatcttttgccaaatgcatctcccagctcctgtctttgacactctgcagaagaatcttgcagatagccatgcatgatctgttactacaggttacattgcttcttatatccatggcacacttgtgttctttgtattaaggtattgtgtcctgaggaatatttgtgcctattacataataggtcctcaggacgtggtgactgtggtttttattattgctctatccttgcctttgcccagaatatcatgctcctctgggacctctgtcatggactgcctggcaggagtgacaagcagtcctgatggtgttctcactggatgcttcacaggcacgttggttgcctagtcatgttgcctaggagagcagtatgtctctctttgtcttttggagcattaagaaattctgggaaacgctgtgctttgtaggttgtattcaaatggatggccatggactccatctgtgtcatgatgcttcctgggtgcacagcagcctggcccactggctttccacccaaagcagctggcgtgttctgtgccatgactcctgggcttgggcctgcatacaaggggccaaggaaggagccctcccaaaactgcagaagatagtgctctcctcaaatgtctgtttgatatactttactctgcctaagcaccatttttgagaaagtatgaagtgactgagatggtcttcagatttagagtgagagatgtcacgaagctgtctgcagtggggttgacagtggttcgtgcatctcatttctgctgttacttgacatccagcatatttctgttttgttatggcaggaccttgttgctcgcctggatgaactcgggggcgtgtatctccagtttgaagaaggactggaaacaacagcgttatttgtggctgccacctacaagctcatggatcatgtggggactgagccatccattaaggaggtacctatctaacaattttcaggcatgaaacccaaaggggtcatcagctgtatctgctaaggatggcttttatcagagaggaatgttcagacagtaccttgggatgctgtcactcagtgtcctgggttagggattaagaatgagaaatagaaagatgtaatgcctgtcttcaggaaatgggttgctagtgaggtagacgtgtaaacaaaccatgcttgctttaaatggggtatgtacatgtcacgaggtagtatcaaggaagccacgtgtattactcctgtttcatctccctttcttcccagtacccttttctgcttgtcgcctgaatgctttccactctggtggctcattcagatccttctctgggctcacaattgcttctcctcccttcccccttatgctcagcaacggctaaatcttagctaatctttgctgatggacatagttcactgagaggcatgtgtgtctatcacacatccgccaagagttcattctttttctcaagaggaggttgttaacctgaaagaatctttagttggaatgcatgtgggaagcctttttgagtaggaccgtctttgtaccccttgtttgtgagaagttaccagcccttaatctaaagtacttaaaatacaagctgcttttatttaaattttaggaggagagatttgggttttaagtgagaattttcatttctttatgcattatgagttttgtgccaagtttctttaagtaaatagttatctgtcttggataattggaattaatttcatattttctccatgtggtcaaataagttattcatgtgtttgcattctttttgtgtctcttcctttgtcctaagtgtaggaggtctagaaatatactcccttttaatttctgttatgggtgaaattgcaagagtgtggggtcttagggtacagattgtttgctgattgtcctatacacagtaaagtagatgaattaatgatattgtacttatacaacttaaacattttcttcctttatttccaagctgctgctaaccaggtacttggctggagtaatttcgctgtcactgcttttgacaaaacaattctggtgaacagtcacccattttaacgtgtcaacagagtagtgatggaaaattgtaattggtccaattaaagaaaattctttcatgttgactgtgaataacactgtcaggaacaagagagcccttttgttggatggtagattttaaaaaacaaaactgattgaaggggaaaatgtttcctcctaagcaaataacctccagaattttaataatgccttttaggttccacttttttaaaaaattgcttttagttttctcctctaagcagcccattagttcttaatggagagttattttagtttctttttaatgtacattttagctataaagtttggtcttataaataaaaactttgcctcaatgtactacttacaagtaggttgggaggaaaggtagcttagctgggaggataatgagaatcaggaaagaacagattttcttgtagaaggactttggagacaaacagtcctacatttgaatgttggtcttgctaatgttgtggtaacttgcagaagttatttagcctcctttagcctcagtttcattttttgggaaacattgataatagcaatcttttatagtttttgtcaaaatttgagttaatgcatgtaaagcacctatcatgatgcctggcatatatagacattaacaaataattactattatatatatttcataatatagtttcatatctcagtagttatctggaagtaccctgcatttgtgtagtaagcattattatgatttttttttcagacagagtctttctctgtcgcccaggttggagtgcagtggcgcgatcttggctcactgcaacctccacctcctgggttcaagcaattctcgtgcctcagcctcttgagtagatgggattacaggcgcatgccaccatgcctgactaatttttgtatttttagtagagttggggtttttctctatgttagtcaggctggtctcgaactcctgacctcaagggatctacctgccttggtctccaaaagtgctgggattacaggcgtgagccactgcacctggcctgtataataagcacttattaaataactgacaaatcatgaatttcagtttataaaggaagatggaaaaaaaaacaaccacatccaagttctaagtttaaatgcagaatatttgcgttttctccatctacgaatttggatcattgaccaaaagacctcccatgtgaacacccgaaacagataagggtgactttcctctacagcagtggccctcccaccttcccagcagaggaagagaaacagctgcatttcgcatttctttcaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcgggtaagacatccatgcccaaagtgtgcccctctgattatcattcctagtggaaggctttcagaaatctggactatggtcacagccaattacagcccctacaaggacatacccattaaatggagggcaaggctcatttccctgagccttgaaatggagacatgaccactcggtgaactagccacagaacccttcaaatctattaaaaaaatttttttcccctcgtggatttttaatttttgtttctttttttgagacagagtcttgctctgtcacccaggctggaaagcagtggcatgattttggttcactgctgcatccacctcctgggttcaagtgattcttgtgcctcagtctcccaagtagctgggatcacaggcgcacaccaccatgcctagctaatttttgcatttttagtagagatggggttttgccatgttggccaggctggtgttgaactcctagcctcccaaagtgctgagattacaggtatgagccactgtgcctggcctctccctagaggattttaaatagtacaggcttggctgggtactgtggctcacgcctgtaatcccagcactttgggagactgaagcaggcggatcatgaggtgaagagattgagaccatcctggccaacatggtgaaaccccatctctactaagaatacaaaaattagcagggcctggtggtgcgcacctgtagtcccagctactcaggaggctgaggcaggagaatcgcttgaacctgggaggcagaggttgcagtgagccgagactgcaccactgcactccaacctggtgacagagtgagaccctgtctaaaaaaaaaaaaaaaaaaatacaggctttcagtaagtgcaggaatattgcatttctaggtctataactccagatgtatagagaagtcttgcatctaaaatgcacttcccaataccaaactttctttttcatatttttttggttttgttttggttttttttgagacgcggtctcgctatgtcgcgcaggctggagtgccgtggtgcgatcatggcccactgcagcgtaggcttcctccagtacccaaattttctaaatatgttattttacgacagctgttttaattctcaattaattctggtgtttatggttgatcagttctctttttccctggtccttgatgggatatctttttgcctctttatagcacagtcctccctttcactcagcagtaagcatagacttctcctttgtgttaactcgttgaacagagcacatgcacagatcttgaatatgcttagaacttttatctcaaatgaggcgttttgttgctgttgtttggaaccagtgataagctaagatcttcatgagaaattagcattttattaatgtctaagtgttgggtttccacttaggacagttctgtctgtcccattagttctactttggtggcccctgcagatatcctcctgagcgagtaccctgttcttcaaaattgcccattttctccctacatacaactcatataccctcaacaaagacttgggtagaaagtaacctgagtaacatggtttcctgtgagtcaagaggggctaagagaacaaagtggaaaaagaattgactctgaagttaaatagatggtttgagtcctggctcaactgcttaactggccatgtgacctttagcagtcccttaacctcttgtggcttgtttcttcacctgtgcaataaggattattctatctgtgtcgtacaattgataggagaatgtatgtaaagggcctagcctggtatatgcatatagttgactttcaacaaatgatagttattaatattatccatatttctttaattttcccattgctgataccattctaaagtatttttctggctgatttatttattaattttttagtagagacggggtctcactgtattgcccaggctggtcccaaactcctggccttaagtgatcctcccatctcggcctcccaaagtactgcaattacaggcatgagccactgcacccagtctagctgagacatttttttttttctttttcagagacagggtttccctctgttttccaggctggagtatagtggcgcaatcatagctcatgctaactcttgggctcaagcagtcctcctgcctcaacttcctgagtatctgggactacaagcacatgccaccatgcccagctaattttttaatttaaaaaactttttttttttttggtagaaacgaggtcttgccatgttgcccacgctgttcttgaactctttggcatcaagtgatcctcctgactcagcctcccaaagcactgcaattataggcatgagccatcatgcccagtctgataaattcttttaaagattctgtagtagagtggatagaatagggaatcagaaagaaggcaatatattggccaggtgtggtgactcatgcctgtaataattcactttaggattaggcagcaggcccaaggtcagccaagatttcccgaagcaggggatttgctctcctgcagagcttgcaacctatagataaagcaccccagaaacaaaattctctgctcctgtagcctttgttgtaacaaataattttttatttatttccagttgcaagtcaccaatgttctgtctcagcctctgactcaggccactgttaaactagaacatgctaaatctgttgcttccagagccactgtcctccagaagacatccttcacccctgtagggtaagtcctgatcatattttggtggggcgctgacctctttgttttggaaagttagcctgcagccagtgtaacagattaatacattccagttaggtaaatttgatctactggtatcgaaagcctacagtcgaatgtaagaaaatgatttttaaaatgaagattatttggttttactgtttcattctctgtttctagttggctctgtcttgtcattgtgacataagtagctattttgaaatttaatatttattgatttttttctgataaataataatgtttattataggaaaaatacagcaaagcacaaaaaaagaaaatataacttacccataatgctaccattcagagataacttttgctaactttttttttttttttttttgaggcggagttttgctcttgttgcccaggctggagtgcaatggtgcaatctcagctcaccgcaacgtctgcctcctggattctagcgattctcctgcctcaatctcccaagtagctgggattacaggtgcccgccaccacgtccggctaattttttgtatttttagtagagacagggtttccccatgttggccaggctggtttcgaactcctgacctcaggtggtccacctgcctcggcctccctaagtgctgaggttacaggcatgagccactgtgcctggccttgctaacattttataatttttttttgacagtcttttttctatgtatgtaaataaattttaaaaattcagttaagggccaggcatggggctcatacctgtaaccccagcactttaggagactgaggcagatggattgcttgagcctaggagtttgagaccagcctgggcaacatagcaggaccccatctgtaatttttatttatttatctatttattttttgagatggagtcttcctctgtcacccaggctggagtgcagtggtgtgatctcggctcactgcaacctccacctcccggcttcaagcaattctcctgccttagcttcccgagtagctgggattacaggtgtgtgacactacgcctggctaatttttgtatttttggtagaggcagggtttcaccatgttgaccaggctggtcttgaactcctgacctcaagtgatccacccacctcggcctcccaaagtgctgggattacaggcgtgagccattgtgcccggcctttttttaaattagagatgggggccaggtgtggcagctcacgcctgtaatcccagcactttgggggggccaaggtgggcggatcacttgaggtcaggagctcgagaacagcctggccaacatggcgaaaccccatctctactaaaaatacaaaaaaattagccagacgtggtggtgcacgcctgtattcccagctactccggaggctgaggcaagagaatcacttgaacccaggcagcggaggttggcagtgagctgagaacgcgccattgcactccagcctgggcgacagagcgaggctccatctctattaaaaaaaaaaaaaaaaatcagggtatgctttatatgtaacaatgtgccacaaacttttttttataggattaaatattcttttacaatttttttttttcttttttgagatggagttttactcttgttgcccaggctggagtgcagtgtagtggcgtgatgtctgctcattgcaatctccacctcccagcttcaaatgattcttctgccccagcctcctaagtagctgggattacaggcacctgccaccatgcccggctaattttcgtattttcggtagagatggggttttaccatgttggccaggctggtcttgaactgcctcagcctccgagtggctgggattataggcgtgtgacctcaggtgatcctcccacctcagcctccaaagtgctgggattacagttgtaagtcaccatgcctggcctttacaatgatttttaatggctgcatattattgctatgtaattttttaaaaactaaggcccagtttactgggtgtgtggcttgcctatagttccagctacttgggaggctgaggtgggaggatcgcttgaggctgggaggtctaggctgtagtgagccatgatcataccatatcactccagcctgggtgacagagggagactctgtctcaaaaacaaaaacaaaaaactaagggtcaagctgggcacagtagcaggtacctgtagtccagctacttggaggttgaggcaggaagatcatttgaaccgaggagcttaagaccagtctgggcaacatagtaagacctgtttctaaaagaaaaaaattaagggtcaatttttatatgaattagtgtttttcccagctaattgtatagaatttttttttttttttgagacagtttcgctctgttgcctgggctggaatgcagtggcgtgatcttggttcactgcaacttctgcttcccaggtacaaggaattctgcctcagcttcctaagtagctgggattacaggcacccgccaccatgcccagctaattttttttgtatttttagtaggaatggggtttcaccatgttggccaggctggtttcgaactcctgacctaaagtgacccgcctgccttggcctccgaaagggccaggattacaggtgtgagccactggccttatatggaactttttgaagtgttaaattaggtaataagttattgagatcaggagttttcaattttagagagaaaatgcgtttcttaatcataaggatacataggcaatatgtgaaattaaaaagcaaaatcatttttaggcgtgtcaatggagtggtaaaagacattgagattttactatatagttagagtaaggaattctctacctttttttccctttaaaataaaaataaatatttttaataaaagtaagatatgtcctttttgagaaattcacaaaacacggaaaggtagaaatcataccaaaaaattagccacaattatactatcgtacaccaacctctttgtacattttggagtattttcctctacatttttgttgtcattgtgaaacatatgtgggatcacattgtaaacttctcaattttacattacactgtggaaagctaccaggagtttgaattttaggagtggtgggagtaacaaaggaaaagaaaacgttggaaacctaggggtgttcatcttagatacttttctccacatgccaatctgtgattaagcacgagggtcaggcatggtgactcatgccccagcctgcactttgggaggctgaggcaggtggatcacttgatctcaggaccctgtctctacaaaaaactgcaaaattatctggacgtgatggtgcatgcctgctgtcccaactaccagggaggctgaggtgggaggatcagttgagcctacgagttttgagactgtggtgagctgtgatcgtgccactatactccagcctgggtgacagtgagaacctgtctcaaaataaaaaaaaaataagaagcacgagattgcccaagtggggtgggaagtcaaaaaggtaaggagttggctagccttggacagtctccaggagacattttgtagctcctgtttgttatatccatgactttcctacctgagttcttgctaagcccattgtcattcttaacagggatgtttttgaactaaatttcatgaacgtcaaattttccagtggttattatgacttccttgtcgaagttgaaggtgacaaccggtatattgcaaataccgtagaggtaggtgtttttctttccttcccattgccatgttagtatatccaaggatatggccaaattgacacagtattaattgtctggtgcattgacttttctctacaaccaagctaatgtgtttatgtggagggagggctgcattcagtctttgctgtttgacagacttagtagctaaggcagtaaatcaagaacttggtcatagtgaattttcttttatttgtaagtttttcattttccattataatttagcattactgtcttacatgaaatttagttagtagaaaaaataaaaatcacccataattccactgagccttaaactcttaaagtgttttgtgtgataggctttggtgggtttagaaaagtgcttgatgccaaataggtgacaaaaagcaccaagtgacacatacgtaacactataatgaagctatttgggtaaaggataaaagaaaatcagtaatctttcataatgaactttgttgatgtttagctaactctagctgggttgaagatcgaagtagctttaaggatagaaagccttatttacctgatgctttgtgggaaagaggtagttcaccttagtatttttcccagctaattgaaatttaccccatctggcatggtggctttcattgtaatctttttagatagaagtttatttaagatgagtgacacattttcctactttcttacttccaatttaagatggtttctttgtctttcatgaccttgacacttgaagaggatgggctctcaatctgtagaatgtctctccgtttgtgtttgtctgatgtttcttcatgatcaggttcaggtcatgcattttccgcagttctatcccaaaagtaatgctctgccctactcagaacaagaagtatatgatgtcgatatgtcttattacaggtcatgttaaccttgatcacttgagtaaggtgattgtgtgctaggtttctctgctgtaaagttgctgtttttctgcttgtatttaagtgtcttgtggggtggtactttgagactctgtaagtatcctaatgatgttgtctgtaatagttattactgtggtgtttgccaaagggtgattttctctttcattccttctacattttaaaaattggaattctgctgtaagaaaataactgtgttttataccattttatttataactatcataattctttatcataacatgtttataatgtaatatattttctataattcatatgtttacaataattgcatcatggacatttattttactatatacattgtggtccatgactcatttatcttgttgctcattttatcctaggtttggcctttggagagctcctcaaattggctcctgtgacacttgctttcttttaatgacagaattaatagctagaaagtttgaccttttcaaaaatgcggcattacttcccataggtagattcaacacttgcatttaaagtttggcagaaaggaagatgttttctggaactcgaatctcttcacctcatgtgttgacctttttagcatgagacatctgatcttagttcgttcactatggatagaagctattgtagcgtatgccttgatcctttcaaatccacattcttataatgttagtttcctatgttaagaggacttatttgcaactgaacatattaaaaggaaagttctttttttcttttctttttttttcttgaaacctcttcttccctgtacttcgagtccatcttaaatgccaggcttatacctcacagttcttaaccccttcctttcttttcacttctaccttctagtcagttaccaagtcctattgattccacctctgattgtcttttccatgagtcttttgctgttacagtcaccaaattgctctattctccatattcgtaccaatatttggtatttttaggttttagtaatctgatgcatatgaaaaggtatcttgttttaatgtctttccttggttactggtaaagttaaacatctttttatatatttattagccaattacatttcctttccagtgaattgttttatatctttgcctggttttcttttggtttgttagtcttattactgatttttaggagtgatatatgtttagttgtgagcatcagatatcttcccctagaattgctttatggcatctcttgaagcacaaaatttaattttaatgaagcctaatttaaatgtcttttcctagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaatacaagtttttttgctagactgtgttttttatatcttctttaaaacaatcctgtgctaccccaaagtcaaaaagatattctccaatgttttctttttttatttttatttttgtttttgagacagagtctcgctctgtcactcaggctggagtatagtggtgccatcttggctcactgcagcctctgcctccggggttcaagcgattctcctgcctcagcctcccgagtagctgggactacaggtgcatgccaccacacctggctaatttttgcatttttagtagatacagggttttgctatattagccaggctggtctccaacttttggcctcaaatgatccgcctgctttggcccaccgacgtgttgggattacagtcgtgagccactgcacctggccctccagtgtcttttgaacatttttaaagttgttttcccccttatatttaaggcttcggtctatctgaagttcatttttgttgctgtagtattttacacccttttctataattgtacttattgcattatattaccattgtttgtttatatgcattgctttttctttttctttttctttctttttttttgagacaaggtctcattctaccacccaggctggagtgcagtggcgtgatcatggctcactacagccttgaccttctgggctcaggtgatcctcccacctcaacctctcaggtagctgggactacaggcatgcaccaccatgcccagctaatttttgtatttttttctagagactgggttttgccatgttgcccaggctgctctcgaactcctgggctcaagcgatctgcccacctttgcctcccaaagtagtgggattataggcgtgaaccaccacctgcattgctttttcactgggctgagaactcctatgggtgaaaactaaatattattattattattattattattattcttttttttttgaaacagagtctcgctctgtcaccaggctggaatgcagtggcgcaatcccggctcactggaacctccgcctcctgggttcaagtgattttcctgcctcagcctcccgagtagctggggctacaggcacgcgccaccatgcccagctaatttttgtatatttagtagagacggggtttcactatgttggccaggatggtcttgatctcttgaccttgtgatccgcctgcctcggcctcccaaaatgctgggattacaggcgtgagccaccatgcccggcctaaatcttattttttcagtgcttggtttccatttaacattacttagaggaagaaaaggatagagtggtctaaagatgtttttccacattgcaggcccttcagaactctggcaattcatcttccagacttagcttttttttttcttttttctttttttgagatggaatcttgctgtcacccaggctggagtgcagtggcacgatcttggcttactgcaacctccgcctccacctcccgggttcaagtgattctcctgcctcagccttctgagtagctgagattacaggtacacgccaccatgcctggctaatttttttgtatttttagtagagacggggttttgccttgttggccaggctggtctcaaactcctgaccctcaggtgatctgcctcgcctcggcctcccaaagtgctgggattacagatgtgaaccactaggcccggccaagagttagcttttatttattgatttaataacagctttattgaggtataattctcataccataaagtttaccaattaaaagtatgtaattcaggctgggcatgagccaccacgcttgtaatcccagaactttgggaggctgaggtgggaggatcgcttgagcccaggagttagagacaagcttgggcaacacagggagatcccatctctaccaaaaatttaaaaataaattagccatgtatggtggcatgtacctgtcccagctacttaagaggctgaggcaagcggatcccttgagcccaggagtttgaggctgcagtgaactatgatcacactactgcactctagcctgggcaacagagtgagaccttgtctcaaaaaaacaaaaagcctgggcgcagtggctcacacctataatcccagcactttgggaggccgaggtaggtggatcgcctgagatcaggagttcgagaccagcctggtcagcatggggaaaccccgtctctgctaaaaaaaaaaacaaaaaaaacaaaactatgcaatccagtgtttttagtattttcacagacttgtgcaacccttgccacaatgccattccagaatatatttatcaccctggagagcaatgctatatcttttagtgggcactcctcattctctcttcctactttctgctttctgtctctgtggttgcctatttgggacattttgtgtaaatgaaatcatacaataggttaccttttgtgtctggcttttttgttttttcacttaacataatacttctaaggttcatccatgttgtagcatgtattagtactttatttctttttatggcaaaataatattccattgtatggatatatcacattttgtttaccgacttatcagttaatgacatttgaggtatttctcttttttggctcttatgagtaatgctgctgtgaacatttgtatataactttttgtttgaacacttgtttttggttctttcaggtatatgcttaggaatagaattcctgcgtcatatggtaactcggtgtttcacttttcaagaaactaacaagttttcaaagcagctgcaccattttacatttctaccagcaatgtgtgagggttccaattttactacatcctcaccaacacttgttattatctgactttttgattttcgccatcgtagtgggtataaagtggtgtctcattatggttttgatttccatttctctgataggtaataatgttgagtatctctttatgtgcttattggtctcttgcatatcttctttagaagaatgtctattcaaatccattgtccattgaaaaaaatgtttttggtctttttttcttccttctacaatctatacacctcttatttccttttatttatctttttatattattgagttgtaagggtttctctggttagaggttccttattaaatacatgatttgcaaatattttctcacagtctgaaggttgtattttcactttcatgatgttgtcttttgaggcacaaaaaatcttaattttgatgaagtccagttttaaaatgttttgttgttgttgtttgtgctttaggtgtcatgtctaagatgccattatgtaatccaaggttaagaagatttactactatgttttcttaaaagaattttatacttttggctcctacccttaggtttctgattcattgtgagttaatttttgtgtatggtgtgatgtagggggtccagtcttcttttgcagttgtcctagacccatttgttgaaaaggctgttctttccctaacgaattgccttggcacatacatccttgtaggaatcacttgacaataaatgtaagggttgatttctggactcataattctatttcattaatctgtattgtccttatgccagtgccacgctgtcttgattactgtaacagcttggcattttgtaacatcaaatctggtgtttgtccaagtgtttctgtgattgttggaaaaattatctaagtacaaaatagcagaaatggctaatagctcttgttcatgcaatgataataagcccccattgaggccatttactctccttttcctccctagtgatggagtaagcattacaaaatcttctctcttcctccttattacattagaggtgtgtgtgtttgtgtgtgtgtgtgtgtgtgtgagtgtgagagagagagagagtcggctttgacctttgccgtatatgcaacttttctttgtaatttcagtaataatcacacttagagcctcagagcaggtcattgggtcctgtttgtcctcccaagaaatgctcgacattggtcagagtgcattaacggtggtttggtgtggaagtcctgtaatagccctcattgacattggactggctgtcaggggaagcatcggttttggacgctctcattagcattaattgcccctaatgcaccatcatttttgacagtaataagctaaacaggggtgttattactcccagcagaaagactgcatttcctggcgttaaaacattttttgagatgtatatggcatgtggtgcaggcaaagaaaggaatagcatgatccagtgtaaagcaggcttagctgcatttaaagtggagaaataagtccctttcctattataaaaacgaatcctgcattgttagttggaaggaagaagcagctaatcaacagggatcctacactgaactctttaaaagagggctttggaaaaagttacgatttttatttctaaatttgctttaaaagagtagcataaaaatgctttgcttttgagtgtttccagagacccatttatagtgagattttaggagcagaaggatttgttttaaactgttccctatttaggaacagccctacgggtgtttatgtgcaacaatgaaagctgtaacttaggaaaccttttaaaattggggctgagagcaaaccaagaatgatgcaagttcactgcagtttgccctttgctcactccatgtatctgcattgtctggggatgctcaggatgtctttagaacacacacgaagctggatcctgattagctggccttggtggccagttagtgctgagagtttacagccaggattctaagtgaaaacctaaaagctgatagcttccttatcactatcattaggagacactgaagactttacacaattcttttttttttttttttttgaggcggagccttgccctattgcccaggctggagtgcagtggcatgatcttggctcactgcaacctctgcctcctgggttcaagccattttcctgtctcagcctcctgagtagctgggactacaggcgtgcatcaccatgtctggctaatttttttgtatttttagtagagacagggttttgccatgttggtcatgctggtctcaaactcctgacctcaaatggtcctcctgcctcggcctcccaaagtgttgggattacaggcgtgagccaccacgcccggcctagtctgttctttttaattgctccatagtaattaataatatgcatgtatctttctttatttagctagtcttctgtttatggacatttcagtaggatgatgatttcaagatcacatttacagattaaatgaatgagttcttaagagaatgagttagagaaatagggaattacctagttaatcttgatgaagattgcagagtagttaactctgaagacagattatttttatagcatggagtattattgctaatcctcctacctctcccaaaattggagggctgctaagcccatcaagcctcctcctcagtcttcttgctatggaatgtttcctactccccatttggggccacccatgggcagacttgggtcacagttccttctgtgctttcataacactttgtacatccattaaagcagcaacctggtttattataattatggtttgtgtacgggacaggaaggatttcttgccatctctgtatattccctgaatggggaaagtgctctcagcaggtgtcaaatcaaagctctgtggctacttctttgcctgagccttccattccagtttgttttccagtggaaatgatgtcagtacttgtcgggttgtgttttttgcaagaaagcttgctctggttctgagccttgcgtgagttgtaacgctgttaactcagcagagagcccaaagagccaaagtgaggctcctagctcccttcttgggggtgtctattcaacctgatgggccatcgtccctcctcctccactgccataatttcacccagttgcctagactcaatgacaggcaatgatcctaaatatagttctgctatgaattcataggtggctgtgaattcaaaagtagatggtaatatccttacagcttctggtaataaacctttacagtttttttttttaaagcaaaacaacacccctattcaacatgataattgaggctgttgtcataaaatagttattacagaggcaggaaagaaggccgttagaaggaattacttgataggtatctttatttttaatttttcttctttgcccttgatttgaggttgtcacacctcgatatggtatttcagaaaactgccagagctatccttcaattatttgcccagcccgttatctctattccttgatcctgacttagactataaaccagtggatttggcaaggatttccttaagtgttacattcaaacctatcaaatatttggaaggcttacagatctgtttgcacataaaagcgccttgggtttgcataatttgcacattcaaacttgggttttaattcagaaatttaacatgttttctgtctcttttggatatttacattgattttaatctaattttaaaatttctcatttattggcattagcccctctttgtgaagatgtttaagggacatacagaattcaaacactttaagagtcaacatggattggtttgtgcttataacaaactcccaatctcagtggcttaaaacaatgagggtttattttttccccacgctagattctttaggtggtcaactggaggctctgcttcatgatatctttgctccaggaccctggctgaaggagcaagcatctggacattgtgtccatgtcagaggaaaagagagaatcacacattgattcttaaagctttcacttctgcccacatttcattggccagagcaaatcatgtggccacacttgactccatgggggcagggaagtagaattctaccacatgctcagaaggagaatgagaagtacttgggcaacagtacagataactaccatgactgtctaacaaggagctgaagtgcatggattctgagtcagagtgcctgagcttgacactggcctgatcacttcctcacagtctgattttgagcaaagcagcttcatctctctcatcttttatttccttatctgaaaagcagtaccttacagaattgtgaggattaaatgagatagtctttacaaagccagtgcctttcacatggtaagcactcaataaatcctagctatcattagaacccaattcttgctgatttgaatgaaaggtactgcttaaggatttttccccttatttattttaaaggacacatgaaaagatttactttttttcttttcctttttcttcttctttttttttttttgatgtttaccatccatccaaagccagaaaaagacattttaggcctcggaatgggagaggttggaaatattactgggctgggtcagtgttattatcatccttgaagactcttgttctaggattttttcatgcctttactcaccttaaagaatagaaaactttatatctgcatgtgaattcctgaacacccaccaattgacctggcaactgtcttctctattttcctctagctcagagtcaagatctccactgaagttggcatcacaaatgttgatctttccaccgtggataaggatcagagcattgcacccaaaactacccggtaggtgagatgccacctgatcactcagggagctgaggctcaagagctgagaggagtatgcctaggcactgagccctgcaggcatcagttctgtgtcagcagccatccagcttacatcctaaattaaagagtctgtagttccactggtcctgcaccggggattctgcgaattatctaagtggatttggagattgtatataccagtgtttagtccatgcacaaactatttattaaccagtcctcaacgaggtaaagcgcttacctcaggatgttagtctgagtcagtcagctatgtcactaagcatattatttagttcagatgataatttttaaaataataagaccttctcaatgaaggaagcaaggtattaatttacattctggtgcgatctccttatcatcacagtcctgaatttgcttttagtgacctaatggcaagtctctctggcctatgatgggtctgaaattagttggaagcctcacacgtgcttaaaattgagatggcagatacccagcactagggctgccatttccccctcccaagtccatggaggcagtactaagaagtcatagaacatttgctcccactgaactcagacacagcctcagaatctttttttgaaacataatcttctaagtagacactaacaattgaacagagttgggccagaatgctgtaagaagcctgctcatcagccctcccccagatccttattggctcagcggggatctagatttctggggtatagtccagaccccaactttactcaactagggtagctatagaggccagaagacagtagggtgaaccatcaaggctctttgaagatgggatgttagccagaggctggaagccaagcagctactccttttaaatcacatagagttggcctttgtgtctctgggttggctatttttgtagtgatattggagataagagcactgtttaagaatccactgaagaaatgtctgtgcgagcgctttgctgtttaattctctgcctagatgaagagttggtcttacttacgagtaaatgtaaaatgtgagtataaaataaagccaggtctgagctctgtaaccatttggctggtttatcccctggccatcttaccctaaaatcccaggagatagctgtgaaaagaagttttcctcatcaagtctgccttttgggaaaatgactttttaaaacccagtttcagggcagaaaactaaattgaaacagtgtccaggaaaaaaatatagcattaaaaaaagacaaagctgaaagtacccttctttcttttgtgtctcctacctgccttgtctcgattttgctcacgtgtgctgctggcatcaatcctgtaattatttctccttgcggttctgccagcccggctctcctgtgtgcctgcagaggccacacgtgagctcctctggtgcctgactttgttggagttgagagccttaggtccttgaagtgaaagcccagaggtacaagcatctgtacacagcatttccccagatcctgctggaagtttattctgcacttttctcagtccaggctttatcagtccaatttgcccccaggttgcagacagttctccacatctgtctgtccacaacagaagtgttactatgggagagggtggttgaggcaatgaagtgaagtatatattttctgcctgttctcagagatatactgatcctctctgaagactaactctatatgcctctttcagggtgacatacccagccaaagccaagggcacattcatcgcagacagccaccagaacttcgccttgttcttccagctggtagatgtgaacactggtgctgaactcactcctcaccaggtcaggaagacacctagacagttctcttaacctgaaatgtgaatggatactagagtttacaatgtggtctataacatggactagagagaattccacgttcctgctttcaggttttgaccgaaccctgacagtccatcaggttctcccacatgacactctcacccttctactggttgtagtcctttacctgggatacacccttctttctaaaaagttagctggtattgaggagaggtacttaaggcagatttgcacttaattaaggtcattccttcctccctccctccctcagatggactcttgctctgtcacccaggatggagtgcagtggtgtgatctcagctcactgcaacctctgcctcctaggttcaagcgattctcctacctcagcctcccaagtagctgggatacaggcatgcattaccatgcccagctaatttttgtatttttagcagagacagggtttcaccatgttggccaggctgttctcatctcctgacctcaggtgatccgcctgcctcagcctcccaaagtggtgggattataagcatggcactagactcgaggctttttctttctgatttaaaaaagggaatgtgctggccaggcatggtggctcacgcctgtaatcccaacactttggaggcagaggtaggaggatcacttgagcccaggagttggagaccagcttgggcaatatggtgagacctcatttgtgtgtatgtatgtatgtataaataaataagggaatatactgaaataatttcaaaagaagacccaaagcatttttttattctagccaaagcagattttgtatttgtgggactctgaagaatagcccttttaacttgtgcttactttgtattatgaaagcaataggctttatttttttcatagagtaatgaaaattattatttaaaagattttcaaaccatatactctttcccctgagaacctaatatggccccatgtccactcagatacccccactcccacactgcctgtcatcccccttgatggagaataacctgcctttagtgttacgtgaaggaagattcagataaatactttgaatgctgaaagacaggaatgcgggacctagtttggtatggggtaccctgtaccgatgctttagcaaggaccagcagacttgttgccttgaggcagcttcagggcagacctcagaggcaactggatttacttgagaaccttcttgctttctgtttcttgcagctgcagctgttggacttgtgccccaggagcacgttcctctatggccacagtcctgggagtcctctgctcctctctcctccctactcccaaactccagacagcttggttagggcccttagccaagcctaactgacctttgagtacttcagcctcttagcatttcccagcttcttcccagaatgacatttgccaaccaaatagcacaagggaaggaagagtacaaagagaagaaagtaaaagactaaactagtaggattaggattagagcaaggagagttagtgaggaagtgtaactttcactgaatacttgtctcatccagaattctgctgtagaatcatggcctagagaccttccaggtggaggtggcattttggtgatgaacttggcagctgcctgcacttgattgtgataggaaggagatctggcatccggtctccccattccattcctggccaagactaattgctgtagttgggatgcttcatatctctgggcctctttccctaaatgctttggtggtggttctttgttgttcaggtatagattaacacatgagatgtagattttctgtagatacagtgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaactttgtgagtgctagtatctgtgaatttctataaacattatacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagcttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcaggtatatcccaaagggcctatccactaaacgtgggagaagagagggcaacaaagccctggacagtggctctgctccctttaacttgttttgtgatgttttatagtttgatcctcacaccctgtggattaggcagggtaaatggcagccccatccttgaactgagaaaacaggtttaaagagtccggtgactaacccccagaaagcagagagttgaagatgaaatcagaacctgagtctggttttcctgacatccggcaggttcaaccctcagaccacagcttattagctatgagcgcagatggttctagcgtttatcctccctgctcctgtgtaaatcagggctgatggggcgacaggtgggaaaactcacctgggagaacagggctctacttccttaggcaagtccttggataagcaagcctggtcctgtcctgcacgcaggactgttgtgagaatcaaagttgataacagatgagtgaagaaaggctttgaaatgtttctaaagccctttccaaaataaacacaataattgttaaacactttggatactggttaaggaaactgaggtggatccactcagtggactattttgcaatcttgagaaatgatcgtacttggaaacttgcatacgaattaatgttgaagtgtcaaaaacagactacctgctgtcattccactttaaaaaacaagtgctcaaagggtagagtagtaggattgttttcaaaactccttttcatattgatacagcattatttaagaatgtaaaatgcagctaactggtaggtgtaattgtgatgatgaagggtgctggctgaagtaggtggcagcagctgctatagtgttagaaatcctttaatggcagcggcagcaaagaagagcagaggtcaaaatttaggaacaggaggctcaagtggggctgtgtcatcatggagctggtttggctgggcattgacaagcagaaaaggcaggcacaagttgatacgttggaggaaaaatcttttttaaaaagttctatttgcataatgagttacagcttacaaagcataatcaaatgcactatttcatttggtctttagagtatctttacaagcctagcagggtggtcatggccctccccacccccaattttccagctggaaagtgaggtgaagagtgggaaagtgacttcccttctggtcacacagccatacgtttcagtttgggcctaaacggaggtctccagaatcccacaccattgctgcttctgctaggtcacactatctaggtgagcttcgtaaagagaattcatgtagaattgctcaggaaaaaacaaaaaacaaaaaaaaaaccaagaaataccatcagaatgcttgtcgagccttctggtttaactctggaaatcaaagttgggccaggcatggtggctcacgcgaatcttgctttgcagggccaaggagggaggatcacttgaggtcaggagttggagatctagtgagactctgtctctacaaagaatttaaaaattaagctgggtgtggtggcgcgtacctgtagtcccaactactcaggaggctaaggcaggaggatcttttgagcccaggtgtatgaggttacagcaagctatgatggtgctactgcacttcaacctgggtgacacagtgaggtcctgtctctttaaaaaaaagaaaaagaaatgagagcgggaagttcgtttagggcttccttagagccatggctcagggagagagggatgaattatgggtggaaagatctgtagggaggctctgttaccttttaaaaaggtatagtgttaccaccattagccaattaagtggggcagcagcatttgccagggccaccctaggaacccagaaacattgcgagtccagcgtcctgcctcagtcctgtcactcaagccatccatatacctgggcaccctctttggcactagccaaatgccacttgatggattgcattctctggcctctgaatggcagtgagtctttgaagggaataaagggttggccaagcagtgagctggggttaatgtagtctctgtggaagggagacctctgggatcaaaagccagcattgagaagaggcaaaaggccccatgcccacttgttgccaagaggttttagcctctgggcggcatatcctcttcatgactgacattgatgctttggtccccggtatacatggctgcccctactgggaagggcacattcttaagtcttcttggtgtgtctttcggcagcacctgttccgcgagcctgagaagaggccccccaccgtggtgtccaatacattcactgccctgatcctctcgccgttgcttctgctcttcgctctggtgagtggctgtaattagcgtgggcagcatgcgtctggcgccagacccagcagatgcattccttccaaaggaggctgtgttgtctggcctcagtaaagctccagaggggtccagcagctgtgacctgaattgatgctcaagacattttagaatgaccaaaagttcccactgtggaggagtggccaaataaactgccgcattaacaagtgggcatgagaaagtacctaacagccactaagaatgacaaaagtggatggactgtgatgccgtaggagggttcagatgagatctagtgtgaacagagcgagatccgatgctggtagctataaaaaacagcacaaaggctgtggatttcagcactgcttggggcagaaaaccagaaacaacctaaagttcataagatggaataatatgcagcttttcaaagaatggatagatttatatgctgataggacaagattgccaagatgtgttactgagtgaaaaaggcaaggggtagggtagtgtgtttagtatgatcctctgtaaagttttaaaaggtggctgggtgtggtggctcatgcctgtaatcccagcactttgggaggccgaggtgggaggattgcttgaagctcaggtgtttgagatcagcctgggcaacatagcaagaccccatctctactaaaatcagaaaattagaaaaaaaaaaattaatggtgacgtatgcctgtagtcccggctacttgaggagctgaggtgggaagatcacatgagcccaggaagtcaagtctgcagtgagccatgcattctaacctgggtgacagagtgagaccctgtctaaaaaaaaaataaaaataagttttaaaaggcgatatgtgttagtgttggtcatctctgaggagtggacattctggagaatgtagaggaagtaacttttaccttttctccttttcagtaccatttgaatttttttttttagccaattgtgtttttctcttttttcaaattataaacaaacatgaatgcatatcctcaaagctcagagaattttgagaaaacactcattagatcttacttttggaaagttgcctgtgttcctaattgttgcttttaacaaaagaattactgtttaaatctagataaatctagaagccttgctacaggttttcagaaaccagacctagggtatgggcacctgtccttacatttcagtgatgagaatttcaaatgacatggaacccacggcaagagcgtgaatgccaccagctgccggtgggtttatcttaccaattcttagagaacttagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctggtaagtgccccaggctgctaattacctgtaacgtcctctgacatttagcctgcccacgcaaaagccctgttaagtagacccacaacctattacctataatgacttaatagcattacatttccctcttcctcctggccttttaggacagttaatacgaagataaacctgtttggtccatcacttagaacagctgtcattatattgggctttgttgtactgtgccactgttggcagaccatttaccctcagttaataaccctgtttatttccagagattactcacttatcgtatctttacattgagcaatcttcctggatgaagagcattaatgcagtttccaaaggttatctttccccacgctatcgatcttcacatttgctgccggctctgtctgtgtagtaatagaaaacagtcctttccacagtcagacatgctatcctgcatcgttctctggagaccttaggacttcaacagcctaaacataacaagacagtaaattcacaaatcacttaagcatttctgaggcttttgatgctattggatcaggggtgccttgcatttcactgtgactttaattttttgttcgttgtttttttttttttgagacagggtcttactctgtcacccaggctggagtgcagtggtgcattcatggctcactgcagccttgacctcccagactcaggtgatcctcccacctcagcctccagagcagctgggactccaggcttgtgtcaccacatttagctagtatttgtattttttgtagagacggggtcttgctgtgttcagagctggtcttgaactcctaggctcaagcagtcttcccgcctttggcctcccagagtgctaggattataggtgtgagccaccacgcctggcctgaccttaatatttttaaaattctttgcctctttcaggagtcactatctgtgcgcccatagtaaacagattctgtaggggtgcatagataagtctcttgaaattctaggcaaatgtctgtatttttctggggaaagagagagttgtgactttgatcagattattatggtgcagtggtccgtgacctcagaagtggttaagagccccgctgtagttcatccgtcatctgtctgggcaaaactgacaggatgacctttctctctggctcagttcctggatatgtatgatagccctctggggtcagaccgagaagaaaacctgaatataaatctgttgagagccgtggcttttcctgccattgtgctttttgtgcacgttttctcatttgattatcatcatagccctgatgagggtgactggggcaggaattatgatcccttttgacaaggtgggagaatctgggctcagagaagttaagtggctggtaagggcagggcctggaccaggccccagggctctccgttcccagctctgagcccttttcactcagccttcttcctgagtcctccttgctcccttcctagtcacagtggcaaattatccttacagtttgtttccccccataaaaaaagaaattattcatttatttatatcctgtttattttttatttttattttttatttttttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgcagctatgctgggactcatgtatgtctactggactcagctcaacatgttccagaccttgaagtacctggccatcctgggcagtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacagaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggttttgcagaggctcccagcaaggagtatctcctcagtagcctacaccatctccccgggacccagacaaccttagagtcacatggatggtcagacagaccttgacatgagggcagcttgctggcagcttgactttctaaacagaattggaggcaaatttaaatgtcacaaaggtgtttctcattgatttgactttattagaacctgagtgatttcagacacgcaaaggccagtaagaacagaattgctttcacctctggaaatcgttttcagatgtgccgctttcttctatccaggacgtttgctggaagaatgtaactcaatagtgtaccctcaacgtggctgccagttagggtgctgggatcagagagaggctttttcagggagaccatcagtgggtgggagaagatgtctcatctccgcccgagtctccattgtgagctttctgagcatttcaccatggagactcggcacagacgtgttccttggctttcctgtaggaatccagggcccaccagagcttcccttagcaccagcagtggcagctggttcattttgccaccctccagtagccttttcctggtggttctgcattgtacctgagaaagagccaggactcagttgcttttgcaaagcagaaccctgttcccttgcagcacctgcctgggcccccagggagccaaaagactgctctgctaagttctctcttttctggaagttgctcactcgagaagaatgaaatctgcccgccatggtggcttatgcctataatcccagcactttgggaggctaaggcgggaggatcgcttgagctcaggagttggagaccagcctgggcaacatagtgagacctcgtctctcaaaaaattaataaaaattaagaaaaaaatcaagacaagaattgagtagaaaccatttggtttatgttctgcttagcaggagttcctaatctggaatcctaaagttgtatgcattttatggggagagagactatggtttttatcagaatcccagaaggatcagtaactcctccctctcccctgctcatgtattcgattcaaaaacttaaagcccactcttctgtggccctctttgtgagtcctagaatgaactctaccctggaaaaatcagtgaccctaatggaagctctggttgggtgtttgtcatttctttcctcagctgatttctcccctcactgtcctttcttgattctcaaaccctctttcctttggcaggatcgctgcagagcagagcagtagattggcaaaatataggacactacggtaaagatgaagggcggactcatcccagaagcagggtcccttccccgtcttgcccgcctcatgcatgtcagttatctctctagttttcagcccacttgctcctcccacccctccctaagccacagctgaattctgaggctgcttttcaacttgctagatgaggttgtgactggaccagggcaaaagcttcctgagttagcccagctgatgggataactttgcagtgagcagctttggcctggctttgactgtataagacttcattctcccttatatcccgtggggtacttacttatttatagacaagcctctctctctgtttccaggacagctgagatgaggataagacaaatccaaaattcattaaatgacggtcccatggcaaatcctggcacaccttgtcactgtttctagacttttctgtaacaccgatctctagttgggctaaacattgtggtctggggagactgtaatttatgaaggactgatggccacagatcaaagccagcatcagaatccaggttcctagcactcagggtatgttaaaagggctgctccccatgtgactaaaatgtgaagtgagattccactcattctccttctgcatatcagtcctaggatgggagggaagtggagggaaggagaaggagagtctgatgcttcactgatctgctccgctagaccagggtctggcaaaagttttctgtaaagagccagacagtattttaggcttaactggccatatggtctcttggcaccaactactcaactctgtcactgtcatgtgaaagcagccatagactgtataaacaaatgggtgtggctgtgttccaacaaaactttattcaccaagacaggtggtgggctggatttggcctgagtggcacagtttgctgacccctgccctagaccaacaaagggaggggaggtatttgaattttcaagtcatgttctcctttatcctttgccttggaaatggctttccctgccaaagccacaaaaccatctaatttctaatcctctgaaaataggagagatcaacaaaagcatagtatttggagcctttccatggatgtgtgagcataagctgggtcacctagtcctcaacacagaagggaactgcatttgtttgtttgtttgtttgtttgtttgtttgtttccaggtttaatggagttgtaatttatctgcagaaaaatgtaccctttttagtgtacaattctgtgaatcctgaaaaacctctgtagtcatgtagccaccacctcagtcaagatataggtattgccactctccagagagctccccggtgccccttttagagtccgacccttctcccacccccactccctggctatgcccgtttggtttcatcctacattatagtcactctgtctgagatttgctttcagcaactgtccttgctgctacatgttgagttctttaattctttaaataagtcgatttcttttcttgattaaaaagaactttttttatagagatggggtctcattatgttgcccaagctggtctcaagctcctgggctcaagcaatcctcctgctttggcccctaaaagtgctgggattatagacgtgagccaccttactcagtctcttgagttttaaagtccgttcccaccctgctatccccaaatcattgcttgaggaagaggaaagtcacttgatcatttggacatttggcatttcctagcatttgaaaggaaaccccctggtagcaaagtgttcttgatctgagggcagacattgatttgagcagacataatgtgggacgtaagttctagccgcagtcaagagttgtgggccactacccttcggctgttcttatttcatactcatgccatcctttctgcatgaacatttctgaatgcccacatattagtgtacctaagaacctctgaatactggcaaggaattaggggtgcacaccccagccctcaagattaattccatgcctgtgcatgtcttttggaactgctttattaatgggtttggagtctgccattctgcaagactggatcattatcaccttagtcctcacccctgggaagagctgccactgaaggatggtgtgtgtgtgtcagcaaccctgcctctgcttgctggagcctgctgggatcagttactcactgcagtcacctcctcagcttcacagtctgtctagattgtcattttcattcattgtgcttccccatccctccttagagtctagggaaaggcagcggaggggaaacaaagagtacaggagataggttcttatcccctttaacactttctgtgagctgagtcccatttttgagaatctttctgtgttaggttagatgctgagtgtgacttggcaagaacacggccacacggcaggaatgtgcaggtttctgtaatgaatggtcaggatgtcatgttctaagctacagaagggccaagtgttggttggcagagctggagtctgggagattgatgatgagcattatttaaactttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtaccttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttggtatctgaaggccccatttggacctctaggggtccaaggggataggtttttatcccctttaacattttctgtgagctgagtcccatttttgagaatctttctgtgttaggttagatactgagtgtgacttggcaagaacacagctaaacaacaggaatgtgcaggtggactgcagctaggacctctgctcaaggctcttgtcttggggccaggcatggaggctcacgtccgtaatcccagcactttggaaggccgaggcagggggatcacttgaagtcaggagttttgagaccagcctggccaacatggtgaaaccctgtctctactaaaaaaccaaaattagccaaggggtgggcatggtggtgcatgcctgtaatcccagctacttgggaggctgaggcaggagaacagcttgaacttgggaggcggaggttgcggtgagccattgcactccagcctgggccacagagccagactccatctccaaaaaaaaaaaaaaaaaaaaagacttgcatggagatttgttgcaacatgaattttcaagggacacaaattcaaaccatagcactgaccacttgagtgactttagtctagaaggccacatctcaagaatgccccctctgaagttgtgcccattacatgaggttatataatagcacagagagaagtaatactgcatagcatggttgactgcgtagactttggttccaggcaaacctagtgttgccacttactagggtgagggaccttgggcaagtagtttaacctccgtaaacctccttttgtgtttctgtaaaagagagatgataactacctacctcataggattaaaggagttgaatgctgacgcagcttagcacttggcatctttcctgattgacctacggttatgtgccttggcccattgcctctagttctagaatggcaaaaactgcaattacttttgcaccaacctaatattaattgaaacataataagtttagttaacttgtgaaatatggtaatcctcatagtatttattgaattgggggtctggaagttgttttattttaatcagattgcttcccaactagctggaccttactacagtgaagaaattgggattttgattgggaaaaagggaaagaagattctagaactctatgccgttctgaatgggatcctataggtaagaggatgatgtgggcagttacagggatgcctctaagatgggaaggaggcttctccttcccagaggttgcaaacttgtgatctgtagtgtttttttaaaaattgagtaagttgccaacatttgaagacagattttatataaaaatcttggttttggattctggattctcctgaaagagaaaactagagctgtccacggcgggcctgattcctgaacggcagcagtcagctgacactgaatagcagctcgtccctttggatggagcctgcaagctccagcttgtcagcccctccccgcacaggtgtccacatacaggacacttgcgccagtccacctggcgactgtgcttctctgatacctgcctggctcccataggcatatacctttgggatcctccactttttagtttcttatcccactcggaggggaaggggtgatggtggtttcctgttgctcttgggcggctcctagtgttcctacttaggtgtgctgggacctcagccgctcagactggagaggaaagagagccccagcagcgtgtgggatgagagcagggacacttgccacctatcaccagacctgtgcgggcctggaagacagactgggtgcggggctggtggacagtggtgtggagcaggggtagtagggcctgagggtggaagtacaaaggctgctgggtgtcctggtcactgggaacaaaggacagccagtggctggaaggaaggaagtcgggaaacagctttttggagaaacggctggcacagctaagtaaggggttcccgggctggtttggggctggcctgcagactcagatgggagctggagaacagagcccagtaaacattgccatgtgccaggctgtgttctgtgtccagagctaccacagggagcaagacagatccagtcccttcccttggtccaggtacagcccacgggcacccagctgagggagaaaggaagcagtgatcacacatgtgagaagggcctcagaggaagcagttcttaccttgatggcttgggaggtctcagctgagacctgaagaatgagaaggcgcctatgccaagctgaggaagagcactccggccagagaatcagccagcatggaggctctggggcaagagcacggcacat

SEQ ID NO: 37893 - DNA, 254739 bp, Homo sapiens; identical to SEQ ID NO: 35999

SEQ ID NO: 37894 - DNA, 44629 bp, Homo sapiens
gcggagcctaggagtcagataccgcgagaagtagtctcccgaagaggttcggacaagcgcaggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacaggtgagtcctccgcggagggggacctgccagggatgtgggagcggaggacccgctccaccggggagggatgccacggttcccggcagattctggaggcttctccatgtttccctgacacccccaaaacagggagttgaagtccatgctccagtcggcaggtattcgtattaaaagcagttctggtagccgacaggtgaattagatacgatctttcctctcaaggagggtacatgtaaatatgtcgttccaaaacgtggcacagtcgtgcaaagcaggagggaagaaacggtgccaggtagtgactcgccgagaatgagaccgaactaattcacaaagggtgtaaaatgtttgccatgcagaagaggtactgcgtgaaaggttagaatattgaacccagacgccgaacttgctttgggagtgtgcaagtgcaggctgtgaggaacgaacccccaatgcctttctatgaagttagagactcaagagtatttgaaccatgcatgcatgcatgaaccgatgcatcgattactaaatatttgcattaaaacaaaaagcccaaatgttctaccagactattttatgaatgatgtgttattaaaattaaaatacatctttggccgggcgcggtggctcacgcctgtaatcctagcactttgggaggccgaggtgggtggatcacctgaggtcggggagttcgagaccagcctggccaacatggcaaaaccctgtctctactaaaaatacaaaaattagccggacgtggtagtgcacgcctgtaattccagctactagggaggctgaggcaggagaatggcgtaaaccccagaagccgaggttgcagtgagccatgattgctccactgcaccctagcctgggcgacaaagcaagactgcgtctcaaaaaaaaaaaaaaaaagaattaaaatacatctttaatactgaaaataggctttactaaagtttgcatctagttaacatgataccattgagtctccttggtttctgcttctccactttacatgaatacattttaaaagagatgtgggtggtccattttctagctgataaccataaccatcatactccttgactcatcttttttctttgaagttggtgtaaaagaactaagtaaatgttaccatttatgctcaaatttattaagtgctgttagtaacatgtggcatacgttccttgtgaagcctggtgtgacaggttcttgttttctttttataaaggtgagatttttcgttcttagtaattttcattaaagtttcacccaatgtgttaattagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaaggtaaatattaatcagtggcatttttacctgcccctccaccctcacttaaaactcttatttgcttttaaattcagtttgtaatgcctattaacttgtcgagatttctctttagagaaagatcacatttgattttcaaaggctttttattctgataatagatgatgttaaaacatgaagatatacatacaatatcaattgcatatgcttcttttaagtctacgtcatgttatcagcaaagatgagttttgactgccaaagttcaatcagccctttcattttagccaatttgcataccttttggatatgtgaatacaaaggatcagcttggtgcatgaggaggaaaaccttgaacattccttcatctttcctgtggagtttttcattaaatggtggcaggttgatctggaaaagccagatttaaaaacccagcatgttgggtgacctacaccttgactttgacaccagaactgatggtgttcaaagttgagagagtagcctgaggtcttatagagaaaaatgtattaatgtacatactgtaggacatttaatgtgtagggttctcttttcttcttcccccttctcagcaactcaatctaaaatatttccatgtaacttgtagcaagaggcacaaatacactaatactttatgagctggtattttggaaattatcctaaagcctcagaaaataaaagttatatttgcaaaaatgctgtttgtttgtagcatcatttataggagcaaaaagttgggaataacccaaatatcattttttaaaagaatggcttaatcagttgtgatttgtcaacataattaaatgttgtgaggaaatttgaataattatattgactctatacaaatgctgtggcaagtatttatatgcttatctcatttaattctcacaacaactctttgagataggcactgttaattatattgcacctgagaaaacggaagctgagaagagctaaataatttggctcaagcatacagtaaatcacaaagcatgctttgctgttaggtagtccttggtaagtgtcctgactctgccatttagtagttggaacatggtgatgtcgggtacctttcaggcttatagactatagatgtgcttcaggtggtacgtggcatcagttggctgctcaattaacatttttttttaatttccttttgtggctgaattggtgtcaggtacatttttttcatgtatttttttaagaggtattgtatatcactagaaacacaatctcagaaagtaaaatcctgataaatgtttctgtttctgtttttcttatctctccacctaaaaagaataaagttttgaactattttcccttggagactttgagttttgtgattacaaaaataaagaataattgtttttattctaaatatttcctactggatgcttctaatgattattaccatgttttatcaaatctaagatgccattgactttaagacacaccattattttagtaccactaagaaaaaaaaacttgccaactgtgatggtgatacacatcctggtttcagagttgttaaaatgtggaaaatgtgtatcctagaagcaatgagctacagtattgttattaagctctacttgcatgattatgagcatgacctcataacctgtgtccttttttctctttggtagctttggcatggcatatgactttattgattcagtgggaaatgatgtggatgttgtctctgactctgaagtaagtgttatttgtcgcttaatgtaattttggaggtgttttgtgataggtgttttatatcatgctgtgttttgcataatataaatgtgcaagtcttgagaaattagtgatgaaataagataaaacttacctgattattgagtatcttttttgttgttaaagtatcattgtttaccacatttgtatttaaagaggaaggaataatcaatccccaaacactggcagtggtaataatatattgatggttatattttaatgatagtaattgaaactgataatagtgtttgggattattctgtatatgttaccagttgagttacaaatgatatttctagtaaaatctattggatccttagtggctttgatctgatatgctaaaagcctgggtcagcataacagtgtgacgtatacacccttaactttaagaaatcctatcatgtaaaaataaatgtttgactgtcactaacataatgtgactcataaagtgtacgtgattctggtttgaaagctccgtcctctgtgtgtttgcatgtagctttttgtttaaagttctatttgtataaccttaaggaaataaggtttattatgctttaaaatgaatgaagctaaaatttaaaagattccaaatcacactaaaacagtctttctaaactattttttctcttaattttttaagaacataaaaaaactcctgaaaattccctacagcaagtcgcacgtgagcatggcagtacaccgcataggaaggactctcttactagatgagctagatattcaagaactctttatgagatcgtctcaggtaatgcttttgtgaaaaaatccaacaaaacattaacagcttaagagcactagaaatacgattttgtttcagagaatggccaaagtggaaatgtagttgagtacttcaacaatcgagaaattgaaagtttcactgaagatagaaaagcttgaatgaagaaaaaagaagagaatgagaatggtgaagaaaattattttattgattccaacagccagattcttttttacaagaaaaaagatgaagccaatgaagaaagttgtgaaaaaaactgtgaaatttaagggactagtttaatatttttaagaatcctttaacgtctcccttaaacagattctcaggaaacacagctactggaaaatgtgaaaaatattagaagctgttcctatgaataaatacagtcatgttcccataatgacgtttcagtcagcgatggactgcatataccggtggtcccataagattataatatactgtatttttactgtatttgcagtgttcagatacacaaatacttcagtcacatgtacagatttgtagcctgggagcaataggctataccgtatgacctaggtagggagtaggctgtaccatccaggtttctataagtaacactctgcgatgttcacaccaggacaaaatcacctaatgacgcgcttctcagaatatatccccattgttaaatgacacatggctgtagttattagaattaattgatgctctttagcctagattctcaaattgtatgttggtaaggactgtttttcccacatgttgagaatggatacttttgaaaaacataataacattgttgcagtttctcaagaactaccctccatatctgtacttttcttgggctggcaagaaatagttcatggtcagtctttaaagaatattactacagtgctttgataaagaaaattaaattatggtgaggtaaatgacatttaaaataagtgcttttttcctttgaaaagaccaccgtttagttcatcatgtgagtatgagcctaggcacggggatgtgacagtgaacaaatcacaggccttgctcctcagcagttcattgtttggggttataaacacatacacagatcatttcaatatagtgtgcaaagtgggaactactgcagctgctaaggaacatgttatagagaagactcacctctcccagcctggcttaggaggaggaagacgggtttcctttaggaaacaaaaaacaaaagaaaggtggtatgaattgacccagaaagatatgtttttaatgagtatgtgtttatgaaactattcaaaaaataataggagccttttctgtaagctagtactaggtaacattgtttcgactatgtgtgttgtattaataatatgtatctcatgttatccagactggtgactggacatggttgaaagagttttatcaaagactcattgatcagaagtggcagaggaagaaaaagagcaaagagcactggtatcaaaaggcaattctttccaagtttttatattacaggtacttggctacttatttatctctaaagagaaaaagggaattctgatctaaaatttagtgtgaagcttaatgaagttataatttaagttttgcccctgtgatactgttaacatttgtttcatatttcttttttacaagatgtatgcttaattacagattgtagtttttataaacgggtagactgttgcatgaagttaactttagtaacagcaatccttttttatttctggtttggccagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcaggttagtacttaaatgctaattctagaaactcacataggaaaacaaagccttttttaacatctcgttaaaaaaaaaaaaagatgaacaggactaagaaatattctgtcagcttatggaatgggggaaaaaagacttctgtcaatttatggaattggagaaatactttttagtttttcgcaatagaatttacaagagctattataggtggggagatcagatttttttattaaatcgaaatataatagttgactgatatgtttattaatactgattatctccttcaagtgatgagtattatatagagatatagtatattttaattataaatactagtcatttttaactataaatactattttaactataaatatctgtcaatatttgatagacatttcctaccaaatattgagactcagagacccatttgtaatttaagttctaacctttttaccataactttcagtcagattgttagacctaaaatatccctttaaggttttccagataaaattcctgaaacttagtccacattcatgttataaaagttttagaaaagagaatgaactaggttgtccattttatctcttacatccttgtttcttcctaatgcttgtttatttttgtacttactgtatctatcaaagaataaaataaagccatagatgtaaattgtgacatgtctattttcaggaaaatagattgataaatagataataagatctgtgacttgataagttacgtcttccctcttgctgttgtgttcccacatattgagcactattcaaccagattgtttcaatcttcacaaattacagggagcagatacatttaactcgattttagtttcagtaggtttaagatagagaaagcatcccataaaactccataatgaatttaaatttctttcaaaagtgagaaaaatgtaaggaaaaggaagtaattaatatgcaagtcacatagtggtaacaaccaagaagtagggatgttctatgattcagaagggagaaaagactacataatacaaatactaccctcctattacccatgtcacccatctcccagtgttgttctgtctttaccttgtttaggaattactgtgaaaactcttggagagtcgggaatctgtagacttgcgtgttgaggaagcaagctggcatttactgaatagctcttatgccatgtgtatgtttgtacaaggttttttttttcattcttggagctgcgtattgtacaaataagtaaactaacgctcatcaaaagatgtttcacatggtcatacagctggcgaaactctcaggctagggcttaaacccagatctttctgcctgcagaggcctgttcctccagcagtactccactgtgtccgtgtactccacacacagcaaggccctactaacagtcagatcatcgtagtagtggtgtatccctaggcacagctagcctgccttaagagtctcttacagagtacttttcttatattgcttaaatttcagctttagagatttgtttatatttgcaagctatctctgcacaaattcttgttccaaaaactaaaactgctggcttgaggcctttgttaagcagttatagaggttaaataggtgactgtgggatggtcctagagccagacatttattgagaacgttgtaacctagagctcatactctgactaaagcaactgcctggcaaactgttttgagaatcggttcatgagttgataacttgtctgtgtaaacaaataataaaataaaaaagagtttaaagttctcttaggactcctgagggagaggacaaggcacaatagaagtgctagagagccacctgtgcttatagtcacacactcttcccaagcaggtgccaagcctactggcacacacagatgacaagtaagacagatgtttgtggaataagcaacacacgcatgcctgtcttgggttctgttgaggcaatgacattaaaagcttaaagtagtatttcttaatggcagtactactttcctaatgattggaaaattgagtggtaggctgagtttacccagtgtcaagagggcccaagtgtattccaaaatgcattccaggctgggcgcagtggcttatgcctgtaatcccagcactttgggaggccgaggtgggtggatcacttgaggcccggagttagagaccagcctggccaacatggcgaaaccccatctctatttaaaaaaagaaaaaaaaattagccgggcatggtggcacgtgcctgtaatcccagctactcgggaggctgaggtaggagaattgcttgaacccaggaggcggaggttgcagtgagctgagatcatgtcactgcactctggcctgggcaactctgtctcaaaaaaaaaaaaaaaagtattccagagaatatcttaagaacaaaaagtgttctgagattaaatacatttgggaaacattggtttttacaaagataaagtagatttttctattgcaggattacttattatatatttattgttttaatatcaataaatattgttactccacaaaagtgagtacctggtaaacgtcatctttcaaacctgactctggaaaattttcattcagtttcccaggaactagtgttctgtgaaacactcatcaggaaatgctaaactggagactgttaagataatgagtatctcaaactgtggctgagtaagatttcttagggtttcttttttttaagagacagactctcattatgttgtccaggctggattcgaactcctgggctcaagcagttctcccctgtcgacctcccacatagcttggactacaagcacatgccatcgtgcctggccagtttcttaggaatttttaaattcaatatagatagagtaggctgaaagagcagtggtaatcagatgcaccaaaaaagagaaaaatgaaaaacttagaaagtttagaataatctttaatctatctctcttgagtaagatctaaatgtgattcgcttcttatagtagctatgatcattagccaaagcaagccacccaatgaggcgtgttattatttgtattggcctaataattcacaatggtagatttgaagtgtgtgctttgaatatttaggtgatactctcaaaagtgggtcaattttaagaaatgttgacagcagaatcactccttatccttgcacttttcacagggaagtgagcctcttgaaccctcatacatagtggggcatgtggcctcagcccccaaagaacaaaacctgattactttattcaatgacggggagcacagtcaggtatgctttccatggtgtccaaggtgacagcaaatccccagtctactttgtcatttcaaaactagcctaagtcgaaattgatagggaaaaactccacttgatcctgaaactgctttctaagcatctttgtgatcttagctctggggcctgactttgtcttctttgtctcttcctttttctagtctttttatggatcatggggggaaattacagattgactgtttattataatcctccctattttaaatcacagggtcttaaaaatgattttgttcggaatattctatggacatttgaagatatccatatgttggtcggctccaacatgcccatatttggaggaggcagatacccagcagtcagcttacgtctcaggtgaactaacatcatacccctcctcaagcttatggtatttaaattcttcctttagaatcagtgttccatcagactgaggttgcagtgagccaagatcatgctaccgcactccagcctaggcgaaagagcaagactcgtctcaaaaaagaatcagtgttccatctatttgggcatcttcctctttctctaggttttttcccctccctccttcccctgccagttgaaatggccacattaaggaaggagctactgtcagcagatgctgaaaggcaggcctatagctgagtcttcattctagacctcattgaatagagccagaggtttgttggactggcctagtcttaggtctgaatctacaacttgtgagaatattcaagagagtttatttaattagttagattcctactaactacttgtgagcatttttcttaatgctccacgtgtatttgttgatattagccaatgtgaattccaacttaagcatggtcttgtatggtgttcagtctttcttcaagttgtgtgtgaggagcaggcagtaggctcaccgtcctttcctattatattgtcttctattcttactgaaaacttaccaatgtcagttagaaatacaagcaagcttttggaaagatgttaaatatagcacaaccactgagctgcatgtgcatatcttatcagaaaagaaagcatagatggcattttctatctagagaggacagcttaagatacttaaatggtgaaataactttcagatgattaattaaggaacatcttaattaaaccaaataacactagaaatgtatatttttagggataacaacaaaccaattaatgtgctaactggaattgactattggttggacaacttgatatgcaatgtgccagagcttgtgatgtgttttcatgtaaatggaattgtacaggtaagatacagtgtgatttttctgatctctcaaatgcaaattggtacagagagttcctcaccaaagtctttacggccctgaagtactaaggtgcatttttgccagggaagatagctgtgaataaactgaatttgagtgtacatttaagttggtgataacagaattgtagatgttatagaagtataattttacaggtaatttggaggaagttcataaatatatgaaaacctgcatttgtagccatagaactctaattttaatgccaagctctcattaataattaactgaaagtgtctacacaatggaggcgtttcttcgttatgcaaatatctactcagtacatgcaaagttttagggaaaggtcttgtaaaaattgcatatggtggatagcttatatagcaaattcttattgagcatattctgtttagaagacacgtatccccattataagtgttgggggaagctaggcgtgttggcttattcctgtaatcccaagctactcaggagactgaggcagcaggatcacttgaagccgagagttcaagaccaacctgggcaacgtagtgagaccctaattgtagaaaaacaacgcacacacttagttgggcatggtggtacatgtctgtagtcccagctacttgggggcttgaagcaggaggatcacttgagcccaggagtttgaggctgcagtgagctatgatcgtgccactgcactccagtatgagtgacagagcaagaccctgtctcaaaaaaataaaaaaattgagaatttaaacaataaataattgttgaaggaaaacaaagaataagcttggttgttattcagaaagagataatctaatgggaaataatatgcagagagaacagtaggagacagataagaattagaagtgtagcacacagaaatctagatcatcagagaagggggtgagcacttccattcaggtctggaggaaagactttgtggaagaagggacatcttaactgagtcctgaatgatagctagtatctcaaaaaataagagctggattttaaaagtctagtgtaaatacatgaaaggattgataataaatccagctagggaacacaggatttatgtagcagaatagctgcaagtaaggttggaaaagtcatggtcaaatgatggagatcttaaatgttgagctaaggagtatggacttggttcagttggtaatctggaatcagaaggctttgcatctaggaggggaaatttgttgtgttagaatattaatttagagatagcatataggacagaaaaggaggacttagagacaagaaaaccagaggcattgtaccattttgcagatagtgtaatgtactttccactagagaggaactattaagaatcaacaatggtaagaatagatagcatttattgagtgcttattttatccaagcactttgctgaatgctttaaatgctttaccttatttgatcttcttagctacctcacatgctgttattcctatttgatggaaagagagactgaggatcaaggagctcaagtgagttgcccagggtcaacttagtagtgagtggcggtgccagtctttgtgcctctctctggctgaggacatgctttgaaccgttatattccaacccagtgattcttaacctggttgtgcatcagaatcacttgtggtctctgaaaaaatgcacttgcttgggcccccagtgttctagtatcagtaggatgtgtacttctgtcttttctgaaagtctgctgtatgattctggtttgcagtcttgattgaaaaccactgttagaccatctccctaaatggcaacatttagtgagaggctggggtgggagtggggagcaagagaaaagagagaggcagataaagcgttagcaaggcggaggggaacaggagtcaaaggagattccagggtttagggactagaataatggtggtgccatttagtgagataaggatgttgaattggtttagacagggaaggtaatatgtttttgtcacatgttcagtttgaggaaagtataaaaatgtctagtgagcattttgaagttgcagccattagagaaataaattgaagcatcatctgcctagatactgtcagatttcatcaccagaggaatctattaaaatcagacattggagcctctcctcataggggtaaaaatagaagggcatttagagagagagaaggagaacaagaatagcacagattaaaatacaggaaaggagcattttaaggaaggaaataatcaacattggggacttcacatgaacaaagtggggtgaaaatcaacctcagacgattgtgtttggtcttacattccagttgatttgaagtttccagttttagagtacttcagaaaatgtggtaggagatggttaggagagtgtgcacagaagataaacaagaaaaatgcaaaggcacttttaaaatagtggtagtaatgtccatgaagcctttactcttattgccacctccattcccccctgctccatccctgtgaagtaataaagtccatagatgaagggaagagaggtgtctactggaaaatttcctaaatgattctctctccttgagtcactgactgtagtttctagcaaaaaaaaaggccagaaatacatgtgttttaaaatcttgctgggtaaagcctaccttcatttaccatcttcccagttgaaaaccattcaagtggaataaaagtagtcagtatgatttgttccatgttagaacagaaataagatcatgcctgaatctgaggttctaaatctggtagtgattctccattgaaattactccaatagtgaactgcccttgctgatggggtggatgagattcctttgggaggctggggcagaaaaaagattaaaaaccactggtttaaacactttcatgctacataggtctctgtttgcaggacttctgcatttggttgctttttaaaaagaaaggtgttgtttccttgggttttctcttaaactgctttccatctgtctgtattttacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaaggtaagctattaatacttcttgagtgaacaataattgatttgggtaactgctgtgaaatgagtcttctttgtttttcttttcagcaagtggcagcgatatagtgaagctctatgacctcactactctttgtgaagaaactgaagacaaataccaaaatccattcacaatgccggtagccattctcttgtacaagtgagtgctttaagaatttaagatgaagaagtagcctattatataaagttttaaagcatacagtcacagtttccaaaccaaggcttttaaatgcttttaggttttcatagtagggggaaaaatacacgtacacattgtaccaaatattactcagctttcttatgccaccatagtataaacgttttgggggttgtgggtaaagtgtaaagtttagtattttgttgtttcttatagctctttgttggaaagaaacaagagcactcctagacttgagtcttgcagacaacgatgaaatgggcagtaaagttgatataaactctttttttagggttgcttgcaacatgatgatgaagaagaatcaaaataagaaacactatggaactattagaacattgcttcttaattgtctgaaattactggacaaaagtaggcatcctcaagtaagattaacatttatgtattctctaaaacaatcctagcattctaataggagattgttacctagacagtaaagcctcctgattcatattccgtaactgccctattcagtgtggtagccattagcacatgtggctgttgatcacttaaaatgtgctttgtctgaattgacatgtgctgtaagtgtaaaatacacactgaattttgaagattggatgtctgtacctattacatgttgaaatgcaatattacatatattggattaaatatatttaagttgatttcacagattctactttttaaatgtagctactagaaaatttaaaatttctgtatgtgactcatgttacatttctctcagacagcactgctcaatgaatttagaattcatgtaattctaacagtagtgcccttagttctttgttttgtcgctattagaccttgttaccactttgttaatataaatagggttcacattccacacttcaggatattaaagcatctcttaaataaaggccagtaaaatttcttttaaagagaaggggaaaaagcatctcttaaaatattccctcagtcatgctcccaacagttttacaccatccttaccctcggttgtctgattgacaactttatttttcactgttaaggctatttgttgtatcctgttcaaatcagtaaaggtatgtaagatacgcaatttttctttgaagagccaaagtaattttaattgtagccacatttgatttagagataaagattatcctagagaccaaactcagaaatgtttttgaagaaaaatagtaaaacattttgtttctgactgaaatacctaattgctgactgaggtggcagtgtttagtggaacttgagtggtttatttggatgttagaaatggtgttaaagactattgtctgtgattaagaactgataaatagtagaatgggttaaatggtcatatataaatgctaattttaagagatatcagaatggacttttccctttttaatgtaatggttttttttttctagaaccatagattatatgataaatattagttacctattatagagaaacttgaattaatttatagtttgtaaagaaaaattctggtttctcacttggcatagggtggtattaaatttttgttaatattttagttatgacactctgtactcaaaagcttttgtttgtctccagtgaaattcagttgacaccttttaagagggagggctcagggtggagtaatttcgggaaataggaaatgcatcagcctataaagattttgcagagcatacccagagtatcagtagctttgaactgggaacatttctgtgtgtgttacagtctatatggtggaaacagcctgtgtgcagacctcctcctaaaattcgttagtatggtagtaaaattcatgtattttttgatgacagtaatttacacatatttctctctttttcataagattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagagtaagcctttagaatttatattaaatttttatcaaggaaacataattgttaatcgaatatagttagcctttcaaaagataccattacttcaataaacctttcatggtctagcatctagtaatcattagttttctgaattcttaaagttggttttataattgttcgagggtaactgacccacattatgcaagcctatagtggacaggtgtgtaaaccaggtgtctgtctattcttatgtgaaggattttcctttccagtgaccagtgtgtagtcatagtcatgtctcattactagggcacttctatccggtgttggggttgctgggaaatgacatatatagattgcttggtgaacatagagtagagaagggggtggctcttggaactgtatatggtgagctctggtacattatccctgtgctatataggacagtacttttttcgtgactcttgtggtcatgtctgttgtattggacatgtctctgccctggagagggccagacagatttctccctgtgtggattgcactgactctaccatcagtgtatctccaggcagtatatacctttcaacataccgtctccctatgattagatccaggccagccttaagagttctggctgttccctgaactgaaatacagtcgtatttacagataatctcttaatttaagcactgagtgtaactttcagatggaaactctaagcaagtttttgaggggctatgtctgtcaccttaaaacattgaccatctttctgaccttcacttgctccattggtttgccgtggccatgctgggttttttttctctcaaaagcatcaagattatgctcattggagggtctttgtatttgctgttgcttctgcttggaatgtacctaccctaggtctgttcatggctgccttttttaaggcttaagtcttgactgaaatgttgcctcttcagggagatgttccctgaccactctggccaaagcatgctctacttttttgtccttcaaggagcctatctgttcctgaagttcttaatgtttgtcttgcttcactagaacgtaagctccctgcaggtacagaccctctatctcccatgtctagaacacattatgggtgctcagtaaatatttgactaaatgactgcaggaaaaagtcattaactgtccatctaaattttagttcactttcagcttgaacttccacagtggagtgaaaaaatgttctggttataatcattgattgcaaaagttacatgtatctggaaaactgcattgtaacactaggccatggacttacggggcaattaggtaataattaaagatgtaatgagttagtgtcactatttttcacagatagcactttctgttccgtatctgaagcactcaaaaaatgcagtcttagtattcatataaacatgtctttagttagcctttccttatcctcattgaatgactttgtggtatggacagtcagcatgagctccagggtcccagctccccactcactcaccgtgtcctcagacaaattgctaaactgtctgtgcatgcttctcttctgtgcaatgagaacagtaattccaaccccacgggattcagcgaaatgaaatgcttcacagaagcccctacacataatatccttcatagttggaggttgctagctgcttttgctccttaattaagcaaataaattaaacaacgagaatattggtgatacttgttatttctaaattgacgctaattgttaattgtgttttgtccagtatcggtgctaattatgagtggagctgacctattagatgatgtctatatttgtctaaaacattactactctagttcttgcttttttgtcataatagaattgtatttaaaattgtaagtacttaaagcaacatatatgttgtaggatctttttaagcaagatttttgttgataatgcttacagtaatttaatcttcaacaaaaacaatatgttgaccttaatacattggtagtgtattaataattttatgtttgttcctcaagcccagttgtgcatttccagtttgccatgacacagaagagcgctgtagacttgtgcttagctatgttctagaggtaagtttaagtttagtcttcacttttttcgtaaagtttgtacttgattatgcaaattacacttgtttgttggtatctaaatgttattctgaattgtgttctgctgcgatttttttttccttaagcataaagtgaaaatcagatttgtttttcccaaatctttcagatcaaacatagtttttgaaagtctgtttgtgagatggaaattttcctaaacgtattcagtagtccagatactgtcttatatttagttttcagttgacctgaagttagatagatagtgaatgcttttcctttttttgcagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaagtaagttgaattgatgtgcaaataaggccttcaatagaataatacactggttctttatcaacagcagacttatgtcaattaaggcattaattgaaaggcattgagaaaaagatatcctgtgaactggaattaggggtagtattctttcatttgaaatataaaaaggataattttgatgtttcatggacatttctaataagagcataaggagcctgcatcttcctgttacccacagtggggaactaatgcttcagcctggtggagttctcgctggatcgtgtaggagccacagacttagccagactgcctaacttcatatcttggctttgcgagggcaagttgctccacttctttgagtcactttttatctctttcaaaatggagacgataataatggtttctttaaagggttgttaaatgattaaatgattaatatatgtaaagtgctcagaacagtgtacataataagcactatagaagtgtaggctgttgttactgcacagtacttgaataagctacaaatgtcacttttaaattatctagttcttcaggaatataacatcatgaagaatatatggacttcgaagcagaagttgtgaatttcttattttaacctaagttgtatttctttttccaaccttatttctttcccccttttaaatcagtttcaattgtttaaaaaaaaaaaaagtgtagaaagcctgtatgtttgaagtacatctgaatcatagtggaagcgctttctggacccttcttcttttcctgaacaaacatggtggaggtaggagaggaatagatttatttccccagcatttatatagtgctgctggtatgccaggcttcggcctacaggcagtaaggagatcacaccaggacttttgccattctttttttctgaaatgccttttctgtctccttctccatctcccctgttgaaaatcctgctcaagctcagaatctccatgtttccctctgttctccatcagaattacttgattctcttaccactttgtcctgtgagcctgccttatgtcagagttccagcattaaatggttttacacacacatgcacacacacggttgtgaacaagaacttcatcttaattttagtttctcacaatgcctcttactcacagatgatgcttatatcagcagaggaaaaaaatccatacacacattaaaccataatgaagactaagtacctttcattgccttgaaagacttgtgttctagctgattaaaaaatgagaaaccttcaggctgggggaaggggtgggtgtttttgttatttgcagagcaaaattttccacagtattttgttctttgtctgttaattacacttaacatattttgttgtggtttatgttatcaaggatagaggccatataacttcatgtcacagtttccagtgcctggcacagtacttggcagaaaaatgatcatttgttgagtaaagaaggtagcgatgggctggactttaaataaagagtattccttgtagaggaaacagtaaactaagatgggagataggaaaaacaggcatgtttataggtgacaagcagtaacttaacattggctgatgggtagtaggatggacaagtaggaagtgagactgagaaacatgcaactagctaagtggggagaagccgttttcatgtttgaggacaggctttcacgctgatctaagctgtgctttaggaaggtaaactttgacaggttgacacatagactggaaaaaggagacaggtgtcactcatgaggttagctatgtcagtgacactggaagagaatgacagagttgccgatgtcagggaagcagaaggccttagaactcccaagtgagagtcttttaacacggccatttcactccagtgtatttaagcagtaaagcatagtatttaccagtcttgtcacctaagtctagagtgtttccatcaagaaacagaaaatattttttgtgcatgagacttacagtcaaatgaaatgtgctgtctttttttttctctccatgtcacagtgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatggtaagccactataaatgaatatgtttaataggcactgggaagagagaacagagaaggcatctgaatcacagtggaagtttactcctatttttctagtaaatctttattttaaaatgactgtttccaatcctgtgtgtgttaccttctattttagtttctgctcagtggtttaacatctctttgctttgaactacatgaagccgtaatatgtattgttggacctaaaataaacagaatagatacagtgctacaaagcgttcagctggtaacacagtttcttcatatttcctatgatcattaatttttttctgcatttgtgttttttcttcttccctccctttctaaacagatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggtgtgccacaggcttggaccacgtggttcacagtgggactgtgcagtctagctcatgcttatttgagtattcagaaaaggggtagaaatattagagttttgatatttgctctgtatttatttatttattttttgagacggagtttcgctcttgttgcccaagctggagtgcaatggtgcaatcttggctcactgaaacctccgcctcccgggttcaagcaattctcctgcctcagcctcccaagtagctggaattacaggcatgcgccaccatgcccggctagcccaccttggcctcccaaggtgctgggattacaggtgtgagccaccacgcctggcctgctgttttattcatttcctaattttaagattaagcatgatcttgtgtatttgtataaaatggtttttaagtattttataattactgtttatataactagaactaaatataaagtaagatatgaagacagttgtgtcaactttttattttattttatttatttatttttttgagacacagtctcgctctgccacacaggctggagtgcagtggggcagtcttggctcactgcaacctccacctcctgggttcaagtgatcctcccatctcagtctcccaagtagctgggactagtacatgcgccaccacacctagctaatttttgtatttttgttagagacagggtttcaccacgttgccccagactggtctcaaactcctcaactcaagcgatcctcccaccttggcctcccaaagtgctgggattacaggcacgagccactgcacccagccttgtgtcagctttttacactcttcttttcatgaggttcttctaggtaacacttgtagtcagctaacaaagccataggtttccttttgaaaggtataacagttggtgaaggaggttaattaaccttctgaatgattccttggggctgaaataaagtgatcattgtttttaaagttagttcatagccacctgtcttgcttaatatgtcactctgtttggaattgtcaggctttaaaactgggaagtagaataatctgatccgcagcagcgatatccctccctcttacctcagcacagtgtgtaaccacgctgccattaacacagtgaatgaagtaaaagatgagtcttctgaaggtgcttctgtaatgtctcatggggttgttttattatgctcttaaattgttatactgaatattacttgatgtttgcctcccagagttttagacaattcatagctagaggagtatactgggggagagggaaaaatgtgttattttgtaatagttttgccctttcttcccctctctccgtctttctcaaataatcatgttttaatgtagtaggaaagtccttggtgtatttttactactcccatcatagcaatttcagttaaatattctttttactctagtccccactagatggcatttttaatcttcgagggcttctgtagcagcctcttcagtgacttaaagttaatattgggacattatttcaagaactatttccattagttaaaaatagcaactttactttgtattagtggacaactttaggtccattctaataaacaagtgtacctgggaaaacctgggtcacagaaattgtttgatattcataggcaggaaaatatttttatccaacattaatatcccaagaaatataattttataaataaatagatctttattatgaaacttaaatattgttgtattgattgaatcttggtatacttacactatattgcattttttattacttagaatttagaatctcaggttcatttggatactgaggaagaaggaatcacatgattcgcattgatgtatcccttttttcttttcaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactaggtgagtatctctttagattcctctctattgcttgttctctcagaaaattatgctaattttgtatgagtcaagcaaagaactgtggcacttgattttatatcataaagaggtgctctattagagaacctcttattattcttaagaaatagaattaggaacacatgattttcccttggaatgaattatttcaatgttcttcattcttacttttgtactcactccatctgatcaattcagaagcaaatgggacatccagccatgtgccaggctctatgttggatatgtaactggctaaaatatggttctctcttcatgttgggaagctagataggaacacaaagcctcaaaatgctgtggatgagtaccgacgaagtataatgggagactggggaaataagacatttatggaggttataagttagaaggcttttgggaaagtgttgttgagcagggtgatgcaggatgtgtagagcatcagccggcaaatgtgaggaaaggagggcactccagaccaaggaggcggtgtgaggaagaagccagggatctcaaagggtgcaagtgtacgtttagagggagcaagaggcctgtgtgaggaagatgtgggatagtgggtaagtaagatgtgggatggcgtagtaagatgtgggatggtgtaagtaagatgtgagatggtaaaccatttgggcccatgttgaatttgagttcactatggaacatgtatgtgaaaggtataatttgtagtcaatttgaagtgtgctaagagctgtagggctagtgagacagactgagaaccattcacataaaggtaatagttgaagccgtgagaatagataagaatgtaaagcctggacacagggacagaacagaaaggggctgaggtagaactgaggtgagcaggtaagctgaacatctgtgggcctttggttttggttttggttgtttctttttttttttttttttgagacagggttttactctgtcgcgcaggctagaatgcagtggcataatcatagcttgccacagcctcgaactcctgggctcaagcaatcctctcacctcggcctcccaagtaatttttaaaaatttttttagagatgaagtcttgctgggttgcccaggctggtctcggactcctggcctcaggcagtcctcacgctttggcttcccaaagttctgggattacaggcatgagccactgcacccagcctgtgtgcctgttgatctgtgaataatgcttggcacttagggatacaaatgttgccctcaaagagttcattgctagtgggagaacctgtgcatttacggtgcatctggagggggcagtcagtgagggagcctggaaagtggtagtcaggaagctagggaaattggatacaacacaggttgtaatctcttcagactccatggggaccacgcttttggatcttcacaaaatggcactttgctcagatgtttttctttgcttattttaatatcatttggttaatagtgaagagggttatacttaagtgttgtacagtagaccccacttatccttggaggatgcgttccaagatccccagtggatgcctgaaactggagagtttttcagtgctttttcctatacatacatacctgcgatgaagtttaatttacaaattaggcacagtaagagattaacagcatttacaacagtatggcagcatcgttactcttgtgctttgggacattaagtcaaaataagggttacttgtacaaaagcacagcaatattgtaacagtcatctgataacccagacagctactaagtgactaatgggtgggccgtgcatacagcatgaatgtgctggacaaagggatggttcccatcctgggtgaggcagagcaggatggtgagagacttcatcaagctatgttagtgagctggggctgctgtaatgaaatatcatagactaggtgacataatgagaaatttattgtgtcatagatctggagactggaagttcaagatcaaggtggcagcagcattggattcctctcatgtttctaccttggcttgcagataaccgccttgtcaccgtgtccacacagggccttctctctgtgcatagccctggagtccctccctctttaaaaggacaccagtcatactggattaggatcccacccttacaatctcatttaatcttaattacgtctttaaaggacctgtcctaaatacagtcacattctaaggaactaggggttagggcttcaacatatgaactcatatggacacgtttaccttcatgtaacaggcatggtgagagcaatgagccgtggttgactgcaggtgactggctcgccaccacactcctgtcactgccatcctcctcttatctcatcaagagacagtgctaaggtttacactgatgtctgcttacacagttgttttctttctttctctgtaaagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggtaacacattcgcgtacatgttgggcctcacccattcacacctgtcatttatttacattttgccagtttcactaaaatactataaaactaaaaataattaaactctgctaatgatacaacaccagacagatcgtgaaaacacttgcaacctggcctaagactagtaagaattgagtattgaagatgacatgtggaattggaagggaaaagatgattctgcaaatggtttgtacaacgagcatgaatgtcaaatggattaaagattgacatggagaaagtgaaactgtaaaagtattagaagaaaatataggtagaggcttatatgataggttacagaaagactttcccagcatggcacagtaagcagaaatcctgggtaaaagttgaataaactcaaatgtgtaaaattaaagttctaaaatgcacaaatgtataaaaaataaagatctaaaaatgctcaacagaaactgaaattgaaagcaaatcatagagatgagaggttaatatactcttgctgtataaaataagaatcattgaaaataaaccacccaaagagaaaaaagagcaaataaccttgaacagaaaatgtacacattttttaaaaaaagtaaatggctaatatatataaaagaaaattttcaaagtttagttttatttatttacttttttgaggcagagtttcactctgttgctcaggctgaagtgcagtggcacagtcttggctcactgcaacctctgcctcctggattcaagtgattctcatgcctcagcctcctgagtagctgagactacaagcatgttgccaacacgcctgtctcattttggcattataatatttttagtggagatgaggtttcgccatgttggccaggctggtctcaaactcctggcctcaaaattgagttttatttattagattgccaaattttatgacaaatggtcacacccactgttggagagggtacaaagatatgagcactcatataatggaggaattgaagccatttaaatgacattagtgaagaatgttggtggcataaatttttaaatgagtgaccttttttgattttcttttttaaatttatatatacacagaaaagagtgaataaataaacaccagaaatgtagaaattattgctgggtgattaagtgtggttttgtttttggtttcaatataatggccatgtatttgaggattggggtaacaaggtaggaggagatacttctttttacgtaaaatttggcaagtttttaatctaatttactagttatataaactgtaattttcatttagaaagaaaaaaaaaaacaaaggaaacaagtgcatcatcatgctcagcctgagtcagaaagcagcagcacggattggcttcttgtagccttgagatgggaacacagagtggtcttcagtctactcggaataactttcttcattgaaatattttcattgacttacttttttcatttcctcataatattgtctctttataaattatcccaaaattaaattaacatctgggtagttgtgaagtgtgttttattttaatgcagtattggtatatgtttaagctgagtcagaaatgtacactgttttctcctttgcaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcaggtgataatatttgctggagtataaaataagttctcaatctaattcccttgtttaacaaatatttagcgtctgttgtcttttccctaataagcagtatttaaacgttttaaaaactcctacagtcagattagaagcttatttttttcttccccctcaaaacaagaacagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggtattgtcagtccaagttaagtacagtgccacatcagtttaaaagtgttctgggtgctttttgtttttttaacatggtcatatatgtcttccttgacgtccactcaggtgaactgctgtcctaaattttctgctgcgtctgtgcctttttttgtgctgtgccacttaaacaatatgtccgcattgtgctccatgttgagcatgggaaaacgaatccgctgttggtgttctgtggcttactgcctgtcacttaacatcgtgtttttgagatacatctgtgttggcacacgtagctgttcattttctcagctcagtagtcattaaatgactatatcttagtttatctagtctatgattagtgaattttggggttattccagattccagtttgatgctattagaaataatctagtgccagcaggattgtacatgaatcctggtgcccaaatgcctgtatttctgagaataatctgaggccgaggataaaggcacttccttccgagagattgcttggcttttgctgcgagtcttgggcctgtagtttctcagtgatgtttttttgtttgttttgttgattttccccccccgtaaggtaagactacttaccttacagtccctttggcatgagtttacttctgggttgcctttattctgaaaagtatcttttgagatacagcttaaactggagaagttctttttctttttttttgagacagggtctcactctgttgcccagactggagtgcagtagcacgatctcagcttactgcaacctccgcctcccaggcctccccactcttttgcatatagatatctagttgtcccagcaccatttgctgaaaagactactcctctgctgcattgtcttggcacccttaagcttgcttttgccctcaggatattaggccatctgggcaaacctgaattttggttgaggacttcctaagtcgaagtggaaagaaatcttctccagttcatgcctgtaatcccagcactttgggagccgaggtggttggatcatttgaggtcgggagttagagagcagcctagccaacatgacaaaaccccagaaaaaaattaaaaaattagccaagcagtagtggcgggtgcctgtaatcccagcaacttgggaggctgaggcaggggaattgcttgagttcaggaggcggaggttgcagtgagccaggattgcaccactgcatctccagcctgggcgacagagcgagaccctgtctcaaaaaaaaaaaaagaaaggaaatggattaaagacctaaatataaaagctaaaactaataagacctagtaagacccacagtgggggaaaaataactaagaagcacttagtgaagcctgaagtagttaccgtgaaggatttgttgcttgttttggtttggttctaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtaagtcttaattttcatttctcagatatgtatgcattggcttagtgctggattgtcttagagtaaggcaggcctgtgaatctaaataatactattttctttttaatttgccccatagttaatgacttcgggtagagagggtgagaaatcactacatgttttgaagtgctttttaaaacttagaggaatgtattagattatgttcagtgactagaaatactgagatatggcccatgacccctagtttggaaaaaaaattgacaaataaatttagacagttaaagaattcaatcggccaggcacagtggctcacgcctgtaatcccagcaatttgggaggctgaggcaggcagatcacctgaggtcaggagttctagaacaacctggccaacatagtgaaaccccgtctctactaaaaatacaaaaattggccatgtgtggtggtgcaggcctgtagtcccagctactgaggaggttgaggtgggagaatcacttgaacccaggaggcgaaggttgcagtgagccaagatcgtgccactgcacaccagcctgggtgatagagcaagactgtgtctcaaaaaacaaaaacaaacaaaaaaaaagatttaaatcggcatgaaaaatttgggaatggagaggcaacagtaaaggagtagtggaccttattgaaccccttaaacatagaactgacccttggattgtggttccagaacagacactactgtagagcctgaccgaggtcaagataagtcgggagatagagaagggtgaaagtgagaatgctttcttatgttattttccatggcatggagtaagcagatacttcaaccacttaatgatttttcctaagttctccccctctctctcttgctcacctattctcctctcccgcagaggagtcttttgagaaatatctcctgtgtggtaaagaaacaagaaacaattatttgaagtgcagcagttcatttagtttttcagtctgctgtaaaataaggttaatactttaaatctgtatgacttagtttacataatacagtagcccctgaaggatgcataagaaactggtaacattgttccctttggggaggaaacctggaaggccaagaggaggggttttgctgcatacccatttggaccttgtaaatttgggaatgtattacctatctaaaacagtttctaaaaatggtttttactaaaactaattttttgctggcatataacgcatggctagatgtgtgggacagtcaccagaattaacagtagctctttatgtgaggaaggtttggggagagtgatcttcagttttcacttgcacctttgaatattctgccatgtttgaattccttagaatgatcaagcatcttttttgttgttggggttttgttttttgttttgttttgttttgtttgagacagagttttaccctgtcacatgggctggagtgcagtggcatggtcatggctcactgcaaccttgaccatctgggctctagtgatcctcagcctccccgagtagctgagatcacaagtgctaattttggaaaaattgtttgtagagacagggtctcactatgttataagcccaggctggactcaaactcttgagctcaagcgatactcctgcctcggcctcccaaagtgctggaagatactggaacaaatttgctaagatgataagtgtgtttaattctctcctttaaatgttttactactgtgagtactttagaaaataatgtaaatattttagagggttttgttagccaggtttgtgggttttgtaagccaagttaataaatgctctagtttgtgacaccttttattctatcttattttacccagtgtttttttttttgttttttttttctagtacatatgattcagacctcccttcctaatgtctatattgtctggtcgttgtcccaacaacactttcatacataagcaatagcttgtcttccagatgccaaatctatgctgaaatcacattgatccattgattttaaagagaataggttgtttagaaagtgtgggattatacttctaaaggaagaaggcaacagttattctctccccacccgcagagtcggggagtccccaagaccattgtcacttctcacactaactacgagtctgtcggcggtctccaagaccaccctcaggtttgagaatttgctaaaggactcacagaactcactgaaagctgttctgcttacagccacaatttcttaacaatgaaaggatgtacattaaaatcagccaagggaagaggctcgggaggcagagtcctggagagttctaagcgcggagctcccagttcctctgctgctggagttacagatagtgctaactcaccccggcagtgatgcatgacagtgctcaccaagtgtatcaatcaatacatgtacaactgcggaagctcacccaagccttggtgtccagagttttcattggaacttggtcagatagacatggttgactgccacgtggctgatctttgtctccagtgcctccagaggtcaagctgttaccctggggcccaaagtccccacagtaaatcccattgttaggctatccattgtgacccaaggacccccaggtaaacaaaggcgttcttaccgggcaggacatttcaaggacttagtggttaccttctgggagccaaggacaaagactaaacctctgtacaagatttaatcctctactgcacaccgcacacaattgagttctaggagaacaggagcaaaggtgtcctgtagtatctgatagctctagaaaaattgtagttagaaggctctagaataaaacaaaaccttgttcatctggtctgacttcctgcctttgaacagagatgtaataaactattttacagataggacaactgatactaagtgcttatgtgacttgaccacacaactggtaaaatgtgaggtgggcctcgagccccagactcttttctgctggtcccttttcctaaggctcctgttctgaaaaagtggcctgtcttgacaaaaccaaatggtggggcagggaaacaatgattatttattgctttgtccagacttagtatttttgtcaagggaatattattaaatagaagttggatttagaagatttaagattctcattagcttcctttatagcattttgaaagtctgaattttcattaatacattaacattagatgggtttctagatttatattaaagaaatgaacgttttgtatttaaaactttaggtcagaatagcaatgttggaaagttgaaaacactatctggggctcttgatataatggtgagaactgagcacgcattccagcttatccagaaggagcttatagaagaatttggccaggtacatggagaaaatgactgtctttggtttttgtgtgtcttaagctacatggtgaatgtatatagtggacgtgtgtgtgtatgtgtgtgggtatatatacacacatgtacatatgtatgctatgcactaaaacattttaacagtgatttgttatatttgcctggtattcatctcctttctttaatttgcaagtattttaaaatatttttaagaatatatctcaacaagaccatagttaacaaattataaagtctcttaagtttttttgttgctgttggtgggaatttgttttgttttatgttttaaaagaaaaggcctgtgccctcttttctaatttccactagaatgcctgggagcagttgaatggtgaatgggcctaagcaggctcctcaggaaggaatttctcgttttctgggcattccggcattcattttaccttctgctgttgctaaaagcttcctgaagcccccatgttgcgcccacctattgctcttctagccctgcttggtcaaatcctgtgtggtaccgtacatttctgcgttgtgtctaatgttggaaagtcaggattaatttcttctacaaaagtgcctattggggctgagacattttaattatgtgttttagtctatcaaaatgatcataggtgtgctttttgtttgtttgtcttgtttagggttaaaaatgtattggatgaatgaaactgcagttccatcacttggtacgatatgaaactacagttgttggatagctcgagtaaaataactttttgttgtttttagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaaggtaaattaagtggttatttgtaggaatttctttcctagcaccctacctataaaaattttctctactaacatcataaagaaaaactaggggccaggcacattggctcacacctgcaatcccagcactttgggaggccaaggcaggcagatcacttgagttcaggagttcgagaccagcccggccaacatggtgaaaccccatctctaccaaaaatacaaaaactaaccggtatggtggcgggcgcctgttaatcctagctacaggggaggctgaggcacgagacttgcttgaacccaggaggtggaggttgcagcgagctgaaatcacaccactgcactgcagcctaggcaacagagtgagacaccatctcaaaaaaaaaaaaaaaggaaagaaagaaaaaaataggttgtattctgtcttgtcttctatgtggatagtagaattttaagtggtgttccttcttgacttgttaaactaggtaagaaccctctccacaaagccttctatgtattgaaattacagaaagaaagaaatcttgctgcctaagggcaaatactctgttgttaacgttttccttgagggagatgaataaccctggaatgaagatctgcgtttctagtgatgcttctgaatgttgtcattaatggagggtctcgactggagtttgatgctcagggccaagtgcactgcagaatagaggacagaacacagaagcaggagagaagcaggagagaagagcgcacacctccgcagaaatgttctaatggccctgagtcatcttgttgcgcttacattcttttgtcaaagtttgttattttggcattattgatttaatttgaaatttcagtagtaagtactagatcaggaaagtaatatcaatgatatgccttccttgtttttaaatataagtgcaatctggccatattacaaaatttggaaaatagagaaaaggaaatgacaaccatttatcctaatacatccattgttaccagttatcttatgtatattttaccgatgtataatcttagggtacagatcatttttgtctgtttatttttttatgttacatacagtaaaatggactctttgtggtgtatacttcttcaaaccttgacaaatgcatatagatgtgtgcctgccaccacagttatgacagaaaacagttccgtcactccaagaattccctcctgctgtcccctttgcagtcaaccctgcccctgcccccaattcctcaggatctcagggagaaagttttcagtcttttaccattaagcctcatatcagctgtggggctttgtagaggcctttatcaagttgaggatgttttcttctattctgaatttgctaagagtgtttctatcatgaatggatattgaatttgtgtccagtgcttttattacatttattgagatgactacatggtttcccttgtttagccttgtttagtggattacgttgattcttcagatgttaaaccagctttgcattcctgggataaatcccagtttgttgtgatgaaggattctttttatgtattactggatccagtttgctgatattttgttgataatttttgtgtctatgcataggggatagtggtctacagctcacttttcttataatgggtttgtgtggtttgggtattagaacagtgctggcctcataaagtctgtgggttcatgttccctcttctgttttctgaaagagattgtatagaattggtactatgtcttcattaaacatgtagtagaatttaccagtaaaaccatcttaacctggagtttactttgttggaagtttttaaacggtgagttcaatttcttttcatggatacagtattactcaggctgtctttttcttgaataaacgagggtccatcatctaaattgtcaaatgtatagattcacagtatcccttattatccttttaatgtctaagggggtttgtgatgatagcccttcttttagtcctgatattggtaatccttctgtttttcttggtcattctagctagaagttttcgattttttttttccaatcttttcaaagaaccaacttttggcttgattgactgtttcttcccctcattgtttctctcttttaaatgtcatcaatttctgccgttcatttccttccttctacttgttttggacttaatttgctctttttgtagtttcttaaggtggaagcctagattactaatttgagacatttttcctttttaatataagatttgctgccaaaaattttcttctaaagcactgcttttgctacatctcatatatttttgtatattttcgttttcatttgtttcaaaataatatttgatatcctgagacttctcctttgacccatttgttatttgaagtgtgctgtttagtttctgaatattgggacttgttagctatcttttgatattgcttgctagttgaattctattatgtgctgagaccataactgtgtttgttctcttctttcacgtttgtgtagatttgttttatggcctagaatatggtttatcttggcacatgttccatgtgtacttgaaaaatctgcgtgtcctgctgtttggggtaaagcattgtgtaaatgtcagttaggttaagcgtgttcatagtattgttcaggtcttctgtattctcactgaatttctgtctattgctatcaatttactgagcgaggagtgttgaagtctccagctacgcttatggatttatctgtttctcctctcagcactgtcagttttgtttcatgtgtttttgaagctctgttaggtacacacacgtaggattgtgatatctgggagaactgacctccttattactacagatgtccgtccctctttgataatatagctactcaacgttcttttggttaatgtctttttttgtatgtcttttatattaaaattgggtttcctataggtggcaatagttgggtcttgctttttattttttatttacttatatttatgtttagtttttttgagacaaggtctcactctgtcactcaggctggagtgcagtggcatgatcatagctcactgcagccccaacttcctgggctcaagcaatcccccacctcagcctctcagagtagctgggaccacgggtgtgccccacgacacccaactaattttttaattttttgtagagatggggtcttgccatgttgcccaggctggtctcaaaactcctgggtcaagcagtccaccttccccagactcccaaagtgctgggattacaagtatgagccactgcacctggcccaagggtcttgctttttaaatccagtcttacaattggtgtctctagaccattcacatttaatatgattctttctctgccttctgttaattattttctgtgattccattttatttcactattgatttattatgtgccactttttaattattttggcagttgacctaggattttgcagtatacatcgttaatctttcatgagaggccaccttcaagtaatatgatactgctttacatgtactgtaaagaccttctaacagtagactcccaattccttcctcccgtcttttgtactgttattatacgttttacttgtacatatgttataaacagaatacactgctactagtttttaccttatacagttatctttaagagcaattaaagggaacaggaaattttatttaccttcatttattccatttcagtactcttactttttgtgtaggtttctgtctagcatcatattccttctgcctgaaaaacttttagcatttagcatttgtaggtgtgctagcaatgaattctatcttttcaattgagagagtttttattcttttttcagtcttggaagatctttgagcagagtatagaattctgggttaacagtccttttcattcagtactttaaagatgtcactccattgtctctggcctgtgtgttttctgaccagaagccagctgtgtttcctacttttgttcatctgttagaaatgcatcttccttgcctgtaggcgcctcaccccccagcagtttaactatgataggcttgagtgtgtcgtgatggcttttacctctggcttcagcatttttctttcttctgttccattctctctcctcctctgtagcccgttatgcctatgttagactgtttgatgttattccacagctcttggatattccgttctggtttttttgatgccattttttcctttttgtgattttgtttgggtaatttctgttgaactgtcttcaagttcatggattccttacttggttttgtgtcatctacagttgaactttttgaaggcattctttgtctctgttacaatgttccttatttctagcaattgccctgggttcattcttacagttccagctctctgctgaaatcaccaatctgaccttgcgtggcatccatcttgtccattagtgtcttgaacatactaattatagtccttttaaattccctatgagatagttccaacatctgtgtcataattagctggttctgttgattctttgtctcttggaagtatgttgttttttccttgccttccgtatatctcttgtttgttgaaaactggacaccttatgtatgatagtagagaccaagagaaatattttttttttgcctggaattttttgtactttccccctgctacggctttagtgtgggaagtggaattcatttttctagcctggagttgagctgtggttgagatttttttattgcgatggttaccttccatgtaccacaggcttcaagttttcctagcagtcctcgtgtgtagggtggaacagatctgcagaaggtgattcttagtgtcttctctaccttcagctctaggtctttcttttgttttgcaccttagagagggtctgtctttatactctcacagttcttccagccatattccactgtcactggtccttcggtgccttttcgcctgtttgggagggagcagggagttagcaaggactccatagttgtttaagcctcagtccaggcagacactcgtgtccctgagtctcaggactgtggccttcccactgctcctgcacccccacctaacccttcagagtgtttttttctgttcccttcccctctcttcattgactttaaccaacgccctaaggttggcagggttcattgtcttcccccacccccattgagtcttttgtttcatagaggagaagggtccaggtggggttgctggtccctcccatagcagctgctgttaccctgtcataggtctacagcaggagggtcagtctgtcaggattctcactggtcttttatgtgggcatttggtgaggtccttggagaaaagccagtaagaagatgtgaaccccctgactccacagaggccctatactttctcaccagcctcactgggcccccaccaacccattcactattttagctaaatgcttactggcatctggctgcatctgccccaggtaaggaaggactgtcctttctctccctgtatcagcctgtctctccttagattgcaggctagttggctgccccacctctctcatggatttaagaagagccatgaccttgtagtttgccctgcttgagccagagactttttccggttctgcaccatgaatagaaacttctttcaataattgcctttgaactaagtgccatggcttacacctgtgatcccagctatttgggagactgaggcaggagaattacatgaacccaggagttcaaggccacagcaagctctgatggcaccactgcactccagcctgggagacagagcaaaacccaactctttaaaaaaaagaaaaaaaatggcttttgaataattctctatagtctaaggagagcttttatttggttgtgtgtgtttttatttttatttatttttttttttgagacagagtctcgctctgtcgcccacgctggagtgcagtggcgcaatctcggctcactgcaagctccgcctcccaggttcacgccattctcctgcctcagcctcccgagtagctgggactacaggcatccgccaccacacccggctaattttttgtatttttagtagagacggggtttcaccgtgttagccaggatggtctcgatcttctgacctcatgatccacctgcctcagcctcccaaagtgccgggattacaagtgtgagccaccgcgcctggccttatttggttgttaatccacagtgtctgcaccatatcctggttgtggtacacagcagcgggtgttgatacactcactgtaatttagcagagacatccatctttttgaagagccctaaggcggagcagatactgcatatggtaacaaggcttggaaagaattcctgcctttttctaacagcagtgggtaaagtttttaaatttgtattggtttccacaagatggtaatataaatatatgatacatgagaaaaagtgattcattgatttttcacaagtcaatcatttgagtaattggtaataggtaatagtttcagttttatcttttataactgtaacagtcatatgtatgacctaagtaatttttattttaatggaaggttttctaagcttctgtttatttaggttattaatattctgctgaaaactattgtaatctaaagttttcatgcatgacacatacaatcttatttagctaatttatattgattttaaggtttattaaacttaaatgtgataatgtgttaataaaataaacactttgacaagtttcaaaacaaaaatattaattactaagtcagtgactatttcatttttcactgatgtgcaaatgaaaacatctataattttattgttaagaggaaaataccctctgccacaggcttagttgtttcacagtgaatacatgaacattctcttttgcaatatagagagaaatcagaatgagacctaaaagaaagaaaatgcaatcagccctctgtatccaaggattctgcatccacagattcaaccaaccacagactgaaaatattaaataaataaaaaataatacaaatttaaaaagcaatatagtataacaactatttatatggcattgacattgtattaggtattataagtcatctagagttgatttaaagtatataggaagatgtacacagcctaaatgcaaatgctgcaccattttatatcagggactccagcctcctcaaattttagtttcctggagggtcctggaaccaatcctccacagatactgagaggccatgttaaacaaatttttgttttattttttgactactgctttttccacttcatgccctctggcaaaaaaataaacaaggcttaataattaaaatcttaagtttattagattcctatagaattagagtgaaagatgcattttacttgtttaaaaaaaatttttgttttcattttcaggtgatgcaggcatttcatcatcatatgacaactgcattggcattgacctgctagaaattctagcagtagcagtttgttaggccaaaggttttctcttttctctttttgaatttagaatttactcttctactgtattttaatattcattgctttcacagatccaggcctcttaacattttggtggctttgcggtttaatataatgaaataccataaaaagtagaagtaatctctgaagattcagggagctctctgctgcagtgctaagaacagatcctttggattcatgggttgttcccattagatgtgtacatttaatattttgttaagattagtaaaaagggagatgaaagaatgtaagttagttccctttagaaaaagcctgtgagatgatggagccctctgaataggggtcataggtcagtgaaactgctgataagaatgcattaaggaaggcgtgatttgtagaaattggaagatgaagatttaagattcagagttatggttaggacaaatcaaaagattttaagtttatgatccctgcagccatcaattatctttaggcacccaactattaataaaatgacagtgtgatgtcattgtccacaaagaataagtcatctttcaaatgccttttctaattgttaagtgctaatgccttgattactgtcagagtaatttaaattttctataagattatcaaaggttttgtgactgttaactccccacaaaactaaaatctagccaatcttaggcccagattacagatagggaatgcatttggaacagtcacttgctgtactgtggttgttgggggaaggcaggaggagatttgcctgataaaataagtgggaattggaggggagaaatgtctaaaggcagcgatggggatcctgtggaggaggaatggagccaggaataatagaaaggggaactcctggggaagggagctctgcatgctggctgctctgtggcaggcctgactggcaagcccttgggtgaagggagaaaatttgtaccctgaagaggtgaaagagcatagcatttgaaattggaaaacatgacattttgaccttagtccaaactgttaacccttctgggccttaggttttacatctgtaaattcaaaatgctagtccttgcctatctgaggggatgggattattgtaaggctcagatgtgttcatggacactgaaaagagttgtggaattgttacctggtatctggttatgtgagccaggggtctccacctggactcatttaaaaaaaaaaaaaaagatgctagatatgaactgccacgtaattactagtcttttccagtagtaacaaaaatagaattcaccgatccatcataaggggtaaatgttttcaggacaaactgtaaactgaaatagttttcaggtagagtactgtctagtactcttcagctgaggggcagtcttcacacagaattgcactgacattttcagagtaaactgagatgcagcagttcttgtaattcaggaatccatgtttaaatcctaggtagttctagctctagagacggcagtacaacagtggctttagatgtgtgtttatgacacaggaaggcgcttaggccgagcttgaggaacagaggaaatactgcatagctccttctgtgccctcacccggctccactgcattttcttcatggccgtccgtctgtcactctcttgtttactatggtttcccccagtgcctcccctcccctcccccaaactcctacctcaataggatgcaaattccataaggcaggggcttctttttgcctgttttgttctctgtcaagagcaattcctagtacataataggcattcaaatatttataaaaggaatgagtactggatttcattgatgtattgaaataaatgtgtagaaacaggcccatgagcaatatgtaaaagaaggcaggtctgaacccggcaggagaggaatgcctgctgctctgtgaagagtgactgttgggctgtcactgtccggttttctggacctctgaattgtcggtaggcattgctggtcccttacctgtctctttttcttttttaaccctagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtc

SEQ ID NO: 37895 - DNA, 9569 bp, Homo sapiens
cagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggtatttcccctgaacgaatttcggggagattaaggagaagcgagaatatttctagagggcctagacttctctcctgggcatcagctttcatctcagatcagggagaaagagggtccccagatctgagcacaaggcctaaaggaggctgtttaggagagggtctgacaggcagaaatgggatctcctgggagcaacaaccacaggtggggtcgtccgggcagtgatgagagggcagagcagccgaccacaggggaaacagccaggcggcagcggtgtgcgcaacgaggagggataaataaaggaggagtggggtcctggaacctagaacagccggttccaatgggatctcctcccttccctccctcccaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcgtgagtgttggggcagggtggggacggtgcaggagcttgttgacccagcactgcagctgagcaggagagcagggcggcaggatctcccagggggaagcgctgggcaaacccccagagtgcccctgcccgggtcactgccctgtggtctacgtgggctgggcctgggcctgggccccagcgctctcctttgcaagcctgggaaatggtggggtcagtggctggcagctcacaatctcagttcctcaggccgtggagggtcccttgtaccgtcaatagggaggcaggtgctgccaggactgggtctgcagtgctggaccacggaggtcaccctgctcttggcctgtaggtgccgagcttggaagacctgcccatgacctcaacttgtccatcacccttctgccaagacccgcgtccctggccctcccccaagactaggggatttaaaagttaaaccaccctccccacccacccccccagcctccctaagacctttccctcctcccacaggcagatgcccaactaggaggagagggtttgggggttctctccatttatgcctgagcaaggccccagcgaacgggggtggtgtttcatagggtaaaaggaactgcccattctgaggtagggcagttggtgagcccccgaaggttggaatctcctctttgtggggttagggggtttaccagtgccagaaaggaagagagtgttaagagtggaattgtagggctctgttttgttttattttgtttgggtttcttttgtggggaggggttgttttttggttggtttttttgttttgttttttgttttgttttgtttttgctctgtctcatttctgtttccaactgggaaattttttttaatggcaagagaaaaagaagctgtgaaaagagaaaagcgagaggaaaagtagaagaaaaagaaataagggtgagaaaagagcagagacaggagaaaatggggaagaggaagaaccgatagagagagagagagagagagagagagagagagagagagagaaagtggagaggaagaggtcaggtacccaaagaatagaaaagctcgggccggggctggtggctgccggctgacccccaccctccccgcagaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaaggtgcgcgcggcgggcggtgggctaagcccctgcactgacgcccctcaacacgtgcaggcccaaccgtccgttcatcgcccctcgaagccccctgcacgggatccgcgctcttgcggcccgcccccgagcaccgagcctcgcatccatacgcgcagcactcacggaagtcctcaaggcgccctctcaatcccaccgcgcgcacacacaggctcccctggggcgagcgaacagctgggccgtcgttctgatggagatgtttacttaacaattagctgagactccgggcccgcgctgacatttttacattttattcgtttatttcttggctcaggaatgagaatgtaagtgaagagagggcgcccgaggcaatctgcccaggctctaccgatgctcagaacccggggcccagttttcactctctcggggggagccagagggtgggacaggtgacacagccccccaaagcactcctggctactgctctgggtcagtctaggccccagaccccttgggaggcgcttagagaattaccttccaatcaaagggctttttctgcttgcggcttctccacccttgttctagtggggcagagcatcacccctctaggcctgtgcccttgtgcgccactgtcgagtgaaagagagggtacgagtgtccgtgccggtcgttgtggctttgtgaaccaaggtgtacgctgggctgtgcgtgccccgtttggggtgtgttggatacctgtggaggcatgtgaattcgtttggttccgtaggcgtttgttatgtctgtgcacacttgcgtgtgtgcgagcccgtgagtgtgatttggctttgtgtgtacctgcagccttgcgtgtgaactgcagtctctgttcgcgcctgctcgggtgcggagtcgtttaacttgcgcaagcccgcgggcgggtgtgcatgcttgggctggttccgacactgtggcactgctttaggcctgtgtggggctgtctaggcctgtctagggataattcctcgaatgaagcttttggaggacagaccccgtcgctttccgcgaggccctcccaccggcctcagctcggggcgtcccatcccaggcgggtgggtaccaagtggacgctccccgggtcttccctctgcggccagcacccgctgacctcggggtgccaccgaccacgctggaagagccacggcctgacttagcgccgcccccttggtccccgcagatcacacagctgaagatcgacaacaacccgtttgccaagggcttccgggacaccgggaacggccggcgggagaaaaggtgagaggccgaggacagcagccctgtggcgggtgcccgcgggagcagcgagcaggagggatggagggatgggctccccgctgacctggttcatccgctcatccccaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgagggtcggaccggaggagggacagggaggtggcggcggggggtcctcaggtcgctgggctggtcttttgctgagccacccgctaacctgaaaggccaggaaggaaacgtcggcgagtgtctgggatggggtttccgtcccgggactcccctacgagggcggtccccggtagccagaagatccggccggactccgagcctggccccttgggcgccgtgtaattctatagctgtagggtttcctctccagggctgggttccttccactgtaaatctggggtcttggattaggtgacctgcagctgccctttgcccgactccagcagctcctccgactcggcctccccgagagcagcccttcccgagtgtccctgatcctgctcgtcggcctccgcccaggcccctgtaatccgcgcgccctctccccgcagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcaggtaaggcctgtgaccccgcggcagcgccagcgagggagaaggcccagggagctggcggcgaggccagcggagggcctgaggggtgccagggtcgctgggatcctctggcaggcaagaactccatccaggggaggccccgggatgccctttaggacacctgggttctgagagacgaggactgtgttgtaagtccaggggctggccagggcgccgcttctgactcccgtgtgacctttggcaagtccctgaccctctctgggcctgcttccttccctatagccccagcgaggagtgcggtgcccatcgagactcttctcaccctcacagaccagggccacccctggcttgtgaagtcttctctcctggcctcaggacatttttcttgagaacaaagacccttggctccctgtccattctgaaaggctaaggtggccagacagacaaagggagaaggaacatttgcattattttctggacagttgaccaccagccctcccagaggtctctggcccctcccaggccttctacgaagtcctctgtcctggtgaaggacaaggctggtctttcccctaccttgagttcccagcacccccagccacatgtcagggatgagaactcagctcttcaggccccattgaaattccaagctcccaggggagtgttgacgaaaatgtggctggggcacagtaaggagatccgatggggacagtggcctctttggttgcttgggtggaatattccctgtggaaagatttggaatctcttcattcattttcttccctctgaggtttctggcaaattgaacccctgagatcttatctcaagggaaggaaaatagcagttcaggtctgagaaagctcctttgcttcagcagcaaatattttaaaagttgggttggtgggtgggggggtggggggttgggaggcaggcgattctgaaatgagttttacacacagctcagtgttagggtgtgtggagtgtttgaggtatcaccatcactcatctggggctctgggctggaagggaagcctctggagaaagttcagggcccagaggtttaatctgcacccctgattatttgtgtatatgaatgcctcctccccagacaaactggtaataatcaccagcatcacagaggtcatgaggaagtcagggcttctagacacagcctggccaacaggtgcatgacccgggtgagaataccagcacctgggaggcatccgttggtagggctgctggtggttacattcccaggccagtgcagcccatcccagacatcaggtagagccaaatcccaagagaactgaagcctccctccttcctcccaacctgggatgccaggtctgaaatgcccagtaggacctgactgtctcaggagggggtattttctcaggcctgatgaagctgcctcttttcttcttcctgctagagccaggcctgaggctccctgggagcccagtgcaatcatcagccccctgccctcctccccatacccactagctctggggagtaagccattatctcaaaggtcaggccgtgcaccagccagacctcatgaactcaggaaggtgcttgtccaggagttcctggctgctgtgcccttcacaggcaaagactgcattccttcctcagctgccagtgaggtgctgccaggcattccctgtagaactttcaggccagtttatgaactggttggcacccgtgtcctcctcctggcccaggcaggagaaccatgagcaggcagaaggagactttgcaaagtgccttccccagcatgtgtgccctctgcccttcagagcctgcagataggaggggtggcgaggacactgttctcaatgagcagaacctccaagacacccaaagctgcctgtttgccacctggccctatgcctgccccgttttctccctcaaggccttcacccgtgctagggcagtcacctggaatgtcctttccattacccctgctgtaatgcccagcacagaacttgatggcaggcctttgcatggtagcctgaagcgatctcacccttctaactgggtttggccacaggcacactggctcatgcttacctgtgctgcctgtggttatagttatgcgaattgtggttttacatccctaaaacagaagggcacggtgtccaggggatagcacccagcccaacttcagaaagacttcaggcaagatgtctaaccctcgtcttgttctgtttcttccagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaacgacaaaaacgcaagaaaacaataaaacgctagaaagcg

SEQ ID NO: 37896 - DNA, 5860 bp, Homo sapiens
agagacttagagccgagtgggacaaagcctggggctgggcgggggccatggcgctgccatcccgaatcctgctttggaaacttgtgcttctgcagagtgagtgtggggccctgggaggcgggtggggggtggcacgtggggctgtgcgagtccgtttcggacaaaaccgcccatctgagcttgggccaggaggagtgggaaggtcccaccagggaagaggacgggtctgggggcgctcgggagagccgcttgccagaggctgtgacgtcttcagttagactttggccagcctcccctcctagggagttgaagcccagagggccaagaagggctgggggcccaggcacggcggcgtctccctcggggcccctcctgcagcccctcttgctggggctctgtttagggagtgggtcagtgattgaaggggacctgagaactgtggggtctgttccagcccccgctcccaggcctgggctggctgctgaccgggcacattcctctgggaagctcccaggctctcggccacatctctggggcagttttcacataggatctatgtgagggagagcagcccccagtgatctagagacacaggatagaaacagcttttatcacccacgggccctggggtgcacagactgctgggaggccagggaaagtggagagagacagggacccccaggccaaccctttattgggatcagggcgttctgcatacaggtttccctcagggaatttttttggaggcagtttctctctcgccaaggaggctgcagtgcagtggcgtgatctcggctcactgcaacctccacctcccgggttcaagtcattttcttgcctcggcctcccaagtagctgggactataggcgcccactaccaccccgtccggctaattttttgtatttttagtacagatggggtttttcatattggccaggctggtcttgaattcctgacctcaggtgatccacctgccttggcctcccaaagtgctgggattacaggcgtgagccaccatgcctggtgggggagttttaactggtgggtttaaggcaagcggcacgagccccgtggggccacgctgactgtggggggactccgtggtgcagctgcacagtccatgtggggcgtggggtctgtggggacacagggggtggtcaccaggggacagtgcgtagggcgggcgtctgggtggatcagctcgaggacgggggatgtgaattggaaactgtcccgggtggcagccccgcttccggtcagagaaagtccagcctagattcagagtggatgccgaggcggcctacgacaatgagagtccctcaagcagcaacgcgggcctgtggggcggcagccggggtcacgacccacattcagccttcaggcctctgccctgcggaagcacctcaggggctgcgctgagccttaggtgtggtgtggggtccccagcgtctgagggtccaaggaccctcgggggctggggcacagccctggagggagcgtgggggaacccacagatccagcctccttggtgctctgggtgacttgggtgcagccaggtggagtggccccggtgacaagcacacaccccagaaccggctggcttggagcctggccctggcccacgcccatgccctggcttccccactcaagggcaggtgccatccaaagcccagcacggtggcagggagggctatgtaggtctgtgtgagaggcgtcctccctgcactgaagtgggtgtcacagcatccactttgggactacaggagggactctgggggccaagtggggggtctcggggctgggtggggctgtgggtggcctctccagctcactcctctccttccaggctctgctgttctcctgcactcaggttagtgaccccagccccagctgcccacccccactccccctcagcccctcctatcttgccaggcccagcccccgggggtcctcaggccctgcccctcccccactgattcccccttgctcatcaggacccttgggcacctccccttgccaataactccccctcccccaatgactcctcttcccctaccagggcccttgggggcctggccctcccccacagactcccgcacacccaccagggccctcgggggcccacccctcccccacagatgcccccactgactccccttccccaaccagggccttcggggtctgcccctcccctactgagtccccttccccaccagggccctcggggcccaccactcccccatggactccccatcccccactagggtccttgggccccatgtctccccgactgacttgccctcccccatggactccccctcccctgccagggccctcgggggtccaccactcccccaatgattccccttcccccacatgggccctagggggcatgcccctcccccatggaatctcccccaccacgaggggcctcaggggcccacacccccccaaagatgcccccaaccccgccagagtccttggggcacacccctcccccagttactcctcctcctccaccagggtcctcagagcccgcccctcccccactgattcaccctcccccatcaggaccatcagggtccgcccctcccccagtgactccccctcccctatccaggccctcgggggtctgccccaccccacggacttcccctccaccaccagggccctctggtcctgcccgtcccttacagacatccctcccccaccagggccctgcccctcccccactgactcccccaaccagggccctagggggcccaccccttcccccaccgactcccctcccccaccagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcggtgcggggaccggggaccggggccgcggggtcggggcaggggtccggggccgcggggtcgggggcaccgcaaggctcacgcgcggcttcctcctgggtgcgcagcggtggaggagacggacgcggggctgtacacctgcaacctgcaccatcactactgccacctctacgagagcctggccgtccgcctggaggtcaccgacggccgtgagtgcttcccccccgccccccagctcccgcccctcgaccctcgaccgccgccccggcccgcgcgccgctgaccgcgccccctccgcagccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccaggtgaaggaggcctccctgggacccgggaaggcgggagcccaccccaccgggggttgctctgcgcccgctgtcccttgcccgaggcccgcggatcccagcgggggccgtggcccgggtcggggcgcaggtcttgctggtacctgacgccgccccgaccccgcgttccccgcagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggtgagtgcccccctcccggccctcctggggaccagggcccccttcaccccacccagctgtaacctcctcccaccctcgccatccaggaaggatgttaacttggcggagttcgctgtggctgcaggggaccagatgctttacaggagtgaggacatccagctaggtgaggcagtgctgggacacgagggcacaggcgcggctcccagtcccgggctgggaagtgcatcctgggagcggggacctcagcctcctctcctcccacagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 37897 - DNA, 224264 bp, Homo sapiens; identical to SEQ ID NO: 37179

SEQ ID NO: 37898 - DNA, 23295 bp, Homo sapiens; identical to SEQ ID NO: 37617

SEQ ID NO: 37899 - DNA, 49663 bp, Homo sapiens
gcagagcgcgcggggcgcggttgccgtggcagcgccggctccagggagggctgctggcgccgggccgggaccgcggggcctgaggcggagaccggagagcccgaggcccggccggaggcagctcgggacaggcttgagcggcggggcgcgctgcccggccggcggggatgcgggaccggctgccagacctgacggcggtgagcggcagccgcgggtagcggttcaggcccggccggggcggcgtctggagggcgggcgggggctcggggcgtcttgggcggggctccgggagggtccccagggcggggatctccggcgttctggggcgggggctgcgggcagggtctcagggagtcctgagcggggactgctggtggggtccccagggcgggggtcccgggagtcctagggtgggggctccgggcggggtccccagggcttcctgggcggagtcctcagggcgggttggggcaggaggagggagcggggaaggtcccggcctcgaccccctcttcgagcgtggctccctgtccgtcactccgcttggcggattgtatctggcgcttacccagccggagcccactggcctaactgtggtccgccccacggggtccccgcagctggcgtcagccccggggagcaggccgggtcctcttggtcgctgctttatccctggggcttcacaaaggactgtgcaccaagcgggaggcaacagatgggtgtgaaatgtgggcaccttagagtgctgggtgcttggggtggggcgagcgcgaacagcagcttgtgtctgatctcccagtagtttgctttggaaactgggaccgtgtgttgactctgaacgcaccttacgcgcccagcagccgggcacacagcaagttactgtttactttagcaagggaaaagcaggtcactaaaaattttggaaggatttcgatgcattctacacgtgtaaaggtgacaggactgtgcatggtgcagtgacagcggaatgatagtgatggtcgtgcactttccaagcttgtctaacccaggacggcttaggccagcagaagtagttatgactttttccctttacaatacaggtactaattcatgctacgtgtgtgcacagatagagcctctggtctctaaattgttggcagcctcagaacaggggtgctaaggcccacagccctacgacacccactgcatgtaatgaattattctctctcctctgctgctagaatggagctgttatgtacccccgagtgggagaatagagaaaagagccacttaaatcattatctgtgttctgtggttcagatgaggagctctggttgagaaaggcaatgatttcatccttaggatcatggaaattatgctttatattcattccaaggaagtttcttcacggtgatttttccttttttattaatggacaaatattccctgtgttccgcagatcaatatcatcttaaacacagcaaattatagttgtgttgtcttgcccgatggattatctttcagtgccgtgtagtaggagctcaggtatttatttaatgaagaaaagctgtggctcactcctgtaatcccagcagtctgggagatcagggtgggggcatcacttgagcccaggtattggagaccagcttgggcaacacagggagacactgtttctcgaaaaaaattaaaaaattagcaggaggccagtcgcagtggctcatgcctgtaatcccagcactttgggaggccgagttgggtggaccacttgaggtcaggagttggagactagcctggccaacatggcaaaaccccgtttctactaaaatagccggatgtcatggcgcacacctgtagtcccagctactctggaggctgcggcaggagcatcgcttgaatccaggaggcggaggttgcagaaagccgagattgtgccactgtactccagtctgggcaacagaaagagactctgtttcagaaaaaccaacaaaacaaagcacgcacaaaaaaactatccaggtgtgactcgcacctgtagtccttggtactcaggaggctaagctaggaggattccttgagcccaggagatagaggctgcagtgagccatgattgtgccatgccactgcactcccgcctgggtgacagagtgagacattgtctcataaaaaaaaaaaaaaaaagctcaatgtcattgaacgtgagagctgtgactattttggcaaaatacagccaaatttatatgttggggaatcgtgagaaagtacgttttcttggcttgaatagcaaaaagcaaataaggcaattatttgtcactcagtttctatatatccaaacccttcctgaaacagtagaacatgtcaatcagttttgttctagaacggcagagctagaagtcagctcatctacttcaataccatcctgctttagacacagcagctgagcagtcagagagtatatccgtggaagtttccactcatggagtttctcatcttgggcaaataatttttaaatctctcaaaactttttcttgtacgtgaaatggggacagtggtatctctcttgtccacctcatagagggagttatgaagcataaaattatctaatgtgtgaagctctgggagaaggtgggagggagcaagtgctatgtaattataagtgtgattaatgtttaccagattttttgtttttagggagttataaaaagcagccttctggctgggcacagtggctttcacttgtagtcccagcactttgggaggctgaggtgggcagatcatttgagctcaggagttcaagaccagcctgggcaacatggcaaaaccctgtctttacaaaaaacatacaaaaactcagccaggtgtagtggtgcatgcctgtggttccagctactcaggaggctgaggtgggaagattgcttgagtccaggaggcggaggttgcagtgagccaagattttgccactgccctccagcctgggcaacagacagattgagaccctgtctcaaaaaaagagaaaagaacaaccttctccctagtataaaatagtaagttaaaactgaatttgaagtttaataacttttaatatttaaaaacccatcttaaagttaccagatacaagtttaattcccctcccccgccccgccccaggaaatgtgtcctttcccagtagttcttagagtagttgaatgtgtactcacaaccgtgcttgtaaatggctggtgtttttttctaggtaaagttgaatattttgttggttaaaatgcctcatcaacaatgtctgattaacaaagtatttgtgatgcttccatgaagtttcttttcttagctgctgatgcttgttcctgtgaagaacgtgcctctgacagttacgtggacagggcttaaagagtaatctgctcaatacaatctgtactgacagatgtagtttctaaccagtgatgctgtttttgagcaaccagtcatttgggcatagaaagtttgcgtgacttggtccagatctctgacactctaaatccagaaagatatttctgatttacagaaagtaaaagactcgcccatccagcaggtacttgaatgtcaggcctctagcagatcatgtgctgggtgcagagagacacagcagtgaactgagcgtgggtggggatgcatgcagcctgggaaggaagagtgaccgaggtgtaatgaaattcactgtaggacgtaagcaaaatggaatagctattctataagataaccaccccaaacgtattttgattactttttaaaaaaagtttatgaacattgatgtatttatatttgatacatatatatgatatatctatttattatagtgaagaatagagaaaccacacatttcatctgtgggaattgtttgcatgataataaacaataaatacacagtagctgtgtggtgttcttagtagacctaaaagaaatgagaacgttatttttcatcctggtttcaaggtgatgaattgcaaatctcttttttttttctttgagacaggatctcactgtgtcgcccaggctggagtgcaggggcacgatcattactcattgcacccttgacctcccaggcgcaagccatcctcccgcctcagcttcctgagtagctaggaccacaggcgcgtgccgctgcacccagcaaacttctgtattttttatagagatggggttgcgctgtgttgcccaggctggtcttcaactcttgagctcaagcaatctgcccaccttaggctcccaaagtgctgggatttcaggcgtgagccaccgtgcctggcctgcaaatataatttcttaaagggcggaaaacactgctcagatatttttaaaagttattttttgacagctcatgtttgtccacgtagtgcagaatgttgtatagtgaagatgcaggttccaattcataaaataagaagattaaaaaacttcactggaacttaaaatactaagagtttaatatatgaacataattttatatatgcatatatttatagtttagaatgtcataacttatgcaatcctgccaaatttttatattttgtgtgttctcatacaaacagttcctacagttggagtctatagtttctctattcttaattataataggtttactcatttgtatatctaaacatgtcctttagtttgaagagcaaaatctatatgtttttacagattaatcacttcttgtttttaacttgaggtctattctgaatttaaggagtagcaactgtaagaaataactgatccatagaagagctccctaggagcccagatctatcgccttgtggtggcaggatttgctcctgcctccggactgatacgcccctcctccctgcccttgcaggtgctgctccctttgtctgaaccactggacttctccctctgcgccttctctcttgccttgtacctttttttttttttttttttttgagacagagtgtcgctttcttgcccagggtggagtgcaatggtgcaatctcagttcactgcatcctccgcctctagggttcaaggaattctcccgcctcagcctcccatgacacccagctgatttttgtatttttagtagaagtggagtttcaccacattggccaggctggtctcgaactcccgacctcaggtgatccacccgcctcggcctcccaaagtgctgggattacaggcgtgagccaccacatgtagccttgcaccttttttagtctcaggttaggcatcactgggaagccttcctgcctccctttcctcgcatgttcccacagatggcccatcttgtcttggggcattctggacacagatgcagtcctgttttttcctgcacccttcccccagtgcttcagccttttcaggacagatgcatactgtcatttgtgctctgaagcctcagtattctgcatggtgcctgatccagagcacctgccaggtatttattgaatcagtctgtttccatttgaaaatgcccatggtaagaaaaatgtagatgccactggaatctgttgtcttcaaggccttttggttaaaagggacagaaacccatcagctaaagcagaaaagggagatttattaaaaggcagaatgggctgggtggggtggctcacgcctgtaatcccactactttgggagtccaaggtggaaggatcacttgaggtcaggagttctagatcagcctggccaacagggggaaacctcgtctctactaaagatgcaaaaattaattgggggtggtggtaggtgcctgtaatctctgctatttgggaagctgaggtgagagaatagctggaacctgggaagtggaggttgcagtaagccaagatcctgccactgcactctagcctggctaacagagtgggaatccatctcaaaaaaaaaaaaaaaaaaggtagagtgatttctcccaggctttgagggcacgtagtaccatcagccctcatgagggatggagttaggacggagcgagccactgaggtccttcctgtccttgtgtcgtggccgttttgtgcttgcggggtcttagtctgtgtgtgtgtctctgtttccgtttgttgacgtttgtcatttgtgtgtactttcccactctcctcccccttgtctgtgtctgcccttctcttgctcttcattcattcattcactcgtttgttgacctggtcatcactgactggcggctgggtgccaggcactgctgtgggcagaatgcctgggttgtgaaaagacagaagtccttgctcttgtggaacctgcagctgggagatagacagcagctgagcagatgaatcaagtgtctttcgcaatccttgctgtgaaggaataagcagggcgagggtgtgggtgtggctgccttggccgggtgggtcagggggccaccccgtgagctgagctgtggataagaaagcggctgtggacagggctgggggagggtgccctgggtagaaggcacagcaagtccagaggcccagagttgggaacgaagtcatgcaagggacagaaagatgctgtcggtagtgagtggatggtcagcagtgggcggaggtgagacgtgagtgagctgaggaggttggctggagcgagatcctgagggtttctcttcgtctccacggcctggtgtaaggggctgcccccgcccccaagtttaaatgctctctagttcacgctctctaggcttcatcatgtcagttctgatcctcattcctggggcgagatcatgtggtgggcccttggtagctcaagattagcctggcagtgtctcatgtccatgtgccatgctgggggcatccaatttattgcaagtgctttggagagcaatttggcattgtttagtgaagctgaagacgcttaaaccccatggctcggtggtcctctctctgcatgtgtgtgtatgttccagaaaaccatcctgacatgcatgtgcagccttgtaactgtggttcgttatattgttggtaatggaaaaatattaggcacaataggagcctggatggctacctcatggctgtttatataatggagtgtatgcagcagtaagatgaatgtatgaggttgaaccatatggtgtggtttcacctaacactagagcaatatatgctgagtggagaaatatgaatgtatagctgagaggaaaaaaaaaaatgattaaattgcagaggcaggccgggtgtagtcgctcatgcctgtaataccagcacgtggggagaccaaggtgggaggattggttgggccaagaagttcaaggccagcctgggccacatggccagacctcatctctaaaaaaatatgtgtgcctgtagtcccagttactcaggaggctgaggcaaagggatcacctgagcccaggaggttgaagctgttgtgaactgtgatcacgctactgcactccagcctgggtgacagagcaagaccctgattccaaaaaaaaaaaaaaaaaaaaattgcagaagtgtaatactatttacataaagtctaaatgcctgttaaaaagtatttatataataataatggaaacaagtgttagtaaaaatacaaaaaaataaaaaagtataacattttattataggtataaaagtgtaattcaccatacaaaatatgagaaagtaggttacgtttagcaccatatttacaaactggcccagagtcagcatttacatatttatttatttgttttttgagacaaagtccctctctatcgccaggctggagtggcaccatcactgctcactacagcctcagtctcctggctcaagggatcctcacaagtgtgagccaccacgcctggctaatttttgtattttttgtaccaaaaatggggtatcaccatgttgcccaggctggtctcaaactctggagcttaagtgatcctcccagttaagcctcccaaagtgctgggattacaggcatgagctgccgcacccggccagcttttacctatgtttaattacaagtattcttttctttttttacccaagtgatttaattgtgaaaagtaagtcaaagtattctagcaacaaagtactaaaaccactgtgtatatgtcaaggtttataatttatttgcccacaattattatttgtatggaaggtccttagcatgtgtgtgtgaacaacaggcagaagaaagccaggattctgtccagctttggattctgccatttgtggtagttcagcttctattgaattataaatgatgatcgttccaatggcaaattactcttctctgttaaatagtctctaaaccaggaagctacctgctacctgtttctgacaatagtattcacacagggagagttgtgattttactataatgctacttttaaggagacttctgttaacatttaaccgaaatggaatgttgatatttaaatgtttatcctgtacttcgacacttgggaaatcaagtatgtcatatagagagtattccctggcttttagtaaatgtttgccactagcagtttggttatttacaataaataccctctcataatcatggctgttgtacagctgttgcactatctcagcctgaaagactgaacatggacattcattgaagacaagaataatgtagcttagggataaagccaaaaagattgctttggtcattttgttttgttttgtttttttgaatggaaaagcaaagacagtattattgggtctgtttcctgttatctaatcagttttgagacttccaggtagaaataagacatataagtcaaggcttaagaataagaaataagacaatagaggaaacatattccagtcatgtggatctttcctggtctacagggagagaaacaaattgtttaccagcaagcgaatgacttggaacaaaaatccgcccgtgccgtgggttcagagtggaggaggattgacgccacgccactgtggggggtgcatcgcgcagcatgggacggtcaccatgggagaggagggttgagcctctggttgtttacgccacgccactgtggggggtgcatcacacagcatgggacggtcaccatgggaaagcagcttgctttcacagggaagcgtggcgctggggagcattgagatgggtgcagcctctttcctggagctgcaggtgcagcctccacagtagcatctgcctcatgggatttgcctcacgatggtcttgtggtgtggggggtaggaagtagtgggaagtggtgggtgtccacctgaaacaagacaggctgtggcttgaccattgttgagcctgggtgatggcgacactgagggctcaccatagtattccttctacttttgtatatgtttacagtttcccaaacaaacaaaaatgaggtgactttgaatctagaacctaaagttcctggcagagcagggaggtgtgagatgccctgagagccatgtggcacctccagggtggggtgaagcacttttatggcccggggctcagggccacaagggccgtctgcagctcactttcagctctccacccctcctccccaccccctccatgggtatttgggtgaatgcacagtcagtcaatgacttaaagcggtgatgcttcactccatcattcctggccctgcgcctctgagaccgcacagctgagaagacaaggcagatagccatagggaagcagtgagaccccgtgcccagctagtgggatttaatgcccaagtgagcacttggagacagggagggagcaggctgtgggcccgagaggcggggctggcacgcacaggggagtagatcctctttctaagagagggggtcccccgcaaggggagtctgtgggacctggccacctggcctgcatggctggtggggctccgcagcacagctcctccccgcatcccatcttcccccagggtagagtgtgcttgttagagcagggtgtgtggaatcacagtcacaggccgttttctgctctgccgtccctgcgagtgatccctgcactgtgtttcagcctcctcactggcaacatggggaccataaaattaatgagaacatgtgtgtagagtatttcaaattgccaactcttgtgagctggaagtaaaggacggctcttactctttttaagagggtcaacatggtaatagtacagttgttaagatgggaagttttgtaaagtcagacctggcgtcagctactggttcggcaccgcttagctctgagaccataaccattgagcatgtgttctactctgaaatagcgatgccagcacctgcctcatggtggggactagggggtgtggtaccaggaagattgacagataacgcacctggtctgactcctgcagaccctgggaaccgacactcaatatccttcagccattctgttttggtttttggagtggtgtgggatcctggagaagagtgttaaactatgtgggtctatcttaatgttagtttctgctgcttgtcggttgattgccattttgtcttttcttttcttttcttttttttttttttgagacagagtcttgctctgtcacccaggctggagtgcagtggcgcgatctcggctcactgcaagctccacctcccgggttcatgccattttcctgcctcagcctcccgagtagctgggactacaggtgcccactactgcgcccggctaattttttttgtatttttagtagagacagggtttcaccgtgttagccaggatggtctcaatctcctgatctcgtgatccacccgcctcggcctcccaaagttctgggattacaggtgtgagccaccgcgcccggcccattttgtcttgaagtgctgctttgcttagaattacgagtgtacaggctgggcgaagtggctcatgcctgtaatcccagcaatttgggagggtgaggcgggcggattgcatgagctcaggagttcgaaaccagcctggccaacatggtgaaatcctgtctctactaaaaatacaaaaaaaaaaaaaaaaaaaagccgggtgtggtggcaggtgcatgtaatcctagctattcaggaggttggggcataagcattacttgaacccagaaggcggaggttgcagtgagccgagatcctgccactgcacactccacactccagcctgggcgacagagtgagactttgtttccaaaaaaaaagagtagggactagaaataattttattaatagaagcctttattggtttatatattaatattacccatgaaagtagtgttaccttataaaacactgataaatatcttatccttagggtcttctgatggagatgggacaatactatctctatttcatggacaagaggcagagactgagacaagctaatgggctgctggggaggaggctggagcccaggtcttcagctcctgatcaatggtcgttcttctgggtggtgctggggtttgctttgttttgttttgtttttagagacagggtcactgcagccccaacctgccaggttcaggtagtcctcccacctcagcctcctaagtagctgggaccacaggcatgggccactaggcccagctaaacctgccaggttcaggtagtcctcccacctcagcctcctaagtagctgggaccacaggcatgggccactaggcccagctaattttttgtagagacaggttttcaccatgttgcccaggccggtcttgaattcctggacttaagcattctgcccccctcagcctcctaaagtgctgggattacaggcgtgagccactgcggctggccagtgtttttactgtttatggaaaatatgcaacaccagcagtttcacttcttgagggtaaaactggcctgtgttatattgacttacatagtgagaactaaatgattctaagcagcttagttctgagaaagccaccccttgtttctctccaggtcttccaccttctggctgcttcagccaggatctgttgtgttgaaaatgttgcggagttcagttggagtagatagtggtggctgctagtctgttacaatttggtgctgtagtgagttgagatcttgtgggtattgaactgtttttgtatttcagttcgctatttgtgcctacataaaaattttaaaaaactgaattttccatttttcattgtagtgtaggaagaatgatgatggagacacagttgttgtggttgagaaagatcatttcatggatgatttcttccatcaggtaagagcgtttaatgaaacccaatcatagcctgcctacctgtcctccctccctccccccacccctccctcctttcttccctccctctccctttcctcccctcccctccccacccctccctccctcccttcctttcttcctcccttctttctttttctttttccttttctttttcttgtttttggagacagagtcttgctctgttgcccaggctggagtgcagtggcacaatctcggctcactgcaacctctgcctcccaggttcaagtgattctcttgcgtcagcctcccaagtagctgggaccacaggtgtgtgccaccacacccagctaattcttttttttttgcacttttagtagagacggggtttcaccatgttgcctaggctggtttcaaactcctgagctcaggcaatccgcccgcctcagcttcccaaagtgctaggatgacaggtgtgagcccttgtgcctggtggctttcttctttaaagatttatatcaatatgattgtgcatttatcatatttgaaataatacttaagctaatatttttaaaagttgttgtttgaattacgtaagttctctggaatttttagtatgatcacaatgttaataatgagaaaaatgcaaatcatcgttctaatgcagtccgggagggaactgggtgtggatggtggagctgtgcacgtggcctccgcgtgggttggggccgggcctgcagcgccctctgctggtgggcggccacttctcccacccggtgctggctgctgcaggagcaccgcctccttgcaggctgccttttggaggtcctgcggcgccccttaagagagttttacaaaggccttcctgcaagactggcagtgtctcagaacgaggcctccttggttcttcaggaagtggtggttccggcagcagaggtggcgcctggctgtgggggcaggggtcaggtgtgcgtggctcccaccagcactgccatccgtccactggtgggtgtgagtcctgaggcaagtgcctagagcagagggctcagggtctgaaatcggtgacagatcagctgtatatgagctcaggtagaagactcagaggaaagtcacaggtgacccagtggctgatattttaaaatgtggcggcctggcggtgctgggatcctatctgaggtgtgaggcctccccctcctgcttatctccccagctcagctcttgggcttaggccctgctgaaattctcaaacctaagaattatctgatctaatgttgcttaatttcaaatttttgaaattgagtcacagaacaaatatattgaccttgtaaaacatgaagaaacgaaaacacacgtccagtgggttttttaatgacggaaccttcattgcaggactcgtcttgattatgctgagtctcatgggatagtttcactcagcagcctcatctggcctagcagtgcctggatttgaacattttaataggtttataaaagcatatggaaagttactagtttttcagattcagccagaatttcttgaatatctcacgtaagcctagtcactggttttctagtatttgttagttgctactgttatttaaaggaaaaaaccatgagattaaattgttagctacaaggaacttcctttaaggtatgaaggagttaagatgctgggatttcctgatttcacttcttggaaatgagactttttaaattgtctttagccttcctgccccctttgtcaaattactatttttctgattttattccttttacttggttgcttaactcttccatgtaagttctttgtaaaaatgtatttattttaaagaatctcctgccattaagtgttgcatttaatagaaaagtcacatagtgcaggccgggcccagtggctcatgcctgtgctcccagcactttgggagtccgaggtgggtggatcacctgaggtcaggagttccagaccagccaggccaatgtgccaaaaccctgtctctactaaaaatacaaaaattagccaggcatgatggcaagtgcctgtaatcccagctgcttgggaggctgtggtgggagaatcgctggaacctgggaggcggaggttgcagtgagctgagattgtgccactgcaccccggcttggggcaacagcttgggcgacaaaaaaaaaaaaaaaaaagaacagaaaagttacattgtgcaattcactgagtgccattaagctgtggtctttgtctatctggtgccagtctgtctttgctgctggcgtctcaggggcatgtgggaaacaggttactcgtactttaggaaggcttgcccggtgcttgcctcattgggttctaacttaagctcaagctttcatttgttaaatagtcaatttattttgcacttaatttctgtgaaatgacttcctagacaaatacagaagcaaataatgtttggtaatataaactcattctgatcttcaatatcacatagaagtttgcaagagaaatgaatttcacatggtgagtgtttggttaacactaaaacagtgctctgaagggtggccagggagtcttgtttctgtgaagatgatttataatggagccaaaggacccctgtgctatgttattcccggacataaaatggtagctggcaccattctctctcagtgcctgtctaggtacagggtgtatagccctgcggtctcctgttcctctggagccatacgggggcttggagttagcagcggtgtatattgcagaactctccaagagttaaaataatgtttttttcttttactttctaacatatgtgtattactttagaaatggtaatttttctttctttttttgagacggagcctcgctctgtcacccagggtagagtgcagtggtgtgatcttggctcactgcagcctcctccttctgggttcaagcaattctcttgtcagcctcctgagtagctggtgctacaggcacaccaccacgcccggctaattttgtatttttagtagagacggcattttgccacgctggccaggctggttttgaacttttgacctcaagtgatctgcccgccttggcctcccaaaatgctgggattacaggggtgagccactgctcctggcctgcatgattctttaatacttagacttttcaaatctggtccggggcttgggttaggagtccctggggtccctaagaccctttcaagaggattctgtggtcaaagctcttttcaaagtaatactaagatgatcattgccattttcattgtcttatgactgcacaatgatggagtttctcagagccaacacaccaaacccagaaatatctgtgatgatcagggtgctgtctattaagctggacattagatttacaaaaagtgcaaatcactgcctctgtttccaccgattttttggagatctatttttcacagaaatgtgttatttatgttgatccgtgtgtcagtttcctgctgctgctgtaacaaaatcaccgcaatcactgtgcttcaacaacacgtttatcacctcctcctagttccagggcctggagaagctcagatgctggcagggcagagccgcaagcctcctggagctgccttcctctccatcttccgcaggcggcctgtgttcttgggtttcctccctcttgaaagccatcactccagctgctgttttcacaatcaagtgtccttcttccaacgttggctcccttgcctcgtcttataaggaatcctgtggttacgttgggcccacccagataatccagggtagtctcccatctcaagactcaatttgatcacatctgcaaagttccctttgctatgcaaggtgacatattcacaggctctgggattagggtgtggattgtgccacaacatgtaatggttaataattacttcttcctttttttgtttttaagagcagggtcttgctctgttgcccaggctgtagtgtagtggtgcagtcacagctcactacagcctcaacttcctgggcccaagtgatcttcctgcctcagcctcctgagtggctgggactgcaggcatgcaccattgtgcccggctaattttctttttttttaaagtttttgtagagatgggggtctctctatgttgcccaggctagtcttgaactcttggccacaagtgatccttctgccttggctcccaaagtgctgggattacaggcatgagccactgtgcctggcctataattactattttaaaatgaggaaggaggtaggagctggcagcagagcatcttgctccagggctcaccttgctgcttctgtagctggatctccatctactgctgtcttctaagaacacttgcgactttaacccatttatgcgtagtgttccattattggaacgctaagcttttgcgagttatttatatcctactgctcagggtcatcaccaaggtctgatttttcacacacacacattgcagcctctggcataaatgggttaatgaggaccaaactggagaattcaggatcatttcccgtctccagatccttagtttcgtcacatctgcaaagtatcttttgccctataaggtaactcccaggcccagggatcaggacctgaacatctttggggtcattattcagcctgccgtagaggtttttgaagataatgttatgactccatctagataaatcttgctaatgatatgttacattttgaaacaaatattgaatttaaacatttagaggtcaaagataataattatgaagccttggctgtatgagctatagatacctcctcccataagagtattattattattattttcttcttttttttttgagacagagtcttgctctgttgcccacgctggagtgcagtggtgtgatcttggttcactgcaacctctgcctcccgattcaagcgattcttgagcctcagcttcctgagtagctgggatcacaggtgtgtgccacctcacttggctaatttttgtacgtttagtagagaagaggtttctctatgttggccaggctggtcctgaactcctggcctcaagtgatccgcctgccttggcctcccacagtgctgggattacaggtgtgagccactgtgcctgcatgttttatgggcttacttcctggttatactgagaatgggtattagtagtagtatgcttctaattggccccatctgtgtcatgcttgggacttgactagaaatttttacaacctgataggttttcccggtgaatgttgattggtactgctttaggtatgaaggtagaaatattcataggatatatctttattttttaaatttaacgataccagtgtgagaatgggagaggcttttatttcttatgtggtaattatttatttccctcctttattcttccccttttaggggatgaaaagtggtcacagatttgagtttgccatgctgtaatgactctctctctctcctaggtggaggagattagaaacagtattgataaaataactcaatatgttgaagaagtaaagaaaaaccacagcatcattctttctgcaccaaacccggaaggaagtaagttgttggttttcacaacaaaacgtttgtctgtctgtgtgtccctctggctgtctgcggcacaggcctcaactctggcctcacgggagattcaggggagtttgtatgaaatgctgacaccctagagagtctgaggcgtttggcctggggcgagccagggcatctgtatgttttttttttcttaaagctgcctgtatgattctagtggtcagccagggtgaggcccactgatggatcatgtcctaaagaatacacgaaagtggcttcacagaacttaggggccaagattagaccacagttcagcaagacagcattttctgttcagagggcagtgaatcagggattgatttggaaaacagtacttgtaagagcagagtgaaataggaagacgcactgaggcgactctgaaagtcttgaggagcttttgtatggactgtgctgcgctcagtggctgtgggggatggcacggaagaaacggttttctttctttacctgtttatccaaattctccctgcctcacatttgcttccttttgaatctgaggcacacaggagagtgaaaggagctcagtggaagcagctggagaacctggatttttgtctcaatttgcttccccgtggtatttgcatctcctcattgggagaaaagacatgattttaaattaactcagcgttaggggcgtgggagctatagagaagagagtttcattgctctggaatgataaatattgaaagctttacaggggacatggatctgagcaagccagagattacaaataggagtccacacatcatggtggggggagttactatgttaacaacgttgagtctttgaatccatgaaaatggcccctacctccacgacacaggccgcctttaatgccggtctgtgcggtgctgtgggttccgaggagggtcgcgcacatctttcgttgtatttattcctaggtagtcaatgttttgatgttaatgcaagtcgtatgtactttattttttatttatctatttttttttttattttgagacggagtctcactctgtcacacaggctggagtgcagtggcacagtctcggctcactgcaacttccgcctcccgggttcaagcgattcttctgccttggcctcctgagtagctgagactacaggtgcccaccaccacgcccagctaatttttgtatttttagtagacatgggatttcaccatattggccaggctggtcttgaactcttgacttttgtgatccacctgcctcggcctcccaaagtgctgggatttcaggcatgagccaccgtgcccagccgtatctactttaaatgtcattttctctgtttgttgttggtatatagaaatacaatgatttttgcatattggccttgtaccccttgcctaatcagttattaattctgatattctctgtagcttatgttggattgtctctgtacccagtcatgtaattgtgaataaatagtgaccgttttttccttgcagctcttatgcttgttagttttaactgatttatttagctgacctccagtacagtattgaatagaagtggtgatgggggcacatgtattcttggtcttggaggaaagttgccagcaaatacattttttgttggaatattacttagtgtagccgtacgttgaaaaaataagaaagtagtattaaattgaaaaagtgcattttaaaattttatgtatcttgtaaaataatattctgagcctctgtttatgccctctcagtgactcagaagtgtgtttcccaaaatgtttctggagccgccgtctcatgagctagtccgtgcagccagggtgctgcctgcggccagatctttccggggacctcttcgtgccgtcgcccagcccctcttgggaagttgcagtacccgtagaataatcaaggctctgagaaggcttcctagaaggaagcctgtttagctttgtttagtgtttcacacatttatttgcccgtaggaccttttatgtaacatctgttaacatcatgcttaatgcttagggaaattatatttgaataagtatccgcatttttttttgaataatttacctccaaaacatttttgctgccaagtcatagcagagagaactattttttgagtaaatttagaactgttactgtttcatgatagtcccttttgggctctaaagaaaaccattgcttttttgtgttttgttttgtgacagagtgtgaaccaaaatgtaggcagcagcctccagccgcttccttggtcagtctttaaaaagcaaaatgcagtgattcctctctcccagtgatgggcccggggtaacgcagagagggacaggctcttggccttcccgccttgttcctaaaggaagaggggagggtgggagggaggaagggggactactgtgctccgcctcccgcgtgtctccctattctcgggcaggcgctctgcttaggtcccggtgagcagggcgatccccgggctgctgccctcccggaggtcccccgtcaacctcaggacccggggcagggctgggcacggcggccgccaggtggcgccagaggcagccggtcctgggcgggtccccggtcccagcaccgcccgcgccgcgccacctgcagccgcggatcccagggcagagaggtggacgaaggaccttttacctgcatttttcttttttcactttctacttttgtattatttcttttttcttttgtattaaaagagcgtctttgcaaaacgtagaaatttcaggccctccaagacgcggatccagccctgcaggagcatgaagtgtgtgtgattctggtttgggttttagtgacgacgaggctgggattccccctgcaggacggcggggatttgattcgctcctgcagtcagccgtcagcctggcttgcaccctgtgttcgggtgcggtcgtccttgcggctgcgcacgctcccgttttctctgcttcctgttccctcagccgttccctggggctccgctccgaatgcgctggggcagcgtctgcaccgtctgcaccgtctccatcgtctccatctccagcgccgcctgctcccgtgcattctgtgcttttccgcgggaaatcagactcatggagacccggctccttgtgcggaggcccctgaggccctggaggaagccgcgcctctgtggctctggattcagatcctgtcccaccggttatccctgtgtggccttggacgcatcacttaacctctcccggggcagttcccacacgtgtgaaatgagctagtggtggcatctgccttccagtgctgttgtgattcttcctcccccgccctctcccccccaccctccagaggagtctccctgtgtcgaccaggcgagagtgcagctgcgtgatctcagcccactgccactgcaggctcagcctcctgggctcagacagtcctcccactgcagcctcccgagtagctgggattacaggtttatgccaccacgcccagataattttatatatatatatatatatatatatatatatattttttttttttttttgtagaaacagcgtttctcactgtgttacccctctcctgtcccctcccctgcagggcatggggacagctcacggggccttctcccttcagaaacgaagccgcgcgtactccccgtaaggagctgcgtggccaggctccggcatcccctcccactgcagggccttcctggggagtcttggctccgggacccctgccctgcttcagcccagctgcccccaccacaggctgggaccaccccacccgaggccttcctgcccttgcggttcctctccccttccttcttacctccttcagtgaagattcgctattatctgaaattatcctcagtttagtattattctcgaaggatattttcactgagtagaagattctagtttagaagttgttttctttcaccactctgaagatttaaaacatatttttccagtgtcttttggctttactttttttttttgtcagctaattagagcttttaagatatttggtttttggtctttggttttagcagttttactgtgaagttttgagatgtggttttcgttttctttttccctcttcttataaggcttcttgagtctttggactgacgttttctggctgtgtttttgaaaaactttggccattacttcttcaagtagcatccttgctccgttttctgtcatctctctttgcggctggaattgtatgtctttagagcgtttcagtgtatcctttctgtctctcctcttttgttctctatttttcatcattttttctctatatattttattttgaaaatgttttccctgacttatcgtttgatttctcttcagcgattgtctttcaggtcagggaatctttcttcatctatggaattatttttggattggttttaactcctagaattccacttggttccttttaatactgtcctattctctgacaaaatttatgatcttacattttatctctttgaatgtaattgttttaacgtctgtgtcttgtaactttattagctggtgcctctgtggatgggttagtgttgtctctttttgttgggttttcattcatgtgtttttttttttctttgtttgcctggttatttttgattgagttttgagctttgtattggaattatttgcagtaataatttgagtcctgaatggtattttctttttaaagagatgatttatttttatttctggcagatggctagaagcaccagcaattctggatctaattttagggattgagatgatttagactgaggcttcagcccctgcgagggccagcttcccacctgactgttcctcctagggcattgtctctccaagtcagcacagttttctcagcttctctgcagctcagctgccttttatggagttggcacatgcccccaggtaaaagtggctgcaaaagtggggcccatgtctttgggttttcttcttctgagtcttctttcctgccttgttaggtttcttttgtttttatttctttttttaattattttattttatttattttcgcaccttgttaggtttctaatggctttacacagatttagaaagagtattgtgtctaccctttctaattgttctcagcagcaggattgagctgaatcacctaggccgctggaagaggaggttcctgatccccgtctggtctctgatttgaaataccacctttatcaaatgtgaccttatggcctgcgtctgcagcttgcaggatcagacaggcagtgcctcttttgttttgctgatgagttgctcaagccccgtgggcctgtagtggcagcaagttcactccgtcatgagtgccccccacccctgctgtgtaacggccaagggctttctttccccaggggagtgagtcctgctgtggcccgccagctcaagagggagactctcatccactggcaggcccagctctcagatcttgtggtttctgtggctgcgcggtggctcaagaccgtctcccgagtctagtcgtcctcagctgtgctcaggcgctggctgggccggacccctgcacaaatgcccttgctgtgtgtacgttttagcttcgactcctacactcagccctcattccccaggcacagtggccaggccttgggggtgtttgcatcagcctcacgcaccacaggagccagcacccctgccacaaactatggacctgccaccctctttattcatagcaagtctctctaattcctgtcaaatgccccattttataaggcattttgtgttccctttactattctaaaatgaagttcatagatgatatagcctacctacctccatgattttaaaaaaacatataatatccaaactaatatgaaggagacataaaatggaagtaacttacatattgaagtacaaattgtattgtgcaggctcaggcacaacaccagaaaacaaaattcaggcgcttgcccccctacaaacaagtgctgtgactgtcacagccaaggctgcaagctgatgaggtgctgtgattcagctgccgttagcaggcttccctgtgcttttcctgaggcagtaggtgtcactgaaatagactgaagtacagctttctcgccatgcagagcggtgacacggcagttgcattcctgaaaatccactggatattgaaacgatgcagatgaaaacagggcttatttgtaagctggagtcaggttctgggctcaggaaaacaggtcttttctcctgcctgagtgagcagcgtgcatctggcagttatgcaggccagtgggtgatgtgctgatgtaatgaggttcgagggtggcacatctcacacgcgcacgaacaccccgtcgtcacgctcaggaactacaggaggatggaggccagttctttgttgtgtggtgctggctggtgccattcctggcttatgtcttctggatgccagtggctctcccttttttatgatgactggaaataccccacaaatttcagaataccccttggggtggtagaaagattcccctgagaatctccctttagaaacatgttcacagaggagaatcacgaaatgacccctttgtgtctagtttctctttttttctagtttcatccattatcagaataatttttctttgttttttctttttctttccttttttaaatagagatggcatgttgctagttgcccaggttggccttaaagtcctaggcttaagtgatcctcctgcctcagcctctgaagtagctgggactacaggtgcacgccactgtgccttgcttaaaaataatctttttaggctggatgcagtggctcacgcctgtaatcccagcactttgggaggctgaggtgggcggatctcgaggtcaggagctcaagaccagcctggccaatatggcgaaaccccatctctactaaaaatacaaaaattagctgggtgtggtggcggaggcctgtaatcccagctacttgggaggctgaggcaggagaatcgcttgaacccaggaggcggaagttgcaacgagtcgagattgtgccactgcactccagcctgggtgacaagagcaagactctgtctcaaaaaaaaaaaaaaaaaaaaaaaaaagtctttctaatgcatctttgctgatgcctttctttgctgagaaaccttcagtgctgactggtgccctcagtaaaagccccaaactcagctgggcctgcacactcctgcccaggcagcctgtagttggcctcctcccacgccagtcactacagcccaccgtcccgctgctctgtgccatagacccttcttctgcctggaatggaagccaccagtctctccactcccaggtcagatgtcccctcctgtgggacagctgcagcagacgcttctcctcctcgctgcccatggcattttgtgaaccctgtctcgtccgttgttagtctctgcgtggcattggcgcttcctgggtttgtcttgtctgtttttaccgagttgttaggtccctggcggtcttgttagcctccttagatgacacgggcctgcacacagaaagtactcagtaggtgtcactggtgcgtgacctgtcacctctggagatcactcagtctctgatctggctctgaaaccctggacgagccaggctgcgtctgatgactgtagctgagcatggaaagaagacttagcacacgcttgtgtgcagtgggtactcggggcaccctgcgtatgctcagctgagggggtgtcaggaagagagtgggcatctctgaaagctttcattcttggccaagttgtctacggcagaaacgtttgccttttccccggctgatgcgtgtgagattgagtgagagaggcaagtgcaggactctctaaaacgacaacaggactccagagacggggcgggggccttcctgtttcagcaacttctgcccaaaggagagagaaacccccttcccttctggtcacttcagccactggactggcaaatgtgagtgtgcggcatggagcagacatcctgccaccctccctgggctctggggcagctaggcatgaaagcagaggctgctatgacgccctgggtggccttaggtctcagcactgccctggagtgtcagctcctgctctgctggcctccctccgtgttaggaggccggcccctgcctccatcgccccctgcttgcagccctgagtgtctgagaagccaggccagggcgaccggcccagcagccctgaagtggtggctgtgattattcgggcgttttggggagacagctgacagcacaagagaaaagcacacacacgggagactttgttgagatcatcgttacgtctccgttttcctttcccaggtctaggtgttagcagtggatttaggcagcagtttcattcatgggtatagagcagcaagtctcaaacttgtgtcacctggagggtttgctaactcagattgctgggccactgtccccacctcagtttctgagtaggtccagggtgggccccagggatttgtgtttctactaagctgccacctgatatttatgaaagctgctgtctagggacccaccttgagaaccactggtataagcggtagtttttcttacagaaaaaaagtgaatatttactaaggatactgtttcacttaaatttattggatatcatttatgttggatattatagctcagatgctgtattttattttttaattttaaatttttatagaaataaaagaagagcttgaagatctgaacaaagaaatcaagaaaactgcgaataaaattcgagccaagttaaagggtaagtttgaagttttatgtttaattattgatgttgggagtatgggtatttgttatttttttctttattggtttttgttcttttacatttttaaaaattaaaatagtgactgctttaaaataaattatttgtatgtaattcagagtactaattaatattcaaaaaggttatgtgtttgcttataaactgttatactgttacatttttgatgacatttcaggctaagttgcagatgtttgggaaggtgagttgccaggctcttcttgaatggaccctttaattgctcatttctttcaaactttctgtagaatttattcgatgatgtttggcattccactttagcagcagtagttttttgggaggcttatagctttgtcatgtaaaacaggggacttaaacagaggttgctttttctcgatttggtagaaaacatgttgtatttgatttttgcagaatggcatcaagatcaaaaacaatctctgtgcagatgataaaatacttttattacggcaggtttcagatgtgtgcagaagcagagagaggcgaccacaagccgaccccccagctccacagttctccatgagctcccacccgcacccgctcccagactattctgaagcccatcccaggcatctgagatttcatcagtgtgtatttcaaaaacagaagcttccccaaaagcacaaccacaattatatctaaacccaaattcattataattacttaatagtacagaatatccaggcagaatttccccagtggtcttacgattttttttttttaaacagtttgcttgaattgagtcccaaataaggaccaaaccctggcttttaaaaatgagattctcccttcatgatttttctctctgcactttttcctttggttggtgaaaccaggtcatttgtcctacagaatctgccatgctgcagattttgctgattttacctctgcagcacatttaataggctctgccgtcctctgaatttgctgtaggttggtagttaaattctccaagctttatctgattcaggtgttttttgtgggtttttaaaatgtaaagatgcagcatctgattacagattttatgtcctcatggttacgttaagatgttaatggtggcctggcacggtggctcacgcctataatcccagcactttgggaggccgaggcgggtggatcacaaggtcaggagatcgagacttatcctggctaacacggtgaaaccccgtctctactaaaaatacaaaaaattagctgggcgcagtggcgggtgcctgtagtcccagctactcaggaggctgaggcaggagaatggcgtgaacccaggaggcagagcttgcagtgagccgagatcacgccactgcactccagcctgggcgacagagcaagattccatctcaaaaaaaaaaaaaaaaaaaaagatgttaatggtgacattaacattttttcttggctctaagtaagttcagtaaaattttaaataagatataacattcttttctattctgtgatattgtcaaaaatggatgattatttccaagatccataattcattagaagttgcaagcagtaatatcctgattttttttttttttttttgagacagagtctcactctgtcacccaggttgaagtgcagtggcacaatctcggctcactgcaacctccacctcctggactcaagcgactctcctgcctcagcctcctgagtagctgggactacaggcgcccgccaccacgcctggctaatttttgtatttttagtagagatggggtttcgccatgttggccaggctggtctcaaactcctgacctcaaatgatccgccagtctcagcctcccaaagtgctgggattacaagcatgaatatcctgattttattcttccttctttgtttagttgctggaatagttaaaaagaaacctttccccttcaactcttgaattgggtagtttggagaatttaactatgagcccacagtaaatacagaggacagcagagcttactgaatgtgttgcagggtgaaatcagcaaaatgtgcagtgtggcaggttctgtaggacgaatgacctggcttctccaaccaagggagccaaagcacattctgggtcacagatcatggaggacagagaggatcagcgttggactctctctctctctggtataattttcataggtcagttccctggggtcctccagagatgaccagggagagtctctgttgctgcttgtcgtccatcatcgtgaacacatggatttaaacacatctgatgttttcattgctgcattatccttaatgctcagatggtctctttggctagtagggtggactcttgagtccttttggtaggcccctcattgtctgtgacagcctttccactttttgctgtgacaaaagtccccatgctcatttcacccctttcctccctgggcctggcatcagccatttccccaggaagccctgctcctgtgtctgaagaatgtgatctagacaccgaggtcagcatgctggggaatgtattgctatacatgacgatgacctgaccattctttcctaggctttttcagtggactgggctaagatttttttaaaagataaaatgaatcatgatttgttactgagaatccaaattaaattaagaataaaggaaggactaaaaatttttttgaaaggatttttacttaataagggcaatattacatctttatttcctttcaactatgccccaaattctggttctcactgacacataattattcacttgctattcatagtacacacacaacagactcaaaataattatgccagcatctactgtcaagagtatgattacttaaaggtttattttttattttttgtgtcattctttttgtctataggtatatcccactgggctagataatcaaattactttttgttgttgttgttgttgtttgacctggggtcttgctgtgctggccaggctggagtgcagtgactgttcaccagtgtgatcatagcgcactacagcctcgaactcctaggctgaagtgatcccccgagcacttgtgactacaggtacacgccactgtgtccagctacaaattactgggttttaaagttgctttgaatagtttttcctctgtgtgtttatttttttgagatggagtttcgctcttgtcgcctaggctggagtgcaatggcactatctcggctcactgcaacctccgcctcctgagttcaagcaattctcctgcctcagcctcccgagtagctgggattacaggcacccgccaccacacccagctaatttttgtatttgtagtagagacagggtttcaccatgttggccacgctggtctcgaacccctggcctcaagtgatccgcctgccttagcctcccaaagtgctaggattacaggcgtgagccactgcacccggctcctctgtatgtttatatcattaacttgacttactgttaggtttgctttattttttctttgaagtttagggattaatttttttaaatttaattttgcattaagttttgtgaagtatttatgtcattctgacgtcaaatatataaaacatattcggagtctagcttctttcttcatcgtccccttgtttctcctttccctttagtggtacccagttttaaagtttgttggttatgtttccatttttttgtatgtgtgttttccatgtatttgtatatatgtgtgtatatatatctgtgtgtatctgtgtatatatgtgtgtatgtatatatatctgtgtgtatctacatatacatgtttcctcttgatggggttgggcgcagtggctcgcacctgtaatgccagcactttgggatgccaaggcaggcggatcagttgagctcatgagttcgagaccagcctgggcaacatggcaaaatcccgtctgtacaaaacatacaaaaattagctggatgtggtggcacacgcctgtaattccagctactcgggaggctgcggtgggaggactgcttgagcctgggaggcagaggttgcagtgagacgagattgtgcccctgcactgcagcccgggtgatagagccagaccttgtctcagaaaataatttcctattgagggattgtctttttagtagattgttttagaaggtcacttgttcattagctttagttttataaagatacttcaaagataagaaataaaaggaatttgaagtcaggcttggaacattttcatttttaaatttggaaggtaattatttcctatttgttcctagctattgaacaaagttttgatcaggatgagagtgggaaccggacttcagtggatcttcggatacgaagaacccaggtttgctatcagcctcgtttagattaaagtaatgtcgcagaataagtgtttttactttcttcttgcagactctgaataatttcatctttactgtcatgcttatcctcatagtatttctgcacaaaaataatatagtattgtaaaacaaaagtatctgagacagaggtttattttgccaaagttgaggacacacttggagaaaagaaatacaaattagagtaggatctgtggtttgtgcctttcctgaagagggttttgaggacttcagtatttaaaggggaaagagcgggcaggagaggaaggaggaaaggggaaaaaaaagagaaaaagtgggggtaggcagcggggtggccacactgctgtgaggctttgctcagggctcactgcgttcacatttcacatgtgggaagagaggagtgggggtcgattctgcactcctcccgtgcccagatccgcctcttacgtgggccagtgtgagcctgaggtgagggaggagctatacatgcatttctcagggtgggccgagggtgacttctagtcttgtctttgtcctgtacctgtgaaggtaagcggctaatgtacattgtcagggtgagattctgcagaactctgttttagagttagtttttggtgggggggatatggattctgaaagattctgggacctacgaggaatttccttgtgagcactttgtgcaggaggctgctggggcgatgtgcggccttctgtcactgcagccatctgtttgagaagaggagggagggcagtgttttgcatgactcagttcccaagcttaactgtccctttgggatagtgagtgtgaggtcctgcgattttattttcctttcacagtatttatagaaatctctttattgtgaagaaaaatctattcggtccatcaacagagttctattccaaagagtagggaattatccaaatgattttagtgtttgtggtaaggccgccacgttttagtggtttgtggtactgcccagaggaagacagagccctgaggcctcgagggcacgaggcgatgaagcacgcgggctctggggtccgcctgcctgggtcccctcatgggcacaaggcgatgaagcacgcaggctctggggtccgcctgcctgggtcccctcatgggcacaaggcgatgaagcacgcgggctctggggtccgcttgcctgggtcccctcatgggcacaaggcgatgaagcacgcgggctctggggtccacctgcctgggtcccagtgctgatctgtgtttatcagaaaagcctgtgaccttgggctaatgacctcaaagtcatggttttctttaagtagggttgtgaccggcatagtaggggtcttgtaaaaattaggtaagatcatgcatgcaaagttcttagcacagatgctgccatggggactttgccattgtcattttccatttgcaggagcagaataacatgtagtttgagtttccaaaatgcatgtcttgcatgtcactttcagtagaaggcatggccctcagatacgaatgtagttttcctgtgttgttagcattcggtgctgtctcggaagtttgtggaagccatggcggagtacaatgaggcacagactctgtttcgggagcggagcaaaggccgcatccagcgccagctggagataagtgagtaatggagactccgtctttgttaaaatcatgtttttctcccttaaggtctcacttcaaatgactttaacttcagaaaaggaaatccatgtctattttcaccaatagtgtaaaacccaaagaccactcgtagcttcctatgccgtgagtcaggcaaacctgttcttcctgtcttcaggaagtcctaagcggtggggtttaccttgctcattgctgttgcttttagagtttcagggagattgggagagtgctcagtcatttcctctttgagtgtttctgtgtcctcagtcccgccctgccctggttcgggggcatcttcatggctcctcacatctctccttgtctgtgagcagaggcagcggccctattgccccagactcttttcaggggtgtctatggggacagttggctgtggcagtggagatggcgccttcttcggggacagacgggtctgtttcagggataaaggttggtcaggtttgtagactccccattgtgaaagattggggttcccaagctcgggtccttcagctgtgacacaaacccactgtgaggacgtcccactgcagctgctctgcctctccccatgagactgggggccgtggacagctgctcatgagcctcaggttgcctgctgtgctgtgagtaggaaatccctttgtccctgacctggggccttggaccttctgccggcccccacggagccctggcaggccagcgtgtcagctcgcaggtcagatgaagcctcaggcccatcccggctcccaacgccgcacatccccctcagagaatgttgtcatatgcccgccaggccgcttgaccttgtcccacagctcagcgaggctcctcatgttttagatactcttttccagtgtgtttggttttggtcagtttctcttgcttgtctgatctgcctttaacctcctctggtgtatgtttcatcggagacactggtttctgttgctagttctgctgggtgttttacatgtctgctgtgttgctccccactgtacaactgggacgcacttgtagtaacttgaaccgtctttgtctgccaactccagtgtcctgtctgctctggttggttgatttccttcctttctgtggcttgtgttttcctgcttctttgcgagcctggtaagtttcgagtgtgtgccagacattgtgaacgttactttgttgggtgctgagtatttctgtattttgagtatttttgtaaatctccttgggctttgttttagaatgtagttaaatcacatgagcatggtttagcctttgggatcttgcatttagagggagcagagcagctttatttgagggcctgtcattcctcactcctgaggtaagacccttctgagcacctgctctgatggccgtgaacctcatggcaccctcgtctgcctggcagcgtgttccctctggcatgctggtcagcactccagtgagcatgcggggtctgtgcagctcgctctctgcatctctctcatctctcatactccatcttgcaaatccagttgccttggtctcccctgagctctgtgcctttgccttaggacttcccctgggctccacctgggccctttctgctctgtggctgacacgagagttccgtctgagggcagcagcaggctcacctggcttgtttccatctgttgggaatcagtgtgtggcctgatgctcagtgtcttggaaatcgttttgtagattttggtgggtttgtggttatttcaagtggcagggaaaatacggtccctgttgctccatcctggcagaaatgctcaatcatgatgtcgactagactgcttttctatgaaaaagtttttacaaaccactttgacttcagggatctgttagtactttttaaagtgaaagtcatcattacaggcagccggttgcactgtgaggatttatgctctgggactctgtggtgagcgcttttctagcacagagttccccagcctgggcttgaaggccccgcaccatctctcctgcaggtccatcctgtcttcactccccatgtgaatccggtggcgtgatcagatcgcctaagtctcttctctctttcccacattattctatctcagcccacagaattcatttccagtttcttctcttgcaatcatactctatcgaatgcagtactgtttgtgaaagtgtcttataagcaatgaagtatcatatacgtgttgggagttttttttagtaattcctttaagtctgttaaattctaaaccctccatgtggctattccgaagtgagcaggtctatgcaaactcacccccaaaggctgagcgagctgagacgccaaagaaagaggctaacaaatccagtttctcgaaggaaacattggctagggacgtacgaacagaagcccccgagagacagagacggtggaccccacagccgcctgccctcagaaagtgttctttatacagcaggctttcagggtagaacgtgtgcagccggccctgtcttctgacttgcttgacaacacttgggaccactggtcaggctggatgagcatcttgatgagaggttgcctgtgccggaggcatcgtcttcagacctcattgcagaacagcttggcatgcacgagtcgagcatcggtcatcacggtggttttgcttcaggatggcgtcactctggccacacagcgggctgtcttcatacagtggtcttctccaaatccttgcacctaaaaccattttgtcccctttctttcttccttccgtcagccctgtcatcaggcaggtttcttaccttgtatcacaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatttcagcattctggataaggaattacgaatgtatactgcatttcacattctgtaaccccaggctgtttcttagacttagcagttagccggtgggaagacctttgtgaacgtgagacatgaactgtaacttttagtttgtttttttttttttttttttttttgagagagagcctcacgctgtcacccaggctggagtgcagtgttgtgataaccacttattgtggccttgaactcctggatccaagggatcctcccacctcagcctctcgagtagctgggaccacagaagcacaccaccatacctggctaattttattttttgtagagacgaggttttcactatgttgcccaagctgaaatttctagttttgatgattatattttacattatttagaacaagtttcatgtttttaaaaaagcaaagcaaaactcagagaatctccttattgagctattttgaatagatttttaagttttattttattttttgtagagatagggtcttgctgtgttgcccaggctagtctcaaactcctagcctcaagcaatccttccaccttggtctcccaaagcactgggattatacatgtaaaccaccatgtgtgctctcaaatagatttttaaatgattgagaattacctcccaaaaaatagtgtaagtaaacaaattttgcaatttactaactttaaaacttttttcattaaatgacatctcaacaactttattgagaagtaaatctcttaatatgtgaatgatatttggagcatacaattaattcagtggtttttggtgtatttccacacacaatcaatttaaaacacttttatcaacccaaaaagaaacttcacacccaccaccagtcattccccatttcctctcctagcccaagacaactgcattctactttttactcctgtacattttcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaagccaaggtggaaggatcgcttgaggccaggagttcaagaccagcttgacaacatagcaaaaccccatctctgtaaaaaaaaataaaaataaaccaggcatgggtgtgtgcctataatcacagtcacttgggaggctggagcaggaggattgcttgagcctaggaggtcaaagcggcagtgagctgagattgcaccactacactccagtctgggtgacagagtgagaccgtatctttgttaaaaaaataaaaagggctgggtacggtggctcacacctgcaatccgagcactttgggaggctgaggtgggcagatcacttgaggtcaggagttcgagaccagcctggccaaaatggtgaaaccccacctctactaaaaatacaaaaattagccgggcgtggtgacgcacgcgtgtagtccccaccactcaggggtcagaggcatgagaattgcttgaacccgggaggaagaggttgcagtgagctgcgacggtgcccctgcactccaggctgggcgacagagtgagaccctgtctcaaaaaacaaagcgacaaaaaccaaaagcgtcctttgtttttgtggctgagtcgtatgtcagtgtgcagctagaccgcagttagctccttcaggcatcgggggacggacgtttgcgttgtttccactttttggcaattatgaataatgctgcttattagatgacatttgaattatgacatttattcatttacttttgtcttctgtggcacaaactatgaaaaatagtaattaacaattaggtttccaaaacctgtgtacatgtttcttcgaagtcattacacatttaactcaaaaggaaagcattaacttccaaacatggaaagtgttcaggcatctgactctcattacgtggactttattgatcctcatttaatacatgctacattcagctcaacccccttttacatgaggcggagttaaactcttagggaaaccagtgtgccgagacattgtttaccgatttcctttctgcagttgtttctcactaatattaaaatgaaattttattgtttataacatttacaaagtttctcggagtatttttatttcttcttgctcctcaatcttaggttcacttctcattgtcaatatctgcttaagaaaaggttaaaaaaattactgaaaaatgctaacaactatgattgtagttgctaacttatggttgcaaatggctttgtttttaaattgtgctgcattctgagtggggctgtggttgcgggtctttcagctgggagaaccaccacagacgacgagctagaagagatgctggagagcgggaagccatccatcttcacttccgacgtgagtgggggtgcggccctgtggctccatgtcctcttctgtagacagagctttttaaaaaccctttaacttccaaacccatcataagtttattaatattatcttttatttttgtttttccaagattatatcagattcacaaattactagacaagctctcaatgaaatcgagtcacgtcacaaggacatcatgaagctggagaccagcatccgagagttgcatgagatgttcatggacatggctatgtttgtggagactcaggtagttacagactcttgcattctccaagagagatatcagtcatgtgtaaaatcttactgcatcccactctgtctagtggatgtatctaggaaagctgttattttggatccaccaaattcaggttaattgcagtgttatatgtgatgctgaaatgctggaagcagctttaacagttgaactgttaacaggaagggactggttcagttgattaaattatggagtgttcataggtcagccttttaggcaaccataggcaacctaaactttgttcatggagaattcttactgaaatatgcagatgtttgtgctagaattaagagaaaagggagatacaaagatcttctgtgtatgcccgtacatatgtatgagtacataaacacaaacacatggcacgagcttggctccataaaacagtatccacagaaggaaaggcgtatatcaaacagtgtaatggcagtgagactatgggaattttaatcttctctaaaagtatttattttcagattttctataagaagcatatattacagtaataactaggagaaatgtctgaaagaatcaaccccaagtggggatacaatctatgacacagatgcaagcttgtgcctgttacacggggtttcccatctgcccagtaacacagatagggagtgaaagcaggtgtggaaaggcccttctgagtgaaccgaagagttaatgcaattcttaataaatagaaaactcctctgggaggctgaggtgggaggattgtttatgcccatgagttcaaggctgtggtgagctatgatcatgccactacactccagcctgggtgacagagtgagaccctgtctccaaaaaaaaaaaaaaaaaatacacacatatatatgtatgtatgtatatattgaactctccatgtaaagtacgggatggatcacagatcacatgctctgtgatgtgcatgggtatgttcacactcgctctttgtctttgaataaggtcttctcgttatttttcaaataccatggagataagactctgttgctggttaggattcagctgaccaccaggtgaagcggaagcatttatatcaaaccatcctaagtaaatggtttcctcacttgtcctgagcctggtttcggatctgttttggctggagtcatcccctaagtaggttcacatctgatgggcttattttctgagactgcctggattgtgtaaggataggaatccatccacacacaggattgttcctgcctgcttcagcaaccttgttaagaaacactgtattttgaagaactttataatgagaatgtgtgtgaaaaactcaggcaccatgcctatttttttttttttttttgagacagggtcttgctctgttgcccaggttggagtgcagtggtacaatcttggctcactgcaacctctgcctcctgggctcaagcagttctcctacctcagcctcccgagtagctgggaccacaggtttgcaccactacgcccggctaatgtttgtatgtataagcatttgctagaggaaaccaacagctacacagagggcagggatgggacgatcttactcctttttgattttgggggccccgttgccattcattatatggtaagtggagtgtggggagtctgattaccattggttacttatttccaggaagcattccaaaggaaaccagctggacagaaagaacgagagatgatttctgtaattactaaagcttttgtagtaccttagacttcaattgtaattgctctataccaaatgcattgcattaagctccgttagaaaaatggctgcatccctggctttgtttcactgtttccttttagaagtctgttggtattgcattatattgactcatctaatgcaaatgtgtgcatagtcagagattactagtaagttgaagtttgtgactgagtgagttaactctccgtcattcttcaatgctttacgattcactgctgcaggttgtgtctggacagacaaccaggtaatacgttacctccctcacactttgctgaattcacctctgtttacattttgctcattaatgtagtcagctgagtgtcagatgtgagctatgctcagtttactgatttaaagaagtagttacaattttctactttgtggaaaagatgtcattctttgtatattgtctgtctgtgcataatggtaaaatactagttcaaccaaaagctggctgcctcccttcaccctgcccatctgtcgaaagtgtctgcgtgttaaaggtatctcagaattgacttgaggtgcctttaattatcaacatggtggcccattccttttcattctttttaaaatataaattgagttttgattgctttgcactggcacatgtataatggcctcatcttttatctttctgtaaatgtgaaaaaaaccctcagtatccattacatgcacatcgtgtttatataaaacctttgttctatggttgtcttaaagatacatgattaagccatttgaaaatgtcttctaagtttgaaactttttgttttaagggtgaaatgatcaacaacatagaaagaaatgttatgaatgccacagactatgtagaacacgctaaagaagaaacaaaaaaagctatcaaatatcagagcaaggcaagaagggtgagtttggcttcgaagaattaagctgcgtttttctcttcatttggtttcaagttgtaatacattgatgtaagcctgcctaaaaggtattccaagaaataattaattaataaatgttttattttaaaatggaaataattttttttgctaaaaatttaaaaggtttattagatgaattatttgtagttcatcttttgtgttctaagtaattgaaaccctagggctgggtgtggtggcacgcctgtaatcccagcacttttttttttttttttttgaattggagtttcgctcttgttgcccaggctagtagagtgcaatggagtgatcttggctcactgcaacctccacctcccgggttcaagtgattctcctgcctcagtctcctgagtagcagggattacaggcacccgccaccatgccaggctaattttgtattttcagtagagagagggtttcaccatgttggccaggctggtcttgaactcgtgacctcaagtgatccgcccatctcggccttccaaagtgctgggattacaggcgtgaggcacggtgcctggcaccaaattgttggctacacatttgatgcagtgaacatttatttttaatttaggttattcgtgacttcttggtttggaggaaagaagagaattatttgagaccgtggacctgcagtcttaggtagcacccacttaaagggatcctcaaaagaagggaacccctttcactcaagatgcacagactttgcattaaaaagggttcagggaaccctgtgtgatttttttgttacggggcaaaaatttaaaacttactctcctaacttaggcattttatgatagtgcccctgacactggagagattatgggtttttcacattgtcacctccttgtgctaatacacagagatgctgattttcaccgtgttaggaaaaaatggagtgagacggtgtgtgtggatgcacctccaggcgatggccctgagacgcacccccgggctgcaggctcagccgccagggcacaccctcactcacacccccgggctgcaggctcagccgccagggcacaccctccgcttttcctgggtatgtctaagtatgctcgtcatctctgaaatgccagacatggtttctcatgttatttcatttattgctttgaaaaaattggcccctaatgtaaactgaggtgaagagatacctgtataaagtgcttaacttagttccaggcctaagtcagctttcattaaaaacaggcagtcctgttccttttctccatgacctgaacacgtcagtctggtgaaaacgatagtgaaagttcgttggttttacaaagggggaaggtggtgggtgtgatacgttttcattctcctctgtggatgagcaagcctggctctgtgaggtgcttggggtctgtgcggtagctggcgtataaactcgtcagagacgtgatgcctgtttcagaaatgacactgtctttttgatgagatgcctgctaatggaaccctcctggcttgtctccctgtccccttgccgctcaaatgctttgctgctgcccctggctcaggtgtgggtcgtccccactcctagtgtcctgcatttattcccgcggagccatgtggccctcagagggaggccaggcaacgtttgtagaagggttttttttttctgtgtgctatgtcaggagcagtgaagaagtaactgccaagaacataaaagaaggagcgaaaggccaagtactgagtgtgtcggggcttcatgacgaggcagtggggctctccgtcactgagctagcaggcccgcacctctgtacatgcggaaaactaactgcatgtctcagtcatcagaaatgtggcaaaatgacttggtcgtgctgtccccatggatgaaacctgaaataacagttacatagcagcttatcgccaagtagtctgaccttattaagtcactctctcaagaagtcgcccaacagtattaagcagtgtcctgtaacttagcttctaaagtgagttctgatgggttgttttgctttattttattttatttttttgagatggagtcttgctctgttgcccaggctggagtgcagtgacacgatcctggctctctgcaacctctgcctcctgggttcaagtgattctcctgccacagcctcctgagtagctgggattgcagacccacgcccggctggtttttgtatttttagtagagacagggtttcgccatgttggccaggctggtctcaaactcctgacctcaggtgatccatccgcctcggactcccaaagtgctgagattacaggcgtgagccaccacacctggccaggtcgttttattttaaatgaaggatgtcttttaatgtggcaatatgaaattaaccatgcatgatataatcagcttgcttttctttgacagaaaaagtggataattattgctgtgtcagtggttctggttgccataatcgctctaattattggcttgtcagttggcaaatgatggtgtggataacgtcagtgtgcatgcctctctgccagggtgggagtaagtaactcatcaactaatttacttattaacttttgcaattaaccaataatagtatttgcttaattgtaatagacataaaactaataaaagcttgccagccacgcagtacagataatgccatctagtgatacatctgcctgtgtgctgattcgagtgcccagccactgtgtttactgagaacaagcacaggctgggcggtaactcatttttaaaccaaggtcaccttcttatcccgtttttaaaagtgtttttgagacagggtctagctgtgtcacccaggctggaatgcagtggcgtgatcatggctcactgcagcctcgacctcctgggctaaaactgtcctcctacctcagcctcccgagtagctgggactacagacgtgcaccagcacactcggctaatttttaaaaaaattatttttagtagagacgagaactctctgtattgcccaggctggtctcgaattcctggccctcagcctcccaaagtgctgggattatacatagacatgagccactgtactcagcctgaatcttttgtttttgatctaagaccattagctctttacatgtagtggatccttcattaaatgtcatagaaattcagtgaagattaattctcagttgtaatgttttgtctcctgagttttagcttttagagtaattgcaacactgaaaggtactttataaaatacactaacgcatcattttactatggaatcgagggcatggatgaacgctgagaaaaacattgactgaaaggaacatccttcgacctttctataggcagcatctattttatttaaaaatatttcctttaatattaaaaggaaaattacgtattatatttagttagcatgcctgttaattcttaaagaattctgaatataaaaggtatcagtttatttaaagaatcaaggtgtgagtgtcacctttcctaaacttcagcaggctttgtggtttccccctggttttcttctgcattgggagccatccttgcactggccctgaagtggcaatgctgtcggtgtgttacaggtggacacagcagtgatttctctgtaaatgtttggcacaattcttgtattagacagttgtgaactgttcccaggtgtctagagtgtggcaagtcatccccaatgaatttattcttgggttatggaagtgactgcagacttgatagtcacccaaggctttttaaaaagttaacatacagcagaaaggaatcacgagcatggttaagtctcactattgctttgtaatctttaagatttattccttcaacatggcaacaccctgtctctacagaaaaaaaaaaatccaaaaactaattgggcatggtggcacacgtgcctatagtcccagctacgccagaggccgaggcaggaggatcacctgagcctggggaggtcgaggctagagtgagtctagatcgcaccacggcactccagcctgggtgacagagcgagaccatctcaaaacaagagattgatatcttaatgtgagcatctgttacgctcaccatgcagttaccagatgagaagttttccagttagtcttctgacatttatgcaaaagccacaaaattacacctgaaattactctgtaaggagctctgggatgctgcgtgtgttaacattccattatttggcagtcagaactctcttaccgtctatttttattaggcaggatgtttgtgtaggatgtttattaggcaagatgttctatttttttcttcttagctttgctgaaaatattgtacgtgatttttcttcattgttatagtagtatttttcaatattttcatgattctaacatgtactttctgagttttttcctagtagctataatatggttagtttaatgtggttacactaaagataaaattacaatttgtagcgcggacacagtgaaatgcgcgacttttcatgggcactacttggcattaaggttgactaaaagaaggctcctctcagtgtgacccctggggagtggggcttgaagtcctgtgccccgggcctggctggccatttcaccctagtgtctgtaaataagaatgaacatagaaggatcctcattcataaaaagcagaccaaaatgaataccagcagttatctttgcataggaaggcagtggttaatgtccttaacttcacttttaaaatattaacatagcctttcatcctttagcaattggccttcctggggctggctgctgcccctccctgcagggtgtgccaggtgcaggcctgtcaccccggagcatgggtgggatgggctgctttaaggagacaggtggagtcttacaggtattcggtgagagggccctggcccagacctggagctggactccccagggtgtaccctttccactctcgctgtcaccaggagattagatgactcctgagtcctgtaccctagactccatgtagttgacagtcatcctgaaagccagatgtggcaggaaagtgcacacacatcgagcacccagacacgtggcaggcagcacaacagcagcaggagatgagagcacgctgcgtggagctgactccaggtggcccagctgccagcacactcacttgctgagcgggagggcgcgcgcctccctctggagggagggaaggcatcacagagaaaaggaagaagaggtttctctaggaaggtgctgagagtggggcgtaggagcgcatatagaggatgagagagtggctggggctttgcaggaaatgtgcgtgatgttaacagggaaccagagtttgagggaggggccctcctgcaggcagctctccccggtcctgaggagtcactgggaggctcaccggggcctgccatgcgcctcttgataaccctgtataactgactgagccggcagtcttggaactgtccaggctcagcaaacaggatttcttaggtaaaagcactcgtacatttggaactgtaattaaaatgatggatctctgctgttcaaaaagagaactcaaagtcctacagcgcggtgcctcctgttgtgtcttcctttccttccctcagacaagcttcctggaggagactccatttattaagccaaaggtggtctcgctttgccttgtgtgaggatacttgttaattttaaaaaagttaaatgctgtgtcgcaccctgcttccagaccatcagtgcagtagaagaatgaatgaatgtcttgttgatttcttacacatttgtcatatttaaatgtaaaaaatggataaggccaggtgcagtggctcatgcctgtaatcccaacacttcggaaggccaaggcaggaagatcgcttgagcccaagaattcgagactagtctgggcaacatagcaagaccccatctcttaaaaacatattttttaattagctgggcatggtggtgcatgcctgtcatcctagctccttgggacactgaggtgggaggattgcttgagtccaggaggatgtgtttgcagtgagccatgtctgcaccactgctctccagcctgggcgacagagtgacacctcctttcagaaaagaaagaaaaaataggatttttcagccaacaagaaattcgtttaaagttttacaaatatgtgtaattcatccaattaaaagcaatcctggagttttattatgattaaaagaaagtgtcggccgggcctggtgcctcacgcctgtaatcccagcattttgggaggctgaggcgggtggatcacgaagtcaagagatcgagactatcctggccaacatgctgaaaccccgtgtctactaaaaatacaaaaattagctgggcgtggtggcgggttcctgtagtcccagctactcgggaggctgaggcaggagaatcacttgaacccggaaggcagaggttgctgtgagccaagatcacattcttttctatgacatggaggagtcctttcttgataatggatgtattttttaaactatcccaaatcccagaaggattagttagcaaatgccattgttgatttctttgatacattgcaaattaatgtttttctttatcttgcagaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactagg

SEQ ID NO: 37900 - DNA, 113970 bp, Homo sapiens; identical to SEQ ID NO: 35669

SEQ ID NO: 37901 - DNA, 3880 bp, Homo sapiens; identical to SEQ ID NO: 37743

SEQ ID NO: 37902 - DNA, 176675 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggtaaggggccgcgcctaggggcgcgggggacccagggtgggtagtacgtgcgcgcggggtcgcaggactcggtcacctgctcgccagcgtggaggacgcgcgggggcggaggggcgctcaggcgcgaggctgcgcggcaccggggaccccggacgcgggggcgcggagaggtgggttcccctccacagtcaggccgctgggggcttcgcgtcctgcaggaggtagcaatcgctgggccggtgggctccgggcgcgtctcgacgcagaagacagaggactgggcatccgagcctcggaatttgggggtcctcggggtgtccgacagggtggagaaggatcgtgccccagggcaacagctttggggattgcccgtggttgtcttcgagacccatcgcgctaccctccgaaacgtcgggcgtcctggacccccggagagtgcggcgtgcgcgccctgggcccgcggtctctcggagtccctgggtcggaattggttccgggccggattgggtgcggaatcggtgcccccaacccccgtgtgcgcagacagcgtgcagcctggctcctcacgtcgctgccgcccccccaccccaactccggagctccccaggttggatgtatgcgtatggttttgttgggagatgtgcccctttcccagccgaggagggacgcacctttgacctttctgaagagctgggcaggtcggtaaccagggaagggacaggcaccacccggctaaattcagaaccagtcccgctcctctgcttgccactccttaattgctcaaggtaagaaagtttgtttcagccctgtgattcataaataattagtaactagttttgttgattaagcaagatggaaaccttgaatatacgcacgcacttccacaaagtctaaacactcccgagcttgtgtccgggaggctttagtacggaaagttagaagccctggagttcaacaggtgttcaggagggtcccggagaggagtttcgtctttacgcgttgctttggcatccaccccaacttcattaaagtggttagcctgttttcctacaggtaaaacattgatcacttattaaattaacttaatcagcagagacgagctaaaccgtcttgatcatttagaacccaaaccttattttccttaatagaaaggtttttcctgtttgaacttcccaggtaattagttctaaagtagttcccagcaagacatctctgccagcatctctctctcactgtagcttggtccccatcagtgaattgaccaactaattatggcttgcattaaacacagagctgccctccttgggaggcactgttcacattcaagcgcacacactagctccatcttcctgccactaagatgtccttaaaggaaaaagttagccaaaaataacccccaaataaatagtgtaatgtttaaaagagttatcctgacctgcgccactattttataaaagcaaaaattcagtgtttcattacagcgctaaaccaggaccagtagaagtattggtatctctcagcagtctacttaaatatttagttaaaaataaagtgtgcaaagtaaagacgttcagtaattatcttccatctcacagagagatgtggagtatggcttagaagaattgtaaatgcgctgcttttagccgttttcttcttggaaatcgatgcctctatttatttgctgatctgtcccactgtgcgtaaatgtagaatcggttttattctcactgcttcccagaggggctcctgtggaggtgaaagaaggaaatacgttctagaggaaatatgttattaataaaacgttacccccaaagagttaaccacgccaaaaataaccaagtgaggctttactaattagtggtctgatgagagagtgttcagatgatgactaaagaattgatctttatgtagaaaacaacaattgtttttaagctcatttggttctcttaaaacagtttgggccctttaaaaaaatttctggctgtttaataatgcaaatgatgaaaatcgttaaagataacacatataacctgatgtgtgccatgtttaagttgaattcaccctatttttttgaacaatctttcttaactcttggtaatctttatagctcactcaacactgcaacttattagattaaaaactgaaagttaattttttcagaataaaataataaggcatgcgtatactttttaatttaaccatctttatatgttcattttttcagagtcttgcttttgaatcttaagaacccaaagggctaagtcttctttcttaatttttaaaacaagcatgtgttttgttctttacatgaatcgtcggttctcccagtgtgatcacgacactgtcccatgctgattccatgcacggtgcaactctttcccaagagaggtcagatttcgaggtgttgaaaatagcccagtgactcagtattcttggctgctttatgccaacggtttaattggctgcatcatagcaagcatctaattgagtttcacatttaaatagtggatagggtacttggtgcattatttgcttacagaagtgtctgattagcatgttcctgatcctcgttctatttgtagcaaagatgggaggtcagggactgtcacatttcatattccccacagcatctcatctcgatggggccttgttcagaatagatgctcagtaaataggtgtgggaaatgagctgaattgttggtggtcactatccaaaggtgagaaatttctgaatgctaatggggtacttaactatgagtaattctattttaaatctcaaggtgatgatgattaatagtatctcagggcactaaataaacatgtattaaatatgagcgtatgtttaaagggggagtttttaatgcagtctttaaggcacaactgcttctcacttgaattctttaactgagattaaggagtccttggcattttaagcaaagtcatttcttaggtaaagttcccccagagaccacttgaacttttgcaagtcttaaaacaatgggtggttccatttgatggttcagaatagaaaggagagtgttgatcctctacactggtatgaaaaaaactgtataaggagatggaggatgctggatatcatagtgcccgagaatcacctggggcccttgtcaaacacagattctaactcaggacacctgggagaggacccgagctgcatttctcacagctaccagatgctgcacgctggcaaggttttgggatgcactgaatccagttcagcatgtttactgagcatataccacatagagagcccagatgataaaaaaatgagaagatgggttgtacctgcccttgaggagctaacaaggtgaggtggcagggagagagagagggattgtaaactgaaaatgaggttctgggatgccattctctggggtggtggccagaaaggggcccaggaaaggagagttgctggtagggcttccacattgctgaccttgacctgtagtcatatttgaatggagagccttgtgacttggcaagaaataaaatgcagattttgaagtcagacagacctggggtagcctcccagctcagctatggcaacttttaacctgagactcagagtccttgtcagaaaaacagtgcaaatgatgcttaccttgccaagtttgtagaattaccagtaaaggacgcgtgttaggcctaacaaaagtgattgcttttattactgttgataggagagaggaggctggaaagcaaggaggacgaagaggttactaaaatatgttccatgtagttcaccaattagagattcaatttggtttaccagcaaacccaaggccggccgtggagaaccgggccagggctggagggcaggcagctgtggaagctaatcagaggcaaaatggaaaattattgggagcatgcttatctccaccctctcctgcagtccctggcttctggtttgctttgttgatagcccttcctaggatattttcatctgaagcttttcttggtacttaagctgtaggttctgttgatcaagactgctagtggcaatcaagcgctctttaaaaatgtagtggagaggacaaacacctctcctctttgaggggcattggtctattctgtggtgggtcactttccaggatcaaagccatcaatctgtctttccaccatagtacgagttacttgaaactagtgccgagcgtgttggaattcacctggggtgccttttatgctttgcactctaagatattgcttcctcctgccatctaggagagatggatattgcaaggcaatggtgtccttcaccctgatattaggaggggtcacctgggtggccctgaaaacacttcaaccaacatcactctgattttttaaaatatattttgggattccatttattatttgcaaaggcgatttctctgctaccatttgccttccacgctccctgaaagtaaatcttgaaaaccaagttctaagagaatggcaatggcagtttgatgtttagggggaaggaaaagcagaggaaccccctggagccaaggcaggcctgggtgagggtggagacgagagagggaaaggaaggcatcgtcaggcatgggagtaccaggatggaaatgggagcagtggtgggggctgaagctgagaggttggaccctaggactcaatttgtggactttgttgctttgctgaaggccgtggcagataatgttcccagaccactgaaaatcatccaggcttccagaaaacacaggcccatctaaagacagacaggtgacgaggtgacagaacctagtggcgtgattcttctagcctcttctgagccaaaaatgacatgcacaattttatgaatgatatttgtgccccttggtgataaaatattaagagctcgaggtcatctgaaaattattggttttttgtttataaaagtacatagtttttggaaaagatagaaaagaaggaaaaaaccccacaatttcaagatatattttccgttcagtgttttttctatgcattgaaatatttttatattagtttatcttaaaaagcacatggatataatcttgtaaaaattttcaaatagcacagaaccatttctagtagaaagaaaaaaaattcccttcatccttgtggcctacccataatcatcgccctatcttttatttgcctagcagaaactggattttgtacagtagactgccaacccacacctgcctctggaggtttatcagattggccactcaaccctggtgagggtggggctgctgcccttgccagtgactggctcagggtgagcatgcggaccctgttctagccaataaaatgtgagggtgggccactgggaggcttctgggaaagtttccctgctctcaaaagagacaaggaaggaaacagtcctttccttccactagatactgtgatatgtggccataatgcctgcaaactgggcagccatcagccaccagaggggctgggccaggtctcagctgacctgcggaagaatgcaaaggtgaagaagggcagggggcggggaggtctccgtggtgcccttgactttctgaattacacaaagaagagtctgtttttgaacatgtgtgagatcatgaaaccattaccagatgaagcaaactgagctagtttttctgttgtagccaaaagcatcccataactctccacctttctcaggaggtaatgactgataaccatggggcatgttctgctagtcatttttggcgcatttacatatacacacacatatgtacacttttaaaaactaaggccgggtgcactgactcacgcctgtaatcccagcactttgggaggccgaggcgggcggatcacgaggtcaggagttcgagacaatcctggccaacatggtgaaaccctgtctctactaaaaatataaaaattagctgggcatggtggcacatgtctgtaatcctggctactcaggaggctgaggcaggagaatcacttgaaccagcgagtcggaggttgaagtgagccaagatcctgccactgcactccagcctggcaacagagcaagactttgtctcaaaaaaataaaattaaactaaaaaataaaaacaaaaactgaactcattttatgtatattatttagcaacttaatatggcatggatttttaatgacatacctttttctttatttttaaaggctacagagtattattcagaagtacaaataggacgttatttaacccatccctattaataaataatctattgagttgactgttacagtttttgtattaacttccttatctgtatatctttatgtacatttcaagattttctaggtcagggattattaggcctgggtaaaggcacacctgtttgaaatattgatagatgctgccaaattgggggctaaaaaaagctatgcctgttaacctccccatctacagtgtgtaaggccgccttgtctccatatcttaactaacacaagatattttccagcttttaaatcttttttgtgcattttcacatgtttgaggtagtaccatttatagttttctattctgattgttttgacgtgaacataagcatttttccatgacataaacaatttaaattaaattttattggctacataatagttatacttgttttgggagtgtatcgatggtacatgaagacgcaaagggaaatatttgaaatagaggttgtctatgaaaattaagtggctatgatcgaccttgcagtaaacctgaaagattttctggaaatggtgttgggagacacacccctccagtgatatgtttccaagaaaaccctgaggagatgaccttccaggcctttctcaatccagtcagatggtaggctgccccaagcatttctaagaagctttgttgcttttagaatccatcagatttacagtcagacaggttctaaattcagttctctgaatgtacagtagttacgtaaacacttcgtacattgcatgagacagctgaaaagtaaatttgctgtattcttttaattttttcgacttttattttagattcaggggatacatgtgcaggtttgttacctgggtatattgcatgatactgaggtgtggggtatgaatgatcctatcacccaggtactgatgtagtacccaatagttaggttttcagtccttatcccctggctccctgctccctccagtagtcttcagtacctgttgttgccatctttatgtccacaagtacccaatgtttagctaccacttataagtgagaacatgcagtatttggttttctatttctgcattaattcacttaggataatggcctccagctgcatccacgttgctgtaaaggacatggcttcattctttttatggctgcatagtattccatagtatatatgtaacacattttctttatccagttcactgttgatgggcatctaggttgattccatgtccagtagacatggacatggaatcacgattgctattgtgaatagtgctgtgatgaacatgtgaatgcatatatctttttggtaaaatgatttgttttcttttggatagatactactatcagtagtgggatggctgggtcaaattagtagctctgttttaagttctttgagaaagctccaaactgcattccacagtggctgaactaatttacattccagtcaacagtgcattagtgttctcttgtctccacagtctctccagcatgtgttttttgactttttagtaatagccattctggctggtgtgagatggtaccttattgaggttttgatttgcatttatctgatgattagtgatatggagcatttttttcatgtttgtatgtcttcttttgagaagtgtctgttcatgtattttgcctatttttaaatatggtttttgttttttttgcttgttcagttgtttaagttccttatagattctggatattagacctttgttgaatgaatagtttgtaaatatgttctcccatttatgtaggttgtctgtttactctgttgataggttctttttctgtgcagaagctctttagtttaattaggtcccacttgttaatttttgtttttgttgcaatggcttttgaggactttctttcccaaggccagtgtccagactgatgtttcctaggcttttctctaggattcttatgattgaagtcttacatttaaatccttaattcatcttcagttaatttttgtatatggtgaaaggtaggggtccagtttcattcttctgcatatggctagctaaatatcctagccccatttactgaagagagagtcctttccccattgcttatttttgtcaactttgttgatgctcagatggctgcaggtgtgtggctttatttctgagtcctctcttctattccattggtatatgtgcctgtttttgtaccagtaccatgctgttttggttactgtagccttatagtatagttagaagttgggtaatatgatgtctccagcttcgttctttctgcttaggattcctttggctattcaagctcttttttggttccctatgaattttagaagagttttttctagttctgtgaaaaatgacattggttgtttgataggaatagcactgaatctgtagattgctttgggcagtatgagcattttaataatattgattcttccaatccatgagcatggaatgtttctccatttgtttctgtcatctatgttttcttttagaagtgttttatagttctcattgtagagatctttcacctctttggttagctgtattcctatgtattttatattttaatggctgctgcaaatggaactgtgtgtgttttgttgttttttttttttttttgagacagagtctcattctgtcgcccaggctggattgcagtggcgcaatctcagctcactacaacctcagcctcctgagtagttgggactacaggcacgcaccaccatgcctggctaatttttgtatttttagtagagatgaggttttgccatgttggccaggctggtctcgaactcctgacctcaagtgatccgcccgcctgatcccagcactttggaactgtgttcttgatttggctctcagtttggacgttattggtgtgaaataatgtagaaatgctactaatttttgcacattgattttgtatcctgaaactttatcgaagtcatttgtcagttctaggggccttttggtggagtttttcggggttttctagccatagaatcatatcagcagcaaagagagagagtctgacttcttcgtttcctatttggatgcctttactttctttctgttgcctgattactctgactagcacttccagtactatgttgaatagaagtggtgagagtgggcatcctcatcttgttccagttatccaggggaatgctcttaaaacattttcaattctgctagagaagagaggaaggcaaatgaaatggataaaactcataagaaatgttaatcacccttcaggcaagggcacatttgaaaagcaccactcttgggcatggacctctgatcatccttctacttcctcactcctaagtgatagtgcatagcccaggaacacccaccacctgctgtcctccaataggaaaggaaaaggcaagatgacaaaagaaaaaaccttctcagagtcaacagaccacacaagaaaaagataccttgaaagcaaaaacaacctatcagtagacttcctggggacatcatgaggcagccagcatagctctttggtctttgttgcatgcattgaggcatcccaaatatcctaacgcgaatagaattgttagtcatcagactacgtgcaataacatgacaggtggtagaagaaactttgagaccacgaagaaatgagaatgcctctattttttattaatttttatgaatgcctatattttttggcatacaaatgcaaacatttgttttctccttaattcagatgggttaactccatttctttttattttatttttatactataagttctagggtacatgtgcacaatgcgcaggttagttacatatgtatacatgtgccatgttggtgtgctgcacccattaactcgtcatttacattaggtatttctactaatgctatccctccccctcccccgaccccacaacaggccctggtgtgtgatgttccctgccctgtgtcccaagtgttctcattgttcagttcccacctatgagtgagaacatgcggtgtttggttttctgtccttggatagtttgctcagaatgatggtttctagcttcatccaacccagcagctagtcatggttctccgacatgggctggagtccttttggagtattttcacaaatagtccccgtcagtagaagtcagatctgtctttagtgttgtatagaaacatccatccattattttttcaatctcagaacttgatggcttcaattttccattatccatcatggagggtgaagaccttttagaagcagacagcatcatacgtccacataggtcacgggacaaacagtgctgatcactgcctgttgacaaagtgttgacagtaagggaggggaggaaacattttcttgtagctagagaggttttttgaggaggtgggttggagtgaggacaaggggaagccagtctggctgctacattgacctaccaaatcttgtgtttgggctgggcacagtggctcatgcctgtaatcctagcactttgggaggctgaggcaggtggatcacctgaggtcaggagttcaagaccagcctgggcaacatggtgaaaccgcttctgtactaaaaatacaaaaattagccgggtgtggtgatggctgtaatcccagctactcggaaggctgaggcaggacaatcacttgaacccaggaggcggaggttgcggtggactgagattgcgccattgcactccagcctgggtgacaaagcaagactctgtctcaaaaaataaataaataaaaataaaaataaattgtgtgtttgccacgtcagcacttcagtttgtgttgtctacgaaagacatggcatacagtatcataagttactgcaaaagatgcctaattccctggagatcaagatctaataacaaatacgaggaaaactttaaaccccaagttgtggggtgtgtggtaaggtgggggcggatgtgtcagctagaaccttgctgagaacgattgctctgcagctctgtcatctcagctcatctaatgaccaaaagcagatggaagtttttgtgtgacctctccaaggccttcttaatggtcagagagaattttccttttatggcctcccccctttccccttcatagcattgtgggagagagagattcattcacaaccaatttgcatggcaattttttagaggttttatgatctctcaagcaaaataaaatcttctttactttcatttgatctgaaaaggtaccacttttggaaactgtccaggggaagcacgggacccctggatttggatccagttcaaggtggccttgatgaaaatagacccctatcctgcattttacatctccttcctggcttttctattctctcaaacctgcaaacccatattctttttgccttcgtttgctgtcatttaccccctagcatgctgattctcagctgccagggccccaagtccttaacttgctctccagttattcctgggatgcttcctggcaaggctccagctgctggcatcattgctcttgtcctgatgtgtgtgtgtgtgattctcatgaccaagctgggctctgcctgggcctgcgatccccgctgaatcccctgcacctcatgtagggtaggcacatcggcattctatcacattccatggagagaatgagagaagaactgtgctgattcctgactgccagacagcagatatgagcccctcaaagagagtctcaggaaactcacagcaccctgagccacctgtatctcccttcccaccctgggcaggtcattcatcatccttgtcccctgatttctgtagagacctgctccaagcgcttacctgacggttgccatgttgtacctgccctggcaattgttggctcctcctcagccaaggcctgctgctattgctgtaccagttcagggagtcatgttcccggtgctctgtgaaaaatggggatttattgggcagcaaggtggtgcgctccagtgtgcgccacatctgtttggtcttgtactgtttggtatatacacagtccctcggtgggagttgttggttagccttccaactgtgcagtaggtttttctcctctcgccatgcctggtctagtagcattctccccagaagaacgttgctgctggtctgcttaagagacctggatgggcccctgcctggcaatgacccaggaaacaatgggggtgctagtgcaggagacaccatgcttaaattttaaaaggaatagttaattcttcttgggctcccagtttctgggaagctgtgctgtgtttgtgtgagttaggtgtccaaagtggtcagctatctaacctctctgtacaaaatctccttatgttttcctcgtgccatgtgtctaagcacatatctctatgaagcaacggcatctctttgcccattttgtacttctttgggtggtatcattcggatgtgcttccctgaggcgatgtctgtgttttctaacagctcagactttggcagctcttgcatctattgcagcctgtttatatgagacacctataaaaacattcagcctgcaccgtgggtgtgccagcagcaccctatgacctgattttaaatcacagtgtgtgagtggccatcgtcttatgggccagggcatttttaaatggtgtaacgaggacagcgcatggcccatagcagaaagctttgacgccctgatatggtcactgtgaccaagtggccttggcaagttgcataaaccccatgactcagtttcttcgtctgtgaaagggagatattgatactcaggatgagaatcaagaggagagaatgcttgttagagtttcataaaaatgaaaagtagtgctattgatttattttgcgctgtgaccagttcactcaaactcttgcacacccagctgggtaaatgccagcctcaaggtgttttcttcttgaatgaagtacttggttttttcagacaaggtacattctagcaagtaaaaccccaacatatcccagtgttctcttgaaagctaacatgaagtgggggaagtgaaatacttcaactctagaagccaaacactcagaatgtcttggcagttgcttggggctgcacagtgtgcttttgaaagcttttgccatttataagagcaaagtaccctgataaccttttgtgtctgggatttcagtccaaatcaaatagcctctgtgtatcccatggattctgaaatttttatgggatgtgtggggctgttttgccatgatgaatgtgacatgtgctacttcatgtggcctttcttttttatctaaagaggcttggcttgcagaatggaggctcagctcccacagttcttaaaggatcctattgtttgtctcctatgtcagcatcccctgaagaataaggatcacctggttttcaacggaaccaggagtttattcttcagattggagacacactcccaattctggttaataagctggttttgaggtggaaggaaaggaccctagtgatcatctggtacaacgtggtgcaccttttccaggtaaaaactagaggctcagaaagcaaagaggcctttgctgactcctggagcttgcccggcaccgaacagaccagccgaccccttcctggtggctcagtgcttctctttctctgatgagtcctgaagaggcttcctcacctggagaatcaggggtttctcaggccctgcttccagagaatccataagaatgaggctttctgggctcagccggcgcactctccacccagaggttttgggagggccacgccacaggccaactacccactctgcctgaatcgccttatctctctgtgtgctctccacaatctgctctctgccgtgagtagcataagataaggaaggctgggtgctagaggcagctgggtacagggagaaacaaggacaaggatggacacggaccgtccacttgacttgtgggaaccagctgactctcttaggtgcggacatctgacttttttcagatagactgaacgcacagagctcattcatgcctatgaaggagactaaactgcctacttacttgaccagcttttaatagtgcttctcatgtatgccaggcggggtcagggtcagctgcaggattttctcacccgtactttttaatcccataacattgccatccttggccatccctttatcatttttcttttcttttcttttctttttttttgagatggagtctcactctgttgcccaggctggaggagtgcagtgatgtgatattggctcattgcaacttccacgtcccaggttcgagccattctcctgcctcagcctcccaagtagctgggattacaggcatgcgccaccatgcccagctaattttttattttttattttaatttttgtatttttagtagagaccgggtttcaccatgttggccaggctggtctcaaactcctgacctcaagtgatctgcatgccttggcctcccaaagtgctgggattacaggcgtgagccactgcgcctggcccctttatcatttttccataacaatttaggcaaggtaaaaatatcatcaggtccaaggatcatttgggaggggggaccctgtgttcgacagtcatcgttacagacacgagtttgctcatttgctttgacagcagtcacttggagggaagcactatgctcttcccattttccatacaggccaccggggcgcagataagttaaatgactggcatgaggacagtcagaacaggaacttgaatttcactgtttagagaagaaccagaaatagaacagctcgtttttatttactttttctgaaatgttgctttgaagaaaataggatgtgtgtaaatcaaatccagcatctgaacctgccttctttagcttcagcaggtttttcttgagcaggaggtcactgtgcggcggctgggtgcatgccggagtaggaaaccactccagtttggtgtccgtgctcgactccacccttcggaggaggaggctgcgtgtgaaagggtacaaaagaggaacgcttgcaggaaaatcttttttaggacaaaatcattattctgttccttgctgtcttttagtagcgatccagctttccaaaattgtttctctggctgtaataaggattgttaaatcaggacactcattatgtctctcctcattttggagtcaggtacatctttcttcagctgagcttaacctagaagccagcatggaaaggtaggggtcacctggaccacatttgtcaaacagcttttcacctgggtctcatcatcccgggcctggaaaacccgagatggactgaatttatggggaagcctcctagaagtcactcagggtcaccccaaaacatatcctcctgcccctcttcccctccacagctgagcacagacctcagcactcaatgtaatataaaggaaatacatgcaagcaagatattaccgacttttgagtaacagggttttctaagtcattgttcctcggtttgactcctggggagtatctccgtagtgattcacttaactgattaagggcagttcagagcatcctaaccccactcccgccaccagccttggttgtaagcagagatgccaggctctctttgcaggatggcagtgaggagcccagttaggttacttccactttgtctaccttcctgctgctaccgtttatgaaaacagaagcaaaatctgaacataaacatcaataaagtaatttgattgacatacatatacacacacaaaatcaaatttgccctagcgacctcacttcgatgtgtaccacccccatcccagagaggtgggatcagccacccagtgccttctcagaataagcatattaccctgacccgagccatttctgttttgttttcttctccccacctggaatccttgaataacatctgtctgaattattctgggctgtatatcatttcagagagttctaggaaacaacactgaaactgatttaagaaggcttttcagctggaagacatggccactcaacgcctgcgcctggggacagtggtggtaggggagggtgaggttgggatgacctgtggtaggaccaaccatggaataacagggtcaggagttaacgattcaaggggtgcctccgagttcccattgtgcaggtcaggggtggctctaccgagtgaatgcccttcttctttcttccgtacgcacggaactgttttgcatcttggttccaatgcctccctgggttctatggcattgcagctttgccccgtcgtgaaggcaagtccccgggccacatgtataatgttgggggaaagaggtatacagggtttgggaggaatggggttttcctccattttcccagatagggaaatgtgtggtcagaaatatgaaagaactttgaaaagaacatgagatgaggtctgtgaattgtgaaacatggtgctcctcttagttctggggcagatttttcaggatcaagaactaaaaccaagaatacctttgaacactttagtgtggctcatctggtggccacactcacattgctatttccagtaaattacatcgcttacagacactagagccatacagcagcgggaccccatccttccagagttattaatgttctaggacaaatctagtatcccaaggagattttctttcagctaaagcagaagcctgaattcacttgagttcgggcagaatagataattcatccagattacttgaggccccaaatggatctgacagtctaaaagttagattgtaaaaggccgtattgatcctaatatcttattctctttcttatacctaactagggattgccatttttatttattttgtttttttgagatgaatttttgctcttgtcacccaggctggaatgcaatggtgcgatcttggctcactgcaacctctgccttctgggttccagctattctcctgggattacaggcatgcgccatcacgtccagctaatttttttgtatttttagtagagacggttttgtatttttagtagagacgaggtttctccatgttggccaggctgatctcgaactcctgacctcaggtgatccacccgccttggcctcccaaaatgctgcgattacaggcatgagccaccgcacctggcctggattgccatttttagacacacagtttaccttttaattttgcactgtcctgttttgataactacctggaaaatacttggggttagctgctaatctgattgaagataaatggagttttcctcagattggtctttttgcccttttcaagctgaagtaaagaacagttgggcgtatgctgggaggaggagatatggaagagagacactgttgtcctcaactgtgattctaatccaggaagtgtcctttagagaggagggtcagggaatgacagagctggacgagaccttagaggtcaggaagccagcaccatcattttacagaaggggaaactgaggctgaggctcatcagtggcagaacccagggtgggaacaggtcttcagccttctgtcatgaggtcaccatctgcctttccacctcattctctgcagcaccctttctttcttgccctacctgtctttcagtggcagtgttaattattttagacacaagaacgtgattgtagctgtgacatcagaaaacgactatctttcaagccctgaaattgtcatccctgggttagcttttttttttttttttaataattcccctaagtcagatgggttataataaacatttaagatttgcttttcatgaatatgtgtgctgatttaatttttcctgaagattatttcttttttatttgagacagagttttgctcttgttgcccaggctggagtgtagtggtgcaatctcagctcactgaaacctccacctcctgggttcacacgattcttctgcctccacctcctgagtagctgggattacaggcacccaccaccacgcctgactaatttttgtatttttagtagagaagaggtttcaccatgttacccaggctggtctcgaattcctgacctcaggtgatctgcctgcctcggcctcccaaagtactgggattacagatgtgagccaccatgcctggcctttctcttgaagattgatttgcatagtcagtacgctgagatggagagagcaggacaccggggtcagaagacccctggtctaggcccttttagctgcagagaagtgactgactttacatcctctgagaaattgagataacaaggcctgccttctcaaaggggtgttcataataatcggaggagataatgagggtgaatttgctttgaaaattgttagtactgcttagaaagtttaaggggtgctttgctccattgctttggatcagttattttttaatatacagagaagagattaaattttagaaatatatattaaatatatatttacagttgacccttgaacaacagaggtttgaactgtgtggaatcacttatatgcagctttactttcaataaaagttatagtgaatgtgcctgactctcctgcctccccttcccttcctccgtctctcccacccctgagacagcaagacaaacccctccttttcctcctcttcctccttcttggcctactctacatgaagatgatgaggatgaagacttgttttgttgttattgttgttgttgtttttgagacagtctctctctgttgcccaggctggagtgcagtggcacaatcttggctcactgcaacctccacctcctgggttcaagggattctcctgcctcagcctcctgagtaacagggactacaggtacctaccaccatacccagctaatttttgcatttttagtagagacagggtttcagcatgttggccaggttgctctcaaactcctgacctcaggtgatccacctgcctgagcctcccaaagtgctgggattacaggtgtgagccaccgcgcctggcctgagaatgaagacctttatcttgatgcacttccatttagtgaagagtagatagatctcctctttcttatgattttcttaataacattttttctctagcttagtttattttaagaatatggggtatgatatatataaatgaaatacgtgttaattgactgttatcagtaaggcttctggtcaacagtaggttattcatagttaagttttgggggaatcaaaggttatatactcatattttcaacttcatgagagttggtgcccctgacccctgcattgttcaagagtcagccatatttctatacagattatttttgtaatccttcgaattttttatgctttcattttatttttatcaaaaattgctgccaggcatgtctagagtttttgtttcatatcagttaagaatatttgtgcttcacttttgaagtccatcttcttctatagatactcttagaaccgtaaacagctactctatgtttaaataatatttttttctttttgatggaatttaggattaacttgaaaattgctcatggttagtagatgcagagtgcgtgaaggcagatttttctcatctatattcagggaattttatgctttacatgaacagcagatgttagtggcattactccgttcacctatccaggccccggggcctttgctcatactgttactgctgccctggaacacccttccttccgtcgttgcttgccaattcttgttcaccctttcggacagctctggcttctaagatcctgcccacaggggtcgaatgtctgtcctctgggctctgacagagactcctgcatgtctgttacatggcagtatctaaattttacagttccaaggttaccggtgtggctctccttcacttaactacagcgaagactgtaggttcccgggagtggggaccacgtgttttttctcctgtcttttaggagctgctgtagagtagacttgctctatccatgtttattgaactgcgctgaaggacaggaagcctctgctcatttgaatggagacccatcttttaaaattattcatttttaggtccttgagacgcaccattttattaaatccactgtgttcacagacccggcttcctcacaaccctctaatgcaaccttctggtagccgctttataccctggacaatcttctctccacagcccccatttttttttttaatcttaacccccacagcaacctgatgttcctgaggctttgtttggggtttagaatctggaattccagagtcgatctgtcagagaacatcagatgcctgtgaagtcatcagtttcacagtggtggggcagggaacattgagaaccatatccatcagagaaagtcacatgtgcgaagggaaagagcaaggggcaaacagcagtttgattccatttttgtttaaaaaaatggaaaagtgaaaagaatgatcgtctaaaaataagcacgaggaagtctagaacacggtgcttaccagtcaagtttggagtcaggcagctggggtttgcatctctgctccacttctgattggctgtgcaacttaggaaagtggcttcagtccagggtctccattcctcctctgtacagtggggataattgtaggatctgcttcaggatgttgttctgaggattcacggagacaacatatgcaaagccctacagttgtgcctggcatatagtgagcaaacagtgcctattacttgttactgttcaattttctagactgggcgcgacagctcacacctgtaatcctagcactttgggaggccgaggcaggtggatcacctgaggtcaggagttcaagaacagcctggccaacatggcaaaactctttctctactaaaaatacaaaaaaaattagccaggcatggtggcaggcgcctataatcccagctactttggagactgaggcaggagaattgcttgatgaacccggggggtggaggttgcagtgagccgagattgcgccactgcactccagcctggatgaaagagcgaaactccgtctcaaaagaaaagaaaagaattttctacagtgactgtgtatgcccatgccaaatatacctatgaaaaatttggagaaagtgttaaaacaagcataatccctatttgtgtgcctaagatcttgctgtgggcctgtgtaaagtggccagaggggctggtgactagttgatgtgaccagtgactaaaggttagaacattcgataaccagactgaccctccagaattccatctacacacacatacatacacacacaaatacatttacacatacacatatacaaacatgcatatacacgtaccacatgcatacatacctgcatatgtgtatatacatgcacacatatgcatacacacacgcatgcacaaatacatgtatatacccacagaaagacacatacatatgcacatacatgcacagcgtatacacatgcacatatgcgcatgtacacaaatacatgtaaaggtgcacacatataactgcacatgtatgtataccatatacataagtgcatgtacatatacacaagcatgcacagcatattcacatccacatatgcattcacacagtacacatatacacacatgcatgtatgcacaccatatacatgtgcacatgcatgttcatgcatgagtgtgcatgtacgcgcacacacacacacacacacacacacacacttaagcccccaggtgccaggaagactgcagcactgtcttcctaggtatttacatgtccaaagggatgaagcctagatcttagagacaattctaggtcataaaagcccagactcatgaggctttctgacccctggagatattttatttatactttaaaaggttggggtgagaacccaggatcctttccatcccatctccaaggagctaaaggtttctctcccttctttctacttggggagggaggcagctactcctgcacgtagacagaatgcatcgtgcgccatcccttgtcaatgggagctagtctgcgcccacatagaaagtttccttcgactgtcatcatcttgcttgtggtctgggtgtcggggctgctgctgcagttactctggctgttagtcagggtgtgagtgtcagtaaagaaagggcccttttccctgacccagctgcctcctctttctgcagtattcacttatataaagtccttagtcgtgcaaggtgggcagcatctcagaccctacacagtttcacaaagcgggtccatataactgagcacttcactggcctagagaaacctgtgtccttgtctctgggatgtgtttgaggaactggacgacaggtcagcacagcccacaggtgcattgttgacaacaggaggctccatgtggccccaccagtgttgcttcttttagcaaagacattcagtgcctcaacaaacagccagtttttacacattgtagctggattctttttacagaaaagtacagctctatcataatgaagtgattctgtcctaagctgttcctgagaggagtaggaaatgctgggatcggccaggtgtggtggctcatgcctgtaatcccagcactttgggagtctgaggcaggcagatcatgaggtcaagagattgagaccatcctggccaacatggagaaaccccatctctattaaaaatacaaaaattagctgggtgtggtggtgcatgcctgtagtcccagctactcgggaggctgaggcaggaggatcgcttgaacccgggaggcggaggttgcagtgagctgagatcgcaccactgcactccagcctggtgacagagtgagactctgtctcaaaaaaaaaaaaaatgctggcatctgttccctggtgtccccacttttggtcagcctcacctgggaatttcatacattttctgatcaaagtccaaagtctctgctttgcttgagctttaatcattggctataaagcctcccctgcccccaacattgcacacacattaaaattagattacagccaaacagcaatatagttttggggattgagggggcaggtaagaagcacatttttagataaatagggaatcagaacctccattatgggaagatgttttgatagtctcaggtaaaagtctgcttagaaaaattttcactgcaagttttcagtatgttttgagatagtttgtcctatatactgatatttgttcattgttgaaatggctctgacccttgttttctgttatttaacacttatgttaagcagaagaaacataaaatgctttccacacttcagtgttcactttaacattttcttgattaagaaaaatttccatttatcttaaggaagtagatgacatttataaagagatctaaaggatctctttataaaggaaaatggatgaggtttagaaaggactctggcatgaaggaataattccttttcagagtgtcctttatctcacccatcaatcagttgttcagatggtttggcaaatgagaagatggtgtcctgataagccattccagaactaaggaattccagcacccatgtcctccgtttgctcagaaggagacagaaatggaagattccaatgattagatacaccaagaagaggtgagaagagaaatggtggtgaagatgcccaccctgatagggccgggctgcccatagtacacagactcccagggccgtgtcagctctcactgtctgcaggctcacagcctggccacccaatttctccttcaatactgacccaattaatatagggtttgtgtcatcatccccatagttagtgaagtgatttatctacccagcaaccaccatgcccagctctgtgctgggtgtgggtaccactgaagggggactccatggggtcaaggggaggctcggggctcagaaggaccctagggacccttacccaggatgttgggagagtcaggggttttgatcagcaagtattttgataaatctccttaaccatatattttatacttggaacaccaattttcagagaattagaagaaataagtatacataaatgttacagaaaagttcacctttctttgctcagttagcctccagtggtaccgaggaggaggggcccgtgattctgaacagttttctgcatgattccccgccagctctgcaggtataaaaggtgtagggtaccacactgatatgcatcgactgcagagtacattttgaaacaaacccttaatattaatttttctttttcatttagctcttatgtcgccacatgaatataggggaacgtttggttgtttgaaatctagatcagtgagtatttcatattgatgctgtccggatgagtcatacttactactagaaagtgagatgagagtgttttgtgatcattcaaatgggttgtgtatagttgcgcctctttccagagcaacagttgactttttcactgaaattaactacttttcctttgccactttcgttagagaaggagacagagagtcaagggtgaggaagggatgagagacattgtactgtgggaataaacaaagaccacccaaatgagaacaagcagaggccatttatccagagcttgcactagtgagggtgtcggccaccagcacttgtgtttggcagagacttagaggcaggcagggggtgggaaagcctcacagtggaaagaagggaaggctgcaagcatgccctgattggaggctgttggcatgggggagctgctggtaactaactagaaatggggcctcctgtgtgatccgttaggggagcatgtttggctctctctggttggttctaagttggaagcagtggatcggggtggaattagggcagctgtcatttattaatcaactcctggccatttggggctgatcattatagtttggcttcgtggatggtggctgcagatagaggtctgacttcttccaagtctgacgtggagcaggctggctccatgctgattattgtagatgaggggctggcttcctgtacaggttgctgcaggctggggatcaggttctgtttttacatgtggtctgcccattgtccatttgtacattcagtctctcagtgccaatgtagcactggctaagaacaaacaacagacccagcacaccggttggcataggctagcatggaagccacccagccaggcagctgactacatgcactcaggcacccaggctgctctgggtggatgccagctggggccacactgcagccatccaatgtcagccctggtgggcagtttcatacttggccatggggcttgttgacagtgcagtgtctttgtgctgtgagctcctaactgccttccttcaatttgggattcacatcagagaactgcttctctgagaggcatgctgttttattgggcaaggcagctctagctcagattttagcccatttttggtagtgaccagctgtctttgtcatctagggatcccctgacagtaaaagattctcctgcatgtcatcatgctcctgttctcagctctcacctggttcctcaccatggcagagggttttctggtcaggaatggattattccaaaccactctggaatttctgtaggaaccgacccctccttcagtcagtttcttgccacccctgcaagttcaatgctgtggcttccccaccctgggtgcggtgtcaggcccaaggtgaatggagacagtgcccaaatggcttggccatgtgggccagccctcggtgcccacgatttcagcacctgcaggcccacatgtggttttctgaaggtcatgcccctcccccatggttttctgcttatatgtttcttgtgtgttttctccaacatttagggaaaattctagggtggtaacatcattggtagtcaagggagacactggaatcttttattttgctagaagatatgaataaaaagtttccagagtttaaggcattaagttttacataaaatgcgcttaaagtattaaagttttataaataaactctaaaaatgtgatgttgggttttgaaagacatctgtaatttttgaagaggggatggttttaaaaaggcatttcttctcttgtctttgtgtgtgtttgtacgtttaaattaaatgacatccactgtgtgtaggagttaaaagagtgtttttttctcctaataacaactcttgtaccattgactaccaagaataacaataagccttctttttaagttaaaaaagaatatttatttttgtcactgaaagaacaattattcatgtctttaagttaaagtatttttatgaattctaaaacattttgatgtttagctgcacacaataaaaatgtcatattagttggtccttcaactaaaatattttggttgcaggatcttggcctttcaataatactaagtatcatttaatgaggacttatttgtgccataaagtgttgaaaatgccttacatatgttaactcatctactcatgctattctcattttatagcttgtaaactgaggcccagaaaggttcagccatctgcctgaggtcacacagccacagtttggacctgagccatcaatcatccaccaaaagcctgcattgaccctagaagattccattgcatgttgtcaaggcgcttagtttctctcttgtgtctccccaaaacataaacctggaatggaagagagccacttactctatagatgcttttagctcagaacgcttcaagcttttggagtatgagaaataataacaatcattccattctttcctggagtttgatctcagctgttggtgatattgttgggactgatttgctatctataaagccaaatttgagaaaagacaggttaaaaataaacagggaggatgatggtagtaaaaataacgtgactgtcttcttatcttggaattcttttttagtttttagcagagttacatttcttcgttgtggtaaaatacttaatgccactgaactgtcacttaaaatggttaaaattgtgcactttagattatgtatactttaccacaataaaaatgaatttttttttttttgagacggagtctcgctctttcgcccaggctggagtgcagtggtgtgatctcagctcactgcaagctccgcctcccgggttcacaccattctcctgcctcagcctccggagtagctgggactataggcacccaccaccgcgcctggctaatttttttgtatttttagtagagacggggtttcaccatgttagccaggatggtctcaatctcctgacctcgtgatccgcccaccttggcctcccaaagtgctgggattacaggtgtgagccaccatgcctggccataaatactttttttataaagccagtgagctgatggggaacccggcaaggtgtgacatctgtaggactcaaaggttgtagtgaagttttctcctagcacgttaatgttctgtgttgatgacacatgtaatcagaacgccttcgccatatatgaagacctttaggaaaaagccaagaatagtgtagaagggccttcttttggtacaagaagtggctgatttcgtggcctcaagaaccactttggtttctactgtgtttggggaagctacaagtacagataaagacactgtgaatatatgtctttctgtgtttaaaagaagaggaaagaaaagagttgatgcagaggggacccctggaccttatttttagtgttgacaaatctggtatcatttagaagtggatgttttcaagggctttccccttaaaggaggaagcagaggcccagggaaggagcttgcattgggtgggccattgtgatgctgtggctgggcctgggagattcgactggactcatgtttttattgggattgttttcgattttgcaaagaccctggttacaaagtccggtgggtcctcagtggtctgcccagccctgcttttcccattggcccagtttttcttagggtgtgatcttccaggatcatatagtattctagaagagattcctgtatcatacttgggaggtaatgtgaatggaaagttcttatagacacaaatcttataggaaagatctggatgaagccttgagtgtttgcctttctgggatccaaggaaactcatgaaacagggaggatttaaaggaggaggaaagggaagtgaaaagagaattcccaaagcctggaattgacccacacagtttggcatgaaatggtcacttccgcatctagagcacacattatttttctgaagcaccctgttgaatgagaggaatacatacgtgccatcataggttgaaaaagtgatcttttcagcataaattggtgggtgtttgagagcattacttgcacagttcaacaatacagagctggaaatgcataaagaggacattccctgctagtcaacgaatacatagatctgtagctggaaattagttttaactttcaagtagtcaagaaacttttatgtccaataagactctctctacgtaattttaggctgtacactggttaaaataattctatttggggaaaatcttgtggttgtttgtcccaaatcgccctgacatgttctctgccttgagtccccaaatccctgccgtggggcgcagcctgtcatgcatgggccaggaggacagccagcacacggggcagatgccgcaggtcatccagctacgttttctgtgcattcatctcaggaatacgggtttccctgcacacttaaatctacgtgtaacccaagtttatagacctgctgggaagtggaaggcagttggttgcctttctcaaaggctgctccatgagcaagatgcctttcatctagaccattccgctggaagcatctgtcagaccagagtagtgcatcagtctaaagtcagctctctcttctctggtttagggtggtagttgtgtgctttggttctgtttagctgagtgggtgaatgaaagtaattaagataccctaaatagggtctttagctaaacggtcacctccctgcctaattgtgacaccaataaatccaagaaaggggaggacagtggcagcaggtcacagtgggaggatcatggcttggagcaaagacaagggctgtgagttccagccctgccaccattagctgcagtgtttgcgcagttggtttcacctcccaggtcttcaggttcttcatagggtcagaactccaggtagatcattcctgggcttccttcaccttgaaaaatctctgcctcaaccatattctaatcacaacattactataaaatgataggcatgacttctatatttacaaaaagccataatgtatttcctcactctctgtaggaagacatttgaattgttacattctttactttgctctaaagcaaggttgtggaaggtttcaggtgccagcaggtttctcagggctagagtctgtaacaaagagatcctggaaaactggagagaggttggggaggagaggaatggacacagcgtggttctggtcccacagaggtcctattgtctgtaagaatttgatgttggctaaaagagacatcaggagtcactggggagggagaaattatgctgtaatggtcagggaaagtggttagactttttcaaaaacaaacaaaatgtaaaattttacatcttcactttaccctatatagccaacttaaactccaagatagatctaacagtaactctttttgtaaaaaaaaaaaaaaaaaaaaaaaaaagcaagagaaaatagaaaaaaaaatttgtgaaattcagtgtatagaattttctaagattcaatgaaatcactaaagaacatactgacagatttgagttaaactcatatacttcataaaaggtaatcaaaatgtaaagatcattaacctttagaggaatttgcagaaaagaattaacatcttcagtataaggaaaataaacaaattttaaaactgatactataatcgagttctcatattctggcccaagaataggttgcatcagatttagtttcaagtgtagattcctgtcctctgtcaaactcttctgccaagtcttcagcctccaaaggttgggatcctttctcttctctggcagaaggcattcattcatgtgagggtacaaaagaggaaggaatggtatatggttaacaggaaaatggaagtcaataatgtgcaaagaaaaaggacgagatcattttgtatcaaggtatccaaaaaaatgttacagggctgtacatccaaggttcataccaacattattctcagtcaccaaaaggtgtaagcaacccgtgtgtctgtcactggatgaatggataaataaaatatggtttataggtacagtggaatatccttcagccttaaaaacgaaggacaggccaggtacggtggctcatgcctgtaatcccagcactttaggaggccgaggtgggaggatcacttgagatcaggcattcgaggccagcctggccaacatggtgaaaccccgtctctacaaaaaatacaaaaattagccaggcatggtggtgggtgcctgtaatcccagctactcaggaggctgaggcaggagaatcacttgaacccaggaggtggaggttgcagtgagccaagatcgcaccattgtactctagcctgggcaacaagagtgaaactctgtctcaaaaaaaaaaaaaaaaaaaaaaaaaaaggaaggacattctgacccatgctaccacatggatgaatattgaggacactatgctaagtgaaataagccagtcccaaaggacaaacactgcatgattccacctagatgaggtactcagaatagtcaaatccaaagacgggaagtagaatgggagttgcgggggctggagagagggaggaatggagagataccatttaataggaataaagtttaagttttgcaagattgagaagttctggacgtagtttacacaacagtgtgaacagtactgagctgtacacttaaaaatggttaacatggtaaattctgtgttatatgtcttttaccacaatttttaaaaatcaaaaatcctgaaaggtacttcctgtggatgtgcaatgggctttccgcagcattgcttatggcatgagcacagggaaagccttctgcagtatacatcaaggtccttgacaagttcacactctgaatgccgtcattctgcttcggggactcctcccaagggagtaagcccaactcaaggaaaggctttactaaccagcgttgttcatgttagcaaaaagttggaagccaagactcttgaaaagctttgtgtggttaaataaaccctgagcacccactggccagaaacacatgcagctatggaaagtgttgtttctcgagactacagagtgacatgcggaaatgcatataatgttcagtgaaaaagagaataagccaaattatatctacagcatgatctcaactatgcaaaatggtcccatgcccaggaatgaaaacacaaaacattaatagtggttgtctggggtcatgagtccatggaagatttaacatttttgttttttacttgtctgggtcttccgggtttttgaatgagtgagtagtcttattgggaaggtgcatggtagatgggaacacagtcaaaaatgatctttagtgaaggaaaagaaaggaaagcaattgcctgctacaggtagaccctggtggaggaggctgttcagggagtctcacgttagctacatggttcttgcaataaccaaatcaggcagctggtgttgtgctcccattttgaacaggaaaaagtgaggttccagcaggttagataacttgccttgggtttagcaaataaaagtttttggccgggcacggtggctcctgcctgtaatcccagcactttgggaggtcaaggcgggcggatcacgaggtcaggagatcaagaccatcctggctaacacggtgaaaccccgtctctcctaaaaaatacaaaaaattagccgggcgtggtggtgggtgcctgtagtcccagctaatcgggaggctgaggcaggagaatggcgtgaacccgggaggcagagcttgcagtgagctgagatcgcaccactgcgctccagcctgggtgacagagcgagactccatctcaaaaaaaataaaaataaaaataaaaaaagttttgaaagcctccaggaatgggtgtctggccattttgaggcaagaattttcccccatggaactctgcccatccacgtaagaacaggacttgttttacagatgtttgcatctgtcaatgcagggacccctggctagcacagcataccccatttggccccacaaacctgtccttgtctagctagagtggaaagaagggagacaatgagaccacttgtgatggagcactgcaggaagggattcatgcactcacagtggagtcaccgcctctacattgcaagagagatgggaggcactgatccctgccctggtgtcctgcactgttcagagctacaggagaaaaatgagcaaaatcgcaagtatggaccctttctgcctgccccctgcacaggcaccagactcggtaggttagcactagttcctgcaggggcgttcagtgctttctttaaaaaaataaaataaaataaataaaagacaaaaaaacccgctaatggcttgatatgaatttcactcattatcttcccatagcccttaaaacatcattaagtattaaattagcaagctgaacttcctaagaggagcaagaataatttgaactctggattttaattacttatcttataaacttctatcatgtgaggtagagtgaagagccctgtctacacccctgtggactttcaaagcagctatttaagatttcataagactatccattgtgactacagtgaataaattgtggtcaagggagtgtatcgatcaaacaccagaaggctcctctcagcttctgtcgcaatcttgcacaggagagaactagacctaaacaggaggaagagttgataagcagtaagcgaacgaatcttggttctgaaaagaacagcatcatatgtaaatttcaatttacatttattagaatttgctcagtaaattgtgctctacgatggagtcaaggccagattgggctctatttccacaaccccctaaggagtagctcaccagtgtcctaagtggctgtttcctgggtgaacatagtacatatttgctgtcacgctgggaataccagtgagaatctcatgcatggacagaggacatgatcatctttatgtttgtaacctcgggcctggaacagtctccttttgtgttcacttgattctgaaaggtcagtgttttagaacaggcttttcacatggttcaccaggaggccagttagatcctgtagtgaaagggcaaactcatggcacccttctgcttctcaaggcaggatgctgcaggggcagtgaggtaagacggtggacacgtggaggagaacaaaggggagccccaggggcatctgcagccaggtggagccgttcagccttctggcacacatctgttggctgggtggaggtatgagggcgcagatctgaaaaccaagtggtgacctagggagggaacaagcgctgtgcagcattgatgaaacttaaaagatgaagtcctggtccgggcacggtggctcacttctgtaattccaacactttgggaggccgaggcaggaagatggcttcagcccacgacaaaaaaaaaaaaaaaaacacaaaaaattagcagggcgtggtgacatgtgcctctagtctcagttactcgggaggctgaggttgggagatcagttgagcctgggaggtcaaggctgcagtgagcagagattgcaccactgcactccagcctcgacaacaggcttttggacatagcctgcctcaacaaaaaaaaaaaaaaaaaaaaaaaaagatggagtcctgcctttgagtctggctggtgacctctctgtggcgtggcatgtagccttagagacgggctcctaggcatggagtgggaggacatggccatgggccggagttgtgggagtggctgaaacccaagcctaagtggcttaaggaagtgagagcaactactgggaaggaagtggagtaggtggctgaatccaagcaagagagagagacctcaaccagggcctcagggcatggaactagggtgtttctttgccttttcatgaccccatcctgagacagactatgactctagatctctatgatagggagagacctagactctaccccagcaaccccaggggaaagagaaagcattttccccccagcttttatacatcagtcctagggaaagattctaattggccttgcctggtcacaaggcccttctcttggactccagcattagcctgaattatgattaggaggccagggtcaggtgctcaccctgcgagtgaggtgacaagtactgtgagtgacaaccttgttaaaactgtatggcaggaatccacaggaaataaatgcaggccaaaataactgaagccccacaaagggagtacactccaaacctgctgcttcgtttggtgatacccattgttggtacgtgcattcacctgtctctacagctgtgcacagtgtggctattgagacgctgaaatgttgagtgctggaccctgaaacgctgtgtgagatgtgctgtcagtgtaaagtgcatactggatttaaaagatttagtaggaaaaacgaatgcaagctctgctattattttttaatattgattatatgttgaaataacattttgtgtatgttaggtgaaataaagtgtattttcaaaattatactcacccatatagctttacttgtaaaaatgtggcttgtaggcatttgaaattacatatgtgactcatattatatttctcttcacaccgctgttctagactgtgttcatatttctaccttgggggtattaatccttaagtcactatccactgggtcattaattttgttttccttgacattatttcctcagacttcaatgtgcacccctgtttgagtgttgggggtttcagtgagtcattgtttgcccttcgtgattcctagacaattctcctaacttgcttagcctgtctcacgaaggcctcgaccgcgggtagagctggaaccacctgagattcgaggggaaaagagtgagtgataggtgtcacaacttttggaatctcattcttggatcctatttgtgaaggtttgcatgtctccatgaaaagcactagcattccgagttgcttgtctgtgttcttacacattttgtttttacctcattgttgacccatcatgcatttattccacaatccagatgtgagaaagcacttcagagcctaatcaaaatggcagctctttgccctcttgttgctctcatgtttatctccctccattcagccttctgtctgtccttccatccattcttttatcaagttgtgacagcccctagtatgagccaggcatagggccgaattcagcagtgaggcaaccaggcccattccccaaactcacagggctagcagatggtagcaccagcttcagctttgctgcatgtctgatgaatcactggctcttgaccaactttccccaaaactcttggaggaaaagtgcacaatgcctagtacagagggtctcagcccactcagcttgaatggggaaggttaaggtaagggttggagtccgtactgccttctcccaaggactcctctgagaaataacccctcgaaataacccccctccctccaaacacattctacttatcacatcttccagtaatacattttgattagagggattggagctaagagccctacttaagcaaaattaaggagctttgtctaaaattgacatattgagagaaacccatccaaaaccagaacagaaaaatggatccagctctctctggcaattacaggtaactctccctgtggcatgtaactgcccagtaaaagtcagacaagaccatccattaggatttaagtgtcacgtgtttaattctgcttgctaattagtagcctttcttttcctgaattaaacgtgtggttaattctggttgagaactgtttcgttacatgactatccacattcccgagcacaggctcccaatgctgtctgctttctcacaagcccccggtccttggtgcagatccagttagaggggacctgtgttacctgctggttgggtgtggaaaaagtattctttgataagcatttaaatgttcatttagatctaattggaagtaaattagtaaagactcagggtaaagaaaagaaaatatttttcattcagactttgaaattgatttttcaaaatttgatgtttataaagaaaagaagtggaaataatgctcacagaattcaagccatgcggcacactccgagtgcattgcatctgctttagcagctcggacttcggaagcaatgtagagagaatgtgtgtatgggcggggtgggggcgggggcgggggcatgtgtttagcagaatcataacccctgtgaatcaaaaggaagcacctgtggtgccagggaaggaccaaacatgaaaagagagaggtgtccacgctgcttgcaccctgaccttttcagatgagctatgagtcatttaaaaatttcagagcaggtagtaagacagcacctgggtgaggaagtagggcaggtgatggagagtggtagggcgtgcatttctgccagaattgggagtggctggtgcggcatggataggacaggctgtccaagcacaagcttaagatgttgtcattcctggccgggcacagtggcttacgcctataatcccagcactttgggaggccgaggtgggcggatcacctgagggcaggagttcgagaccagcctggtcaatatggtgaaatcccatctctactaaaaatacaaaaattagccaggcgggcgcctataatcccagctacttgggaggctgaggcaggagaatcacttgaatccaggaggcggaggttgcagtgagccgagatcacgccattgcactccagcctgggcgacaagagtgaaactccttctcaaaaaaaaaaaaaaaaaaagatgttatcattccctgagatcgcccctgagctttcatttgttgaaaacatttgctgagcccttccatatagtagatggcagggacatggaaataaaaagctcagtccttgctctcaaggagctggctaatgagagagcagcccagtggattgtcagtcagtgtggtggctgccctcagatgtggccatggggcttcctgggtccatatttaggaacaggccagagcaggccactgcagtgacttggtaaccattggataggtcactagatatgtgtttcagggagggttctaatcgtgaaaggccactgcctccaagagtgggagcctggccaagtctccgcaaatgggtggcgtgaaaacacgctcctgttaacctgggctgcatgaccacagcaagtgtttctgtgcacccggcgtctgctacagggcaggccacagtttactcttgaacttcgctttccttcagttctcaccaaatgactctttgtcccactgaaacaaccacatgtgtatattttgtgatctgtaacacttggtctctcttatgtctgcttcggagagctcaagctgcctcctggcattgaagaagaagcacattgccttaattttgtgtatttggccattatcagctgtaggcaagttggaaaactggttgtaaaacatcctttaggaatctggaagaaaaagtcagtactcaagagaaggaaatgatgcagctctttataaaacatgattcagtgttaaccagtttgtttgcatgatagtcctagacaaagaggccaggggttaagtcatggaaaagaggtctcgttgcctctcttttgcatcatatcagggactttgctgtaatttctagttccttctcactgtgaaagctacaggccatctgactcagcctctgtcttcagggatgaggatgctatccatattttaaaaccgtgaccagcaagacgtagagaaagaaagtgatttgccaggctggtaggtggtgataatggttagactggaattcgagtctcttgcccttgtctctccctttgtcatctgctttaatgcttaaaaaactgcagagaaaaacaaactccttccagcgtgcactctcacttctattagttactttaatttcctcgctgagcagagaaagcattgtcacactaaagtttttgctgtgagggtctctgtttccagtggtctctgtgttccctttcgttatggggaaggctggcctgatgtggtggggctggaagagttaggggtgctgagcaaggagcaattcagaaggtggcggggagttcccaggactgcacataaaaattaattacagaaaagaaatacatcattaacgtcagatctcacaataggtcccagtgtgactattatgtgaaattaattactccctactttatttttttaatcaccttctccgtactctgaaaatagtcctaattactgacattagttgtttaagtcattaagggtgatcatgttacacgtcagtgtgcacgccccgtcctgtttatttggatttaaatatagcagcccttgccctccatagtgtaattttcctgctcaataagatatttagtaaaactaagtaaggttgcataatcaacgcctcaagaatataagttgttggagtaaaataataaaaacacatgcatttgtctgggcacggtggctcacgcctgtaatcccagcactttgggaggccaaggcaggtggatcacttgaggtcaggagttcaagaccagcctggccaacaaggcgaaaccctgtatctacaaaaaatacaaaattagccgggcatggtaacatgcgcctgtgatcctagctcaggtggctgaaaggcatgagaatcgcctgaacccgagaggcggaggttgcagtgagccgagatcatgctactgcgctccagcctgggtgacagagcgagactccatctcaaaaaaaatagcatgcatttgtgatggaaagaccactgcctccaagagtggaagccaggtcaagtctctgtggtcgagatcttttgttcagtcctttattccagaaaatatgcttcagccctgggaattgaaagtgaggaaaacaagtcaaacccagagctcatagaatagtgggatagatgggcattaaatggataatcacctaaatcagtgtagaatatcaccttgtgatggggagttcggtccagtctaggggacaggggtggcccttcgaggaagtggatggatttgaacttagacctgaatggtgggaagggagtaggaaccagtgacgccaggggagcgagcagagcttttcaggtagagggaacagcatagaaggacaccttgggtggagaggatgggaaatgttccttgaggggtggttagaggtataggtgcagattaccaaggccctggtagttttgccagaagtgcagtgggaaagcggtaagggtgggtgggttggttggttggtgttaactttttatttagaatcatttcaaacttaagagaaaagttgtaagaatagggcaactagcttccttatagcctttgctaagaatgttaacatttgatcacagttgcctatcatgttctgtatttatattactgttttttactaaaccatttgaaggtaagttgcagatatgaggcttaaggacactttcctgtgtatgtatccatgattcagtcatcaaaagaaggcaattaacactgatacagtatttctttctaatgcttggtcccctttggaattccacagattgtcccaataatgtcctctacagattcaggatccaatacaggatcacacgttgcatttcgttgtcttctggtgtttagtttcttccttctgggatggttctctaagtcttcacttgttttttgtgacctagatgttttggaagattacaggtcatttccttcatagaatgaccctcagttggggtttgtcttatgtgttctaatgattagattcagattctgtacttctggcaggaatatcagagtgatgcagtgtatcagacgaccatgctgttgattagtcccatgactggtgatgttaactttgatctcttgattaaggcggtatctgccaggtttctccgctgaactatttttccttttaattattatgttgtgggagatatcctgagactatgtaaatatattgtttctcatcaagcctcacccactagttttagtatccattgatttttcttgcttgaaacattactatggtggttgccaaatggtaagtttctaattcaatcctcccttctacgtgtgttagttggcagtctacttgaaggaggagctttccttctcctccatccattcattctttgtttattctctatatcagtatgggtttgtagatttcttttatttggtggattataattacagtttgggttctcagattgtcccagatttggctggggagagctctttccagctggcttctgacgtgtccgcatcattctttgagctcttctgactttccaggctcattctgtactttccttcctccccactggacttagcatggtttttttttattgtttgttgttgttgtttgtttgtttgttttgttttgtgttttgagacagggtcttgctcttttgcccaagctggagtacagtggctcattgcagcctggaactccagggctcaagcgatcctctcacctcagattccctacaggtacacaccaccacccccagctaattttttttttttttgaagacgaggtctcactttgttgcccaggctggtctcgaacacctggcctcaagggatcctcccatctcagcctcccaaagcactgggattatagctgtgagccaccatgcctggcccagcctggctcttttcgagaagagtgaggcactgaagggttccgagctgctcagtggcctgatctgattggcatttctaacatattactgtgtctacccttgaggagcacattgaagagaagcaggagacaaaccggggagaacacttggaaaactttagggtgtagctcagtctgctggcttgggcttgatattcatagtgcagacagagaatgggatggatttaaggtagattttgaagctggaaccgacagaattgtgatgggtgggatgtcggggagaacagaggtgtccttttctgacaaaagaaacacaaggggaggaggggagccgccttggacagggaagatggaaggttctgattcgggcctgtgcagcttgagagttgtttgtcagccaggcagtcatgtgaggggcaggtgggctcaggggtctgggacacaggaaggaggcctgggctggagatgcatatctgagaagggtgagatttgaccacacacctgggggcctcttctacaggtattgaatcaggctgtcctgggtagaagagtgtgtccttcaactcatattctgccttgttttccctttgcaatgcttggcagatgcttggcattttcacaacagatatgaaagcctttgggcatgttttctgggtctggctgttggtatgtgtatcaagaaaaagaaatgtaaacagattacctctctgcaccatcctatgactaccaacccggtggactggggaagatgtcaacaggaattgtcactttttttgtattaagggatctgtgttaagaaaagaatgtgtgtatatgtatgtatacatatgtatgtctatatgtagtatttaaaatctttgctgtcaaaaaatacattatgtcaaaattaaaattgataaggggtaattaaaaatagattgtggataaagaatttatgatgaggaaactataatcatagcattctcacaacctatcggatgggtaaaaggaaaaaaaagaatacatctcaaagaaagctgtagtcagagctactgctaagtagatgcgtagttcacaaacacagtggttttgttgtctgatcagacctcggaaggggatctggcttctatgcagtaggttcaatcatttctgtagatacagatgttgtttgttttggcatttttggtaatgtttacttgagggttggttggggttttttttgcctctaaatcagaaacagctgatattcatcgggctgtatttaacttctgcttttgtctgaaaagcaaagttggagggtttcattgcctcgtagcttaatttttatttcaaatcaagggctggtattaaccatagcttggcagtgcagaaggctgtggtcaggtctggaggtcagggcatggtgatccagcggctgcctgacagtcactgcccagagcttcccttaccataaccttcctcagtagactagaaaaggttttcaggtttgcccaggttatccacacgtaccatggcatagtttctccagcaagtcagcacactgccgttcctttttcacacctgaaacacgcattgggcctggcttttgcatatagtttggctttagattctatgtggaaaggggcagacagtgctccacttcctgttgatgagctcttccttttacgggagttgctcttgtacgcctcccattttgtgtcctccccagaccagacatggcagtgagggggacgtatgtgagtgaccctcttcttaccctgccttttggcagcattaataacagctatgtatggagctgttagtgaaatggtgttgtcgggtcaggaaggagtaagctctgccttgctataaggtcgtgaggaaggatgtatcttcacttccgtgtcaagagccttagcccgtgcacagcagtgccaccatggcagtcacctatcctcttggttaatctgatgcctctgaaagcctactttgaaacaacagcccgaccttctcactgtctaaaataagagctagagcagaaggggctagtctaccgctagtagcacttagcacaatgacccaagtgctggagcatctcacacaggtgtaggagttggatgctcagccacactggttccattcaagcaaaagagggccatggctgctagactctgcttcctcttccctgctttgatggtgggttgcttggttgattagttggttggttggtttgatgggaaccccatgcagttacctatgagccctttcctgagttgctatctgtgtgttagagaaagagatcctggcagatagaaagatgtgcatatcagtggccacacagtccgtgggcccacagatctgtgccccatgtttggaggagtggttgcttttttcaacatcctagagggatgtgaagcccagcttgagcgtctcatggggaattatatctaatgggtcagaatggcatgagaatgactctaaatagcttttctttctttcttcctgctagtctaaacacaggaatgagaaataaatgctaacgagttgcatccttaaatacagttggaccattttcacgcaatggtgaagacatgtttttttgtgcaaatattttatatctttgccattttgaccattcttattttagtttcttccatctgtgagctctaatgtatatatgtatataatttatatagccctccttgcattccactttgtagtgtgaggattgctgcagatctccttctctctctctcatggacagtgtcctccatcagtataagcttttgacctaaagcacaccttaatttgtcacgctgccaaatccaagccaaacacaactcagcacttagaaattgtctgaaatgtgaatgaaaatatttctatcatatcgagactgggctaattgtgaaagcattatgccgagatgtcatgaagatgggatgtgtagtgagctatcagtagctagatgcttggtgggaatttggttgacttacatgattatgaattagcatcctatttctctgtgagttattcataattcagagcccatgtgggataccttttatcttttcggcttgttgatttgtatgttggttttgtagaggaagagtgctcatctgaatgtcagaaaaacattttgtggttattgttttagttgtttaccaaattaccttaagttctagactgagtagtccatcaggataaaatattagtatatttaaattgctcacaaatttccctgatctcttccaaaactgtgtgatataataatattcggatataaataaagcctctcccgcatttaatggtgctgggttcagcattaagtttccatacgattagccaacaactccttggaataaaaagtccacgagaaccttaccttgggacacgtgggaagtgtcttccttgaaactctggagccatttctgaggcaccaaggaacatggcattgaaaaatggttgacaagtcttttatattgcttgaacatctacataacaaagaaaaaatggggcacaacacccccttagtctttaaagtgactgttaagtatttctggtaagtgtcaacatttgtaaccaaggatttatgttgaaaatttagagcagcagttcccaaacttgttgatttcaggcttcttttacattcttcagaattattgagaatcccaaagaggttttgtttatgtgggtttatctatgagtatttatcaccttataaatgaaaactgagaacatttaaaaatgtttattaattcatttaaaaataataagtgcattgcattttaacacaaaaataataactacgtttccccaaacagtataatttagtgagaagagtagcattgttttaatttttgcaaatctcttcaatgtccagcttcacagaaggcaaatatcacgtgccagtgtcctctgggaaactccactgtacatttgtgagaaaatgagattgagaaagacagataatgtcttggctttattatgaaaatagtttagactttatggatccccttaaaatgtcatgagctcccaaggggtcaccagaccacactttgagaactgctaatacagagtaattagttgaactggaatattcttgaacataagaaccctgaactcaactacgaatctgttctctgtccatgaagttgggagtccgtgggaggaagcaggtcgtgctgccgcctgagccagcatgctcctttggatgcatgttcaaccttccctctgtactgggaacgtagcctggactcctgtctgcttgtgtggagctgaggccccacttacctgctatgtgttcttagactactgctgcctgcactgttgacctttcggaagctcacaattcacctggttccctgaccggtgactgctgacatagtctactttgtaggacacctttgctcaagtcgggtaacctggccacaccaatcaccaccatgacttctagttaaaataagaaggtaagctcttaaacactcagaacccttgttgaaaatccaccttctgaccccatttcagagaagaatttggaaagggggcaattccaagtgcctggtgttactgactggatctccaatgcacatgcaggaagtcatgcttccatttaacttggaaactcaaggagctctgtccaggaaggacaactgctgactttgggaacaaggagactcctatttggaccatactctctaagttctggaaggtcacacctgaggcagtactatagatggaaaccttgaactacctcccgctaaaattgttaccagtcccaagtgcttgcctagaccctggccctgatatctctttattcctgtctcttcactgattttgacgccagcctggacccaaccctcagcctgacagcccagggtgacccgcccctcttcagtcaatgttcatgctcagcaattccgtttatgaatggatggtttctctgttgctctggtccctgcagctgtctggccacacactctgcagggccctagctgtgccatcagtgaggcctgaaagattggaagtggagtgagcactgtggcagaggagttgagggggtgatggggagagaacagttgatcagggcaaagcattcttactcatcttctgcatttctccttggatactcctgacacagtttgtcaagagcaggcgactcatgagtcatttgttgactgtgtgattttattcccctccctgtaagaaaaatactagagaagtagagctaagttcacttttgttttatctaccctctttctgcttttcccagcaggctttgctgccatgagcaagcccagatatgtccatcatggcatctttttctttgtccagcagtctcagagttaacctggcatcaggagcacaaaaaagcaacgcagatgttgggtgctttctttccaaaataccatgtctgaacctaaatgtgggatgattaggtcactcacttgccaagtagcatatacatcacaaaatattcagaattattacagtgccacagggaaaggcaaagaacatctagtagtagtgtaggatcttcattcatttattcaaccaatcattcagaagtatttatcaaatgctgttatgcactagatgatacatctgtgaacaaaacaaagattcctgctctcattttactgacattctatccagcaagtaacaaatcaacattctccaagatttggggtgaagtgaatcttttatctaggttctcaatggtcattttaggagttgtagcttctatactctttctaatttgctgtttatttgctcagtccagtgagttgtgtgagcggggaaaacaattcttgttctttggggtgacattaagcacaccattttaaagagagtcatttacaggttagttaatttattttgtagccagtgtaatatttggtcacctgacaaatagctgaatttgaagtggatgctccaaatcccctgttaggaggactgaaacatagtctactgtgacctaaaacagcgtcttcctaaatggtcaatatttgtttgttgcgtgcttgaagagaatgtttattctcccattattgggtataatattccatatttgtccattagatctgtgctgctcaattttatttatcctaattgttgtgttgcctgatatatcacttatgagatatgtcagaaatttatgactatgatagagttgtcagtttttctttgaggtatggtgctttttgctttatataatttgaggctatattattaggtgcatgtaagtttaggattatcttctcttccaagtaagttgaaacttttatctttgttttgtggccctctctgatgtcaaagttatgcttatatgctactaagttatgtttattgccttaaagtctgtctgacattaacagatgtatggtagattccttttgttagtatttacctggtatttgttttttctccttttactctttaagttttctgtttttagatttcagatgtgtttcttgagaacaatgtttgctaggttttaaaacatcctgtgtgatgactcttaaatctttttaactggagagattatatgtttattatgattactaaagtactttttgttttgttttgtttttgttttgtagacaaggtgtcactttgttgctcaggccagtctcacaaactcctgggctcaagtgatcctccctcgtaggtctcccaaagtgctgggactacagacatgagccactgtgctcagctgaagtacttatttatttttaactattttatattatagttggtatttgtcccatttttttctgcctttttttcccctttattacatttttcctctactaattggaacttctgttcaaattaattaattaaatttcaatttaattaatgaaaattttaagttaatttttctcctcccaaatatgaagaccttagaatgatttattacttacatgttactgttatccagtattattttctatgaagcacactatatttcctcacttttttgtcttgcctctcaaaattcccatctgggacaatttccttttgcctcaagggcattatttagatttactttagtgagattttgttagtagcaaacttttttcttcatctaaaatatctctattttatcaattgttgaaagatagttttgcagggtatacaaatctagggtgatggtgatgttctctcagcacattgaagggattcttttcctgttgtctggcttccatggttgctcttgaaagtcctgctgcccatccagttgctgttccttattagataatcagtgttttctctggctgcatttaagatgattcccttgactttggtaatctgcagtgtcatggtgattgtctccaggaatagatacattttaaattattctgcttggggttgttaggcttcctgaatctaagaattggtggttttcataaattttggaaaattttcttttgaatatttcctagaccccattccctcgaatatctcttgctagaacttgagttttgcatgtgttaggtcactgtctgttgattttactctcccttttatattttctgtcttttgtctctgcattctgcaatctggataattccttcagatctgtgttaaactttagtaattctcactctacctgtgtctcagcttctttttaaccaatctattggggtttttaagaaaaattaataaattcttattccagaaattatcttttcttcttttctcaaatttcaaattgcttggtcttcattttctaaaaataatcccttcttccttgctttatttttaagcctcatgtttatatctttaaacatattaaacatacttattttattttatttttttgagatggaatctcattctgcacccagtctggagtgcagtggtgtaatctcagctcgctgcaaccttctcccaggttcaagcgattctcgtgcctcagcctcctgagtagctaggattataggcatgcaccatcacacctggctaatttttgtatttttttttttttgcagagacagggtttcaccctgttggccaggctggtctcaaactcctgacctcaagtgatccacctgcctcggcctcccaaagttttgggattacaggcgtgagccaccatgcttggtctaaacatgcttattttataactgacatatgatcctcaagtatttgaggtcattgtgaatctgattttgttctttgttgtttctgctggatcccatccagggtgacctttttccttgtacatttggtgaaatttgaccaggatcctaatccttggaacttgatctgtgagaattttttgaaggctgggttaaagttacctctgcagaggatttgtgtttgttctgctacacacctgcaggctgtcaacctgaaaccactcgaaatgatctcttaaggattttcaaaccacgcagtgggaatttgggcctgaaccttgtgtgaaggtcagtttgggactaggactatttgggagaggctaactttctccttggcattgaaaaaggcatgttcccttcctgtcccttccgtgtgggcgggtttattcctcatgtccattaatactgagcacatccttcctttgaggtcgagctttacaagcaagggtctcttcttaggcatacccctcccctccaaggatgggcttcatctctggcctcctgccttatccacacaatatcaaaaaggcttgggccggggctcccctcctgtgagcatgctagttcaaccctgttactctcaggaccccacttcctctctgtgtttggccccagcagactcctgacttcttttttttttttttttttttttgagatggagtctcgctctgtcgcccaggctggagtgcagtggcacgatcttggctcactgcaagctctgcctcccgggttcacgccattctcctgcctcagccttctgagtagctgggactacaggtgtctgcgaccacgccaggctaattttttgttttcagagatggggtttcaccgtgttagccaggatggtctcaatctcctgacctggtgatccgcccgccttggcctcccaaagtgctgggattacaggcgtgagccaccgcacctggcccagactcctgactttcatattagctcaacagttattcagaagtttcctattctcttattctttttagctgacttcagtaggaggctgtccagggtatacactgaaaccacatgcagttaataagtgttctgtattgttaaggccaaggggccccatcttttttcttacagggaccaacttctctgcttagttctcaccccacccctcatttttttgagacagggtcttgctctgttgcccaggctggagtgcagtggcacgatcttggctcactgcaacctctgcttcccaggctcaagtgatcctcctacctccacctcccgagtagctgggactatagatgcctgccaccacacctggtgaatttttgtgtttttgtagagatggggttttgccatgttgcccaggctggtctcaaactcaactcaagcaatcctcctgccttggcctcccaaagtactgggattacaggcgtgagtcaccactcccagccttctctgcttagttcctctagctgagggtgatataggcaggtcccttcttcttccatgttgtctgtagttgggcacacacccccaaccagcactatggtgtgaggggctgtgcatgtaccaacagatatgcttgtggcaagcgctgatgcttcagtcccatctaggtgaagattcctgtggggagtcaatgcttcctctcatctctgaattcagctgtgtgccctctagtggcaccttggactttggaccagtcaagtcttttatcattcagaagatcaatgacttttgtgctttcctgttaacgctgttctgacagccttctgccagctagcctgggtgtcccatcacactgccctgggcaacctgttgccttctcttcaatgccatgctctaaggcaggggttggccaaccactgcctgtgggccacatctcacccactcacccacagcttatttttgtaaataaagttttattggaacacagccacacccgttcatattacctttggctactttcccactgtggtagcccatcaaactgaaaatatttaccatatctcactttgcaaagagtttttcagcctggctttaaggtcctgagctaggatgcttgctgcccacctcttcttcttccttgttttttttttttttttttttaaagacagtcttactctgtcacccaggctgaagtgcagtgatgtgatctctgctcactgcaacctctgcctcccagattcaagcgattcttgcaccccagcctcctgagtagctggaattacaggcacatgctgctgtgcttggctaatttttgtatttttggtagagacaaggtttctccgtgttggccaggttggtcttgaactcctggcctcaagtgatctgcccgccttatcctcccaaagtgctaggattacggatgtgagccaccacgcctggcctgcctacttctctcttcttaactcttccctagagcatcctgtatccaggccttcacctcctcattaaccacacttgtcacctcttcagctccagcgttgctccactgaacttttcctgctgtcctcagcttgctcatgatttgccctttgaaacactagaaattcatctctgcatgctgaaagacattgtagtagcttgcccttggaaacccttacttaatttagttagacgcttaaagtctctccactccacatcagggacctcattccactcttcatgggtcttctgttgcagaccctttgggggaaggcagatatcttgactccatccatttacacattcagtccaaatacacatttcaagcagcagatagtcttgggaatgcaacagcaacaacaaacttgtaacacagcaagttaaatagcatttaatggcactagaggagttctccttttgagtcatcagcttgagcagtgaagaattaatttgtactggaaaccatcaccagcaagtgtgttttgtgtaagtgttcaccaatatgctttctgtggctgcaagagcacaggctgttgatggccttgtggtcagaagtgtgcaacctggaatcagactgcttagttgggaatccttgctctgcactgactaaccagtgggcattggcaagtcactctcactgtgcctcagtttcctcatctggacaaaggcaaacatgacaaaatgagataatatattttaaactacttagaaccatgcctgcaacctaggaagccgtcaaatgtaattcattatcataatatattatttaatctttctgactttgtctttcctgctgtaaaatggaaatcataataacaaacttttattttaaggagtaaccatgatagatttaaagcaccaaagcaggagacactgtaggagccaaatacatggtagatagataccattttctggggtttcatttatatttgttctctatctcccttttcctactgaggctatttataaattcctttttcaaaggaaatggtttctagaaacatctagaacctagtggccatcctcagcatggtggatctttggtagcttcttactgcctcactctagagctgaacactggatgagaagcccagaaaagtttggtctcttgtctgctaactctgtttaccaagactcagcatccacctccaggaagtcctccctgatccctaaccccctaccaccttggtgcgtctgtggcatcctgagatcctatttgtcttctggagcagagactggtgtcattcatctgcatatctattgtgactaacagactaagttctagtaagtaccaaagacttcctggttcaatgaatgaataaatgaatgccagttaaaatctatttgaaaactggccaggcgcagtgtctcatgcctgtaaccctagcactttgggaggctggggtgggcagatcacttgaggtcagaagtttgacaccagcctggccaatatcgtgaaacctcatctctactaaaattaaaaaaattagccagaaattgcttgaacccaggaggcggaggttgcagcgagccaagactgtgccactgcactccagcctgggcgacagagcgagacttcatctcaaaaaaaaaaaaaaaaaaaaatacatatatatatatatatatatatatatatatatacacacacacacacacacacacacacacacacacatatatacatacacacatatgtgtatatatatatattttttcaaatatatatatatttgaaaacacacaaggaagctaccttaagaaatttgcagtatgattcattttctcaatacaacaatactgaatctcacaagagcactatatattgtatccctttttttaacctatctccaaatttcacagttaatggaaatatgcccagaaagtaacccccaaagtatatgccaactcagctacatagatagtcctttaaacctctgtattttctcctttacattttgttgaaacaccatttcattttcttatgctctctataaaaatattttgtaactacgatattataaagtgcttactttcatagcaatggagcggggattcatttgtgagtggattaggattgcagtttgagcagggctgctgcacaggtgtaatggatgcacaagtaagctccaaaatcccaaccgctatcatacctgagcatcatacctgccctgttcctccccatcataactgtctgtagctttaaaggcttaaagacagaaatgtcttcccattttggtcaacctgaaaaataagaggggcttctagaagcctttgttcagctggcagttttatatataaccaactcttttttttgttttttgtttttttttgagatggagtcttgctcttgttgcccaggctggagtgcagtggcgtgatctcggctcactgcagccttcaccacctgggttcgagccttctgtgtagctgcctcagccttctgagtagttgggactacaggtgcatgccaccacacctggctaatttttttatctttagtaaagacagggttttaccatgttggccaggctggtctcaaactcatgacctcaagcaatccgcctgcctcggcctcccaaagtatatataaccaactcttaattgttgagcaagtagaggaaagtaatggagtacaacccacatgatggagcagaacaacgattggtcatgtttgattttgccatatgcggagcaccccacattgccttgtacaaggtggaggcatagtctctgctttacccaagaagctgagaattctcatatagcaactaccacttaaaaagataaaaatgggctgggcacggtggctcatgcctgtaatcctagcactttgggaggctgaggaggacagatcacttgaggtcaggagttcgagaccagcctgaccagcatggtgaaaccctgtctctactaaaaatacaaaaattagccaggtgtggtggcgcacacctgtaatcccagctactcaggaggctggggcaggagaaccacttgaacccgggaggcggaggttgcagtgagctgagatcacaccattgcactccagcctgggggacaggagtgaaactccatctcaaaaaaaaagataaaaatgaagtaaacatcagttttctgcaagcgttctcacagccctgcaaaatgtggccaaggcagagaatgcccagaacccggggccgtttcctccaggctgtctcctatcctagaattccaggggctctcatgccaggccccacaccaaggacccaaggagacggatgggccccggtgactgtggtgggcctcatgctggatcatttgtctattaagtttctatttattgaaaatgaatgtggaatccaagacatacaacaggttgatatttttatcatttttaggatgaaaagcttaagcccatgtgctctatccatacaatacagtggaatattactcagccttgaaaaggaaggaaattctgacgcatgctacaacatggatgaaccttatgggcgttatgctaagtgacataagccagtcacagaaggacaaatgctgcatgattccacctacctgagtcacttagagttgtcagattcctagatacaaaaagcagaatggtggttgccaaacgctggggaaagcaggcaatggggagttagtgtttagtgggtgcagtttctgtctgatggttgcacaatagtgcaaatggacttaatgccattgaactgtacatttaaagacagttaaaatggtaaatttttaattatatgtattttaccacaatttttaaaaataaaatttttaaaaattaaaagcttacacacacacacacacacacacacacacacacacacacacacacagcatgtagggatcacacagatgtgagcatgatgccccagtgttggcatgagacagtcgctttccttagctggttcctacacagcgcggctcctggacgcgcagcttgtcgaggcttgaaaggcgcgggcagggctgcctccccttagctttgtagaccgaaggtcgtttactttggcatttttaacaaagatttaaagtttctggaatttgccagcctgcttggtcccgaggcccagattaagcagcatgcacttttttccttaaacgcagaacaatggcagacggcatgaaagctttcccagggttatttttcccttgaagtaacaaaaggggagacggatgaggaaaaaacacccacatggaatcaaataccgcagaaagcaaacttcaagccacgtgatattagcacagaagggaaatgggaggatgggttaaaaccgtgtgaagtgctcagagttctgaagtgagggctcttaagctatttttagcctcaaaaatgctataaatcctgttatcccattacactccagtggatcgaattatttgcttttctctacctttaccactctaatttttttttgtttgagtaaatgagagcaggccttctcagaggcagctgacatcagacagagacttcctttgcggcctctctggttctgttcctctcttccccgtagctggtatttgtagtgacacctgggagccacagatttgcttagcaacctttctccagggtgaacagggtattcacaactcctgaaccaaggcgtgtggctggtatcattttgtggggccagaacgcattgcgtggagaaattcagtgatgacctggtccccacgcctgctgctcagggccccatcaccctcgtgactgtcagtggtgctgcttcccacgtctcctaagagggcttcaggagaacgtagaacgaggtatctgtctcttcctttcggacctggcctttccatttggccatatgtcagaatttccagctgccctaggggcccaggaatctgtattttagttgctttccaaataattctgctgcccagctgtatttggagactatagccttaaatcagtgattccccgtcagtggtgactcatgaagagcttagatgtgggcctggtgtgtggttggtggcaaggggagtctttcagatcccttctgcttgttgctgttggtggcaggagcgtgcatgttatggtggctcaggcctaatcccatctgtttgggcatctcgcctgtctggaaaacaggtcccggagccatgcacaccaagctcctagggaaggcagagagcactccccgactcttaacaaagacatgtggaggtggacgtctgcccttaagcactcagggttcaagaaatgctgcaaagaacaagagctgcagccaccaggagatgcaggtgactcccatggaccagaaaaaggacagaaacatgacagaaaactggtagaagaaccaaagaggtttggcatttcacagggcacctgactctggagcccacagtcaccctcctcggggccctctccatcaacgtcatggatcaagttcctcctgatgaccaagccaccaaagagagctgatggttatgttcagttgactctgctgaggcagtcagggcagtgtgatctcctcctgggaattgctgtatttgaaatgattgaaataggctgggcgcagtggcttatgcctgtaatcccagcacttgggaggctgaggcaggcggatcacgaggtcaggagatcaagaccatcctggctaacacagtgaaaccccgcctctactaaaaatacaaaaaaattagccaggcgtggtggcaggtgcctgtagtcccagctactctggaggctgaggcagaagaatggcatgaacctgggaggcggagcttgcagtgagccgagatcgcgccactagagtgagactccgtctcaaaaaaaaaaaaaaaaaaaaaagaaatggttgaaataagagagctttctggaagagttgcttctaaagattgtttttctttacagttggagccatgcaagcattggccaagcagccttcagcctcccctcccctcaggtgggctcacagccccaagggttttcacgggggaccttgtcacttgagagtatcctgtgagtgtcatagcacccattttacacagcaccatgtgcattttctgatatgtttttgcaccctgtgattactgttccaaccttcattggtcaattgaatatggcgtgactcatcaccgaagcagcttggcttggcatccctcttagggaaccccatcatttggctcaagtgcagccgtgtcttcagccggtgcatcctttttatttcatttcacatactgccttgtaagaatgccaaggaccttctcttgtacaataccagggaccaagtaaaatgaaattatcaaacagtaaacatggctgaaacactacataaaaagtgctggaaacttatagtctggggcctgcagaatttatcagttacgtgtggtatagctaataccagagtgctgttctttgtaggccccgtggacctgccgtgattgcaaaaagtggtgacgagtcagcattcccctatgtccacggaaggttgtttggcagcagctgagacaagcagcctgtgacagaagacagcctccagggaccaggtcagtgcgtgtggccgtgcaaggagcagtggccctggctccagatgctagggaaagctgggcagaaggcaaaaaaatatagaggactgtccgaggagctcgggagggagccaggagtgaggcaagcagcattccctgacatttctgcctaagcaagggctctgcaggccaggaggagactgtcacccacaacggaatgtccttctttggaagcagctgaggacctggaaaaccagcagttcctctttccagcgttggacaaggacatgagaaagacccacagcaacaagctggagaatagctccctctgtgacattgaagcaagaagaaaaggcatggagagatttggctactttgtttgttcttctaaaggaacacctggttttaaccgtcaactgaaatggccgtgtgtggtacattaagttcagtaagaatatacactttcagctatctgctaacagaatcaaggtaactttgcggttttgtttcaaaaaaagttttctaattttggtggcattgattttgtagattctcactgatacccaactataagggagagatgtttacttgtttgaaattcatctgagtccaaataatataacctgggttttaaacgttcaccgctaatttttttaaagacactgtaaattatttaaaagaaaatgccttctggccaggcacggtggttcatgcctgtaatcccagcactttgggaggctgaggcgggtggatcacttgaggtcaggagttcaagaccagcctcgccaacatggtgaaacccccatctctactaaaaatacaaaaattagccaggcatggtggcatacaatgtaatctcagctacttggtaggctgaggcaggagaatcacttgaacctgggaggttgcagtgagcggagatcgcaccactgtgttccagcctgggcgacagagcgagactctgtctcaaaaaaaaagaaaaaaaaaaaaagccttctaaatattttcatgaaggtgcaatagatctccagggcacatgttgctaaacatgaatcatttgcttcattgataattatattttaagataaatgttattgtatttagggtttacaacgtattacgggatatgtatagacaggaaacgggttactatagtgaagcaagttaacatatccatcatgttacagttacttttttgtgtgacaagaggagctaaaaatatacttatttaacaacagttcctaatgcactacaatgttattaactacaatcctcatgttactctagccttgctgaccccccctcacctgctactttgtatcctttgaactctacttcctccttttctctctcccttccttccatccgtcccaaacccctggtaaccactattttcttctcttatctctgtttttttaattccgcatgtaagtgagatcatgcagtatttttctttctgtgtctgacttactttgcttagcataatgtcctccaggcccgaccatgttgtgggaaatggcaggacctcctgattccctttttagagacagtgctcactgtggccaggcctttcttaatatcgtgcttcacactggatatggtgctgtgttctttgcaaaaggatttcacttttttaggttaaaaaacaaccatcaacaagggacaagatgtgtcctagcagccactcaaggagagaggctccgaatcagtggtcaggagagtcagctctggggttggccactggtggcctgcacggctgagggctggtccctccacacagggacaccgggcccacttctgaaaaccacatttcagggtgtctttgacagtcaagaagtggggagcaactgaagatatttggcctgaaatgggggacctctgggggggacaagatcactctgctccaatatctgaaggccaactgcatccctcggatggctttaatttaaaagaattcttttgaaatagaaaataacaagtgttggtgagcatatggagagattggaacactcatacatggctggtaggaatgtaaactggtgcagccgctgtggaaaacagtttggtggctcctcaaaccgttaaaacatagaattaccatatgacccagcagttccactccttggtctatacccaagagaaatgaaaacatatgtccctgcagaaacttatgttaacttatgaacaatgttcacagcagcgttattcataatagccaaaatatggaagcgacccaagcacccatcagtggatgaatgaagaaaatgtggtaccatatgtatatatataggaatattattcagtcttaaagaggaagcaaattctgaaatatgcccgaatgtggagggacctcgaaagcattatgctaaatgaaagacgccatggcaaaaggttgtatagtccctctctgtgaatatccagaaaaagaaaatcccttgagacagggaattgggggaggtgggagtgagagcatagctcagtgggtacaggctgtttctctgaggaaataagaaggttttgaatccagagaaaggtggtagttgcacaacattatgaatgcagtgaacaccactgaattgtacatttttaaatggttaattctatgttatgtgaattttacctcaatttaaacaataatctgagggctgtcattctgtgtgacccctggacatatggcaagaggaaatgagtagaagctccaggagcacagcagggaggagggagagcagtatttttgctcagcaggaaaaactgactcataaatacaactagtaggaaattgaagaggccgcccaagaaagcagcaagtgcaggggactgtagagtgcctgtcgggtgctgcactcaaccccgagagcagcagttctcaccccgaggacacgtgggattcacttggtggcacaagaaagccacacttgggccccaccccagggatgctgacgctgttggcctaaggtgtggactgggcatccggacaaaggcccctggtgtcttagctttaggtggaaacagatgaccttttgtgtccctcccatcctacctcggccccaacagggatttctgttttaatgactgtggtgcctgcgagcctaggatcatcactgttcagtgtgagtggtgtacccacagcatccgcctcacctggaagctggctgggaatgcagcgtctcccctccccacccccgcccagtcagaatccatactttagcaagatcccaggggacctgtgtgcccatctgagtttcagaagtgctgctgggccggggcatgggggctcacccctgtgctcccagcactttgggaggccaaggcaggcagatcacttgaggccaggagtttgagaccaggctggccaacgtggcgaaaccccatctctagtaaaaatacaaaaattagtcaggcgtggtggcaggtgcctgtaatcccagctactcggaaggctgaggcaggagaatcacttgaacccaggaggcggaggttgcggtgagctgagatcacagcactgcactccagcctgggccacagagtgagacttcatctcaaaaaaaaaaaaagtgctgctgtcgatctttatttacaagacacttcgaggtgcttttcctcattttatcttctgaacaatcgctggtttgttcagctgtttgacaggggaggaagtccaggcgcagagggcttcactcactccacatgccacggacagtgctggtctcccacgtgccccattcagggccttctcccccaggtccagggcctgcttcagctctctgtgacacccaccacctccctcatgtgctcgcagtgccctgcccggagcccaggctgggtaattattgggtatgctgaaactgctggggctggggagaccccgtgcctcagcttggagcctgatgccatgggaatcctcaatgcatggctcagcttgtcattagcttttccctttcttttttcattctttgttttgaaataattatagattcaaaggaagtcaccaagaggttcaagttcagtgtacccaccacctggtttcccccagtggcaacatcttaacgtcactatagcacaatatcacccccaggaaggcggcactgccacaggggcctgtagaattgtgtcatttgccacatttgtggatttgcgtaaccaccacccatttctttccttgacttaaaacaaaaaaacaaacagccgggcgcagtggctcatgcctgtaatcccagcactttgggaggccaaggtgggcggatcacaaggtcaggagttcgagaccatcctggctaacacagtgaaaccccatctctactaaaaatacaaaaaaaattagccgggcgtaggtggtgcatgcctgtagtcccagctactcgggaggctgaggcaggagaatggcgtaaaacccgggaggcggaggttgcagtgagccgagatcgcaccactgcgctccagcctgggagacagagcgagactccgtctcaaaacaaacaaacaaacaaaaaacgatggggtccccgaaaacacactttataaagactgatttcctgctggcaggagagagagctgctgtacatcacaaagcaaggcggcccactagagtggtatggtcagcgacctctgccttgcctgggtgaagtgtctctctctctgtctctgtctctctctcacacgcacacatgcacgcacacacatgccatgcactttctctgtggaagacttcaaagtgtttggtggctgttctgagacctgttcctcctcggctgggctaggggaggggcccactccttttacctgtgtttctttttagaggagaaactgacacaaagtcagatagtcttggggatggaagttgctctcatctgtaagaaaaggaaactgacctaaccagcaggtaatcacttgaaatcacttgtgtcccgtgctggaaacagctccacagcagtgtctatgatggattggaacctacacagctagaggaagaatttgcatccagaaaccacaggagcagatgacccacaagtgtagctattttacttctttcatgttaaattccaaataaaaggatgattatctttgaactgaccccagtccaaagtacaaatgcctggctgagatccaccaaggccagatgttgtcatcagtgactgggtttatgccaggctatcggtgaactgggtcagagatggtgcaggcaaggttgctgggtcagggcaggttcacagcccagtcattcctaaccaagaacatcagcacctgactggagggtgggaatgaggttcctgacctgctgactcatttgcagagtggtgtgtcagagccacacacggtagcagcataaacctgaacttcaggtaaccacacgccatgggatgctgcagatttatgtgcccactgcttgcagctgagaggaccagcatgaatggctctaatttgtcaccatggcacagtcacagatggagaatgctctgtcataaccagcgctcccagtctccataggttcttagcacccttccccatccatgtttacctgtacagccacctgtgcaggtcattcttgcccagaatagtacatgagctaaacagccatcttcaggtggttataaaacctcatatttatatgaggtttcatagtttacaaaagttacttcttattccacctaatgaagaaaccacagtccagaaaagtttggtgcctcccccgaggccacctacctggtcagtgatggatcagcaccacagttcccatcttctcattacacctccctactggttaggccccagcccacacagagaagtgtttctgtttcacccctggagagggccctgaagcatcttgtgagtttgtggaaagagaagaggagcagctcttgcttccgtggggagcacagccagactcctgtcttcatgtcctgtcccttaaatgccctccaaaaccgggggcaggtgctcgagagaacttgaccctgattccggattatggggttttctaaactcagtactgtggctgagatctgtggggcattttgcaagctgcttgcttttgtgtgaaacccctatatttgtcagtattttaagtttctgtgaggctgttcttgaattcagttcctttctctttgcctaaatgcaagccacaccctcatctcctcccgttgaccatataagaggtctcaagggcactgaggaacttagcagaaagcaaacagtaccttcagaagattaaaaaaaaattattgcatttgtttttctacaaccaagataagagacagtagataaaggaatgtgtatgtcttgtacagctcactagccccaccatctctgatacggaccagttcttcctgccccttgaataagtatcccttgtcttatcatagtttacatcctgctgtgatgccatgtgacatacatgctctcgcacacacattattaagacttcactccttgtgatcaaggctgagaaagattgtggtggtgttattgttaatataagatttatgacctcaaaatgtttgcaagcttggggtcagagatggagcattcctcagagggagtcagcctggggtccttcttacatagacatgaacatagtttctccagagcaaggcagaatacacagtttaaaccatgggaaggaggaaagactcaaaggagtgatttagtaagagtataggtaaagaagggagaaaatattagtatttctaggagagttagaaggacttagtacttctgccgttttgttttaaaatatatttttttaatatataaagagacatcttggctctccctaacgaaaatggcctaagatcctttatatatatatataatttttttttttttgagacggagtctcactctttcacccaggctagagcgcagtggcacagtcttggctcactgcaagcttcaccttctgggttcacgccattctcctgcctcagcctcccgcgtagctgggactacaggtgcccaccagcacgcccagctaattttttttgtatttttagtagagatggggtttcaccctgttagccaggatggtctctgtctcctgacctcatgatccgcctgcctcggcctcccaaagtgctgggattacaggcgtgagccaccgcgcccagccgatcctttgtattcttaatgaaagagggaatgaattgcaatgaatatgtactgcttctccagaaaacagaaaaatttttaatgtttttatttaaaccagacatatacttttttatttatttccttgttggtttctttttcttccaaataggttgcaaaaatgaaatttctgtttaaatttataacatgcaagagtatatgtgtatgtggccttggaatgattatttagttttgttccaaagatctgatagtttttaaatgaactctataatttagggtactctgggaattgaaaacttcgtgctttatttaggtaaagatatcctgaattgcttacttaagtaagtcaagtaaatggaacgttctttgtgataatgctgttgcattataagaaatgctttgaatcataggtaggactaatgtatagcctatttatttatttatgagatggagtcttgctctgtcacccagactggcatgcaatggtgtgatcttagctcactgcaacctcccccagccaggttcaagtgattcttctgcctcagcctcctgagtagctgggattacaggcacctggctaatttttctatttttagtagagacagcctagccatgttggccaggctggcctcaaactcccgacctcaggtgatctgcctgcctcagcctcccaaagtactgggattacaggcatgagccaccgaacccggctagccaatttattttaacagcatttcactttcaattttgttaaatttggctagacatgtaaaatcatttatttaaaatttaaaaatccaaacttctccctattttgtccagaatttcaaaattgcagtgagttgtggtcgcctggaaaccaggtgtatgatactttgttaagcacactaattggcagcttggagttttgcattgcagaaggctcgttagtgagggtgggtgggaatccacactcctccaattagtgggcccccaagccactcgcacatttaaagtatgattcactttacccaagtttgtttgtcttcagctcttcaggaaaacactgttacacaagccaaggtctcctatccagcaaccttttggatcccgaggtctgcacataaaaggacttgctctgcaggctccctggtagctggtgaatatcttgggaatttaaatatgaagatagttgatgtccatagctaggatctgttatttaaatgtagaagcatttaaatatgcctttggagttgtttttttgcattgtgatagtagccaccacctgagctaacaattcattgagttttatgctgtcccacattctagctgctttaagggattgtgttctcaggtctcacagatggcctgtgaaggggagaaactgaggcagagagggttaggaacttgcctaagctagttaagcaacagtcacgattagaagccaggatctttcaggactgttcccacgttatgcgagagtccttgcctctcttcataaatggtagatttcccatctcctttaatatcctctagatgaattcatgaacaaaggccaagggacaggagaaagagagaaaggaggaagaaatgatgtcagctctttccttcagttcttaaaaatgccaaagacaaaactttcagacaaggtcgtttcctggaagaggtggggtaaacattcccagagtcatgagtttttagatttgaatgtttctaaaatgttgattgacagaaccttctaatacatttgttataaacgtgacataaaggggaaaaatgtccagcattttgaggaagaaagggctctaaatatacataactgcatttgaacagattcctttgcttcctcgttggcctgggctgcaaggccactgtcctcttatgagccctaggaagcaggactggcctcctgaggaccccagcattagcctccaggtttgtgctgggccctcctgagacaaccccaatccagacactagctcctataagtagagcacctgagactcaggggaattccctcaaagcgttccagcttctgagccagagaggccagaagtggaagcctttctgtcggacagctacagcccagactggatgcaggaacagcaggaacagagcagtggcctcctccgtggcatggggccttgtgcccaccaatcctggcaccactgaaccactgactcaagtccgtcctcagctccagtgagcctcttgttattgccagtggctgacggagaggtgaggggagaggacgtcatgcaggcgagctgggaggtagcaccacggtttctcagcagtgttcgtgcaaattatcactataatgcacccgtgcaggcccagcagcctgtgcaagtatcacagcaccatacagacatgaattcatgtgtctttaataacagggaaatggcaatgtgtcaatttacacagttgtttttctgcagttttttctttttctttttttttttttgagccatcttcccaagtgttctctgggttttcctcttacccgggtcccctgtctgccatccacaggctggcatgagccacccaggctgggtctgggatcagccgagggcctgggctggtgccggcaccgcccctctccgcgaacgggccctgcattcgcatcattagttcatcaccatggaagaactgggctgtcaagctgacctacttttcttgtttgcccacagcaggctaagcctgtttagcctcatccagaggggctgggcagagcaagttgctttccgagtcatacagatggcagtcttctgagtgagtgtggttgaatctgtttgccctttttgcccttagtctgcagagttagggcccagcacccaggatggcttgagtccaggtccaagcacaggggcatcctgcaacccatattcagcctctcccgaagagatcctgcattaggatgaattattgcgggaaccaatgccaggcttctttccaaactttaaacacagattcctaaatggaagctcttcatattctatactaagccctaagaacatcagccacttgcagagatgccaggagggtgggacccatgcctgtgcttgaggggtttaccatccagtgggggagggttgtgaacagctaaagccaaggagaagcagaaacagaagaggatagggatgagccgtgggggcggaggaagatgcgctagtagggtagaaagtgttggagagggggacaatgtgatgaggatggggctaaagtcacagactggcagcttgtcatctgagggtttgaatgctacgatatggaaccatgtgaagtgctagtagatgtacatgttatccccccaccccatagttactacctttattctttgctgaaatattgctatattgctgcctgtgaacataggatagtatctgttagagttgttcaggggaaaatagttaagatcagacccagactgtcatgattaaataagctaatgtacaagaaaaccactagccagagcttcatgtgtagtttatctctcaagctcatggattttgtgtgtagcaacatgccttgggtcctgggcctgtgccttctaattctgatgccatgacttctgactcaggcggacatgtcttggactctccttgacaccccgaagccaccacccagagctttggaggaggaatcgggccagtgggtgaattatgccttaactggggccacttctttagacatttgcagaaggaggaactcagtctctttttaaaaagaaaaatatgtacttctcttttctcttgcagtttccccagcattattcagaggcagagtgacagatgtaaggagagggatctaaaacatctttaatatacaacatgaatatctgaatggacattgagaaactggagatttctagtcctgctgaggcaaaacccagatgacctagagatgacataaaagtcagtcatttctacctgtcccattaccggtgatggtaatgtttgtcactcaattaaggcagtagctcttctttagacattcagcaaacatttgttgaatacctgcatgggactctgagtcttggtgttcgaagagggaaaatggaaatactcggccctacattgcctaagcccctcactagggagagctgtaagctcttgggaagggcttgccacggggctttctgtttgttgaggttcaccctgtatccagtggctcttctagcacaggcagagacatgccctttgccgtgtgacattcgaggagacgaccagtttttttccctactgacctatgatccccacatcccagcttctctgcctactggttggtcttcctgacattagttttgttcttgtgtatttgatccatgcacacatttttaccacaccggatatcctgaagttgggctggttggggttttgggagaggcatgtctagggttggttcactctgtggattaggatctagttttatcaaggtggtgggagaaaggcctcaccaggcagcaatcaccaatggatcccaaattcccagctgggcctgcatccaacacaaccaaccagggttttcagacaactcagattttaaaaagaaaagcagcaacctgtcagtttggtgacctagcagatacatctcaatgctttttactttttaattgactttttaaaaatggtgaattaatgccattttccgtatgaatgcatcattgtgtagatttgtgtagatgccttggagacgtcccctgagattgagagcgtggggtgggcatgttcgggggcggggagggatatgtagagcaactagaaggattgaggttttccttgcgtgcacaccctcctcctggcagcgtgcagtggtgagttcctggttcattgggagtgaaatgggcaccctcctgcttctgtgtgcatactgtatgaggtatgtagctttgccagatcttagtgtgacacaccaggatgacagctagcaaggtcacgtctctgagggttgttaggccccagccctggtataatgcctctgcaaggcatgttggtcccctacagtgggccggctgtgtccagggagcaggctgggctcagaggtagtgcgagctctcagctggcctcagggcccagccaaggcccctcatcatctctgactatagggacaggtgggtgcagggaaggggtggcaaacttagtaacgttgatctccttgatagtttctacccctgaatgcacctccacacaaaattgtgcaggccttcccagggaccctagcctacggggaatctcggggcaaggagaggtgcaggtgctctgggcagtaccacaggtgtccctgtaccctcaggtcatcaggcccaaatacagtgaggagccagccactcagagccacttgaggggctccaaatgccccattttctcatgccccagggcctttgaacaaaccattccttctgcttgcatgcctcttccaggctcagctgaattgcatgatacagtgacagtggaaggagtggaggaggatccaacatcacagatactttaacagtgaatatgttaaatctaatacatcataagagagtcccgggtgtgaaggaagagtgctccttgctgctggtgctgtcccatctgctccctgcggggccccttgcagcccgtgagcttgacttggccttggctgagtcagcaggggtggtgggcaggagacccctggctgcacagggagggccagcagtgtgctgtctgcttaaactgtaagtaaaagaagtgaggatggtccaggcgcagtggctcacgcctgtaatcccagcactttgggaggccaaggcgggtggatcatgaggtcaggagatcgagaccatcctggctaacacggtgaaaccccgtctctactaaaaatacaaaaaattagccgggcgtggtggcaggtgcctgtagtcccagctactcgggaggctgaggcaggagaatggcgtgaacccggggggtggagcttgcagtgagccaagattgcgccactgcactccagcctgggcgacagaatgagactccatctcaaaaaaaaaaaaaaagaagtgaggatgacaggagaaggtagatggtgcaacatgagggtgctttctaccaacaaggtgtgcagcattggacacgcatgaccacgtgacctgcagctctgatggtgcaacatgagggtatgtcctaccaacaaggtgtgcagcattggacatacttgaccacgtgacctgcggctctgaaggtcccacctgttctcgttctaaagtcaccatttctgaccgctgtgctgtggaaggggaggcaattaaccagatgaggcgtcccaacagattctcctatcgattgtgaaaagtgggtccacttcagcttacagatgaggtcatcatgcccaggctccaaggccaccacacaagtgaaggcaagagcactgaggacatttcaacctagatctggctagtttccaaactaattctgctgcctcaattagcaattcacatcaaacctcctacgttttgattaaatgttatttgaaactcttgatattaaacccaagattccacagtctaggtgtccaaaactaatttgacttcctgtttcaagggcacctactttttctctccttgcaaacttgagcacagtgaagatgagcatttctggacctgaaggagcatttggggaacagttccatggagggagatgcttgctggagcagtattttgtggattcatttcggcttgtctgtggcagccgaacagcggtttccaacaaaggctttcactgactcagctccaagcatgactcgtaaatctccttttcccctcttgctgatttttctaggcatctattgtccacaccctgaccacacactgtcacccatcagagtccccagttgactcaggtttacactgtgccatccgaactcttgatagagagtccccctaaaaggaacctgaggtgattgcaacataaatgtcaaaggttgcaagaataatatgttgtgttaggatggcccttccatccagatatcatggccgtttctatcttgagaattatttgctgaccaaacgatgttacggtacatttacttaataacaaatttttcaactttcttcatccattccttcactgcatatgtcaccctctctctgaataatgaatcatcagattcttggaaaaaggaaatcatgaaggaggaaccatggttgtaacaggcagataaagcttcagcttggttttttagacactcatggtagcgtttgcgtatggtcacgacgctcatgagagtcttgtcttggtttcttctagccatctggctctatgaggctccagcaagcactgtgagacccggctccttgggacaaggctggagagggctagtgttaggattggatctgtccgccttgccgtttccaggtcagagaatgtgccagaatgcgatgagaactccctagttggaggggaattgggattgcaggagctgccggctctcaggctttcactgtccatctcctttagaaatttattttttattttatttatttatttttgagacagagtctcgctctgtcgcccaggctggaatgcagtggcgtgatctcagctcgttgcggcctttggctcaggttcgagtaattctcctgcctcagcctcttgagtagctgggattacaggcgtgcaccaacacacccggctaattttttgtattttcagtagagacagggtttcaccatgttggccagctggtctagaactcctgacctcaagtgatcctcccacctcagcctcccaaagtgctgggattacaggcatgagccactgtgcttggccttagaaatttatcttttctcactgaatgaatcattgcaacaccaaaagccattccctggagaggaagaatcacaatatggaagttatttcctagcttccccaaatgacaaaggaagataagtgagcgtcgcagttcatcagcaactgttgctcaaaggctttttattccttaacataatgaggaaaaatcattaccaagctcccatgtgtgagatacagacgttaatccaaaacgacatgaggtcccctcaccagggactggctgggaggacagaaggtacacactctgtcagcaataaataaacccccatcaattggggagatgtgtgtgctcggttttgccttttatgattccaacttgttcttgttttctgtatttttttcttttgattaaattctaccaggcttggttggtatggtggggaagagtgttaggattttccagctaacttgggacctgtaattcaaaccagttctcagccaatttcaatacatcatgattttatgtttgtgaaaacataggccttgcaacacaacaggcttggggtagtcatttcagggaaaattcatgatgatacaaagtgacccactgggcctataaagactttacaaaaaattctaaattaaaagacactgaagaggaaagtttagtcatgattccagtgattctttaacatggtttggcaaactgctgtctggggaccaaatctggcccacaacctgttttcgtaaataaagttttattgaaacacagccatgcccactcatttacatgttgtctatggctgcattgcactataatggcagagttgagtggttgcaacaaagactggatgctctgcacctaaaatagttaccaggtggccctttggagaaaagggttgctacctcctgcatgagtggagtaacatgcctttccgtgcgtgctgcatgaggccctctctggagacctgggtgagctgctagtccctgggggagactgtcacttgtatgactcattagtcttctgtctcactgctgacgcacttgggacccagggcggatatgccgtgacaaaataatcctgctgccatttccaggtccccatttgccaggggccagaattctaatcagttgtgtagtaggtggctgtgagaaagaatgttctaaagcctttggggcagaaatttcacctgggtgtgtgaatgtcatttgcaggcttcacttttgtcctttgcttcagttagagtcaacagattttttgagggtctgctgtgtgaaggaaaaccccagtcatttcacctgatagtcattccattcccttctctccttcctcacaacctcacaatggccggttgctttcctgtttagttatgagcggctcagggtcagtgataaccaggtccatgcatgtttgtgtctctccacaaggtcagacttttattgacgtgatttcaatcacaaaagctggaagctccattgagttcccaaggaggaacttccccttactacttcccattcacttaggagtcagagccgcgggcacacaggctcaagccactccacaggtcagtcagtgttgcaaaccatgcataatagtacacttatcaataaataaatgattaaacatttcacaataaatgaagtaacatttaacatcaaaagaaaagggttaatggaccagtccagggagagcaacatgaaaaaaaaaagaatgtcctggcctggtctgggcagtccattggtctcacaaggaagagtctttgatgtgggcagagcattgggcagtggatgctgggtgctgatcacaagcgacagcaagatggagtctgtggggacagccatttctagctggtgaagtactgctcttatggccgcagagtcctctggtgaggactgagtggaggaatgtacttggttatgtccttgttggaagcagtcttcattgattaggcaaaacatccagtcttgttggcaaggtgccttttaaaatgtaagatggagtctttctctaagatggagtttactgtgtcaagggtactgtatacagttatcactagctagtccagtattctagacagcgtatgtgtgtctgtctgtccatcatgcgtacacacacacacatacacattttcaacactggtagaagggaatgattatcctgtttctcccaaagacacttgttgggcttaagtaccagtttctactgtgagccctttaattcatgatcattagtgatagtgtgattaaaattctgcagctacaattttgtgatgacttatttgtgccggggactgtgctgggggcttcccttggactctcttatgctgtctcacagccaaacagtgagaaaagctcttctgttctctcactttgcagttggggagctagggctgggagcatcacacttgtccaaggttatacagagatactgaagggcaaagcctgggtcggtctcagtttgggtcgcctgaccccaggccaccactgcctttctccctttcacagatgtggatgctggacccaggaactctgacacccagtgtgccccagtagctctgcctgccagcagcaggggtggctgtctgccaattcccttaggagttccagccctcctccccgcccctccacactcagtgctccactggccttgcttgattagattccccagctggtctgtttactgggcctggcagagctccttacccccatgcccccactcagtggtcctcacagtcctgtttgcagcagccacaggtagtccctaggggtggggcagactcaggcttcagctggagcccctgcctgcgggtgcctcttggctgtaaggcactcttcctaccaatatggccttttctgtctctgtttaggagcccctctctgaaaccttaggtctgtgtgaccccagagtccatttctgtttcacccctggtgacctccttactgtgcagagaatgtgttcgttgaaattcaaagtagataagaaaggctgaagctcagtgtcacctcccttagcaggggctcagtggccacagtgtgaacagaaggggtaggacagttaggtggggcaggtgtgcaatgaatggaactcacctagagctttctgtgccccaggcatcatgctgggtcctttattgcacacatacctgtgacctgcttcctgtttgcaccttgcacaattgctgcctggtgggtgttagctgcattgtgttaggaatgaggggaacgggctcatgaggtttaaggggcctactcaagatcatagagcaagtaggttggaatggagatttaaatcagactgactctgaagtcggaaaccccctattctgagcagcagtggctggagaaaggcctcctgagtcagtgccaggaggcagagcccagggtctgctctgtccccaagcctgtgtctgtgggcaggccacttagccttgctggggggtggtgctgcctgatttatgagtggaggataactatagccagcccattccacccacagaactgatggagacaaaatgagattatgttttttcagaacttggcagctgccaggggttggtgagggacccattgggccttcctgaagagccctggctgccagtgctgtctgagtggattttccctctagtcagtagctcctgcacatgcagaagtttttgttttaattttagtcaccaggatataactgtcccttcaaatgtactttgtaagcactattaccttggagccaccacgatcatggggaggtttgtgggagtgaatgtcaggtagtggcacaggaattcagatgggggtttggccctggctttgtccttcctttcctccctccctcccttcctcccttccttttcttcttcattcctcatgcatttattgagcacctaatatgggtaaggagcttgtattagtccattctcatgctgctataaaggactgcctgagactgggtactttataaagaaaagaggtttaattgatccacagttcacatggctgaggaggccgcaggaaacttacaatcatggcggaaggggaagcaaacacgtccttcttcacatgatggcaggaaggagaattgctgagcaaaatggggaaaagccccttataaaaccatcagatctcatgagcacccactcctatcatgagaatagcatgagggtaactgcccccatgattcaattacctcccacctggtccctcccaggacacatggggattatgggaactaaattcaagatgagatttcagtggggacacagccaaaccatatcatagctgggcgagccatcgtgaaatgggtgaagatgcaatttgcctaatccttgccatcaaagtagagaacctgtttttgagtgtctgctgcaggccagactttgcaaacttaagttcatttaagtttcaccgctgtcctctgagataggtgtctgtcactcatgttcaaaacctccagtgccttcccgtctcacataaagcaaaagccacaatgcccctctgcccctggctccacctccccctcaccaaagcaatcaccgggctggcctctgggctgttcctcgctttccttgctgtctgggggaggcaccctcactgctcactcccacactcccttcaggtcacagctcacatagcatctcatcaaggaggtcttccaagactccctaaaacatcagaacaagactccccgaaccccgtcccacccaggattcaccttttcctgcactgcagtgataaccaaagaacaggctctgtgtttacttatttgcttgcctgcagttttccccaactcccctgacacatgcatcccccgcctcatgtaagcaccatgagagtagcggctttgctcacagtgggttcccccttgcccaggcactcagggagtatctgttgaatcactgtatatcacatgcagttggcacatttgtgctttggcatatacattctcctgcctcatcacagagcccaagaggagaggcaaatagaaggagatagtacacacggtgcatggatcagagacctgcacattgttagttttcctaaaattgatccccaaattcaattcattctcaatcaaaatcgcatcaagctatcactttttttttttgaggcacagggtttcactctgttgtttaggctggtgctcactgtaaccttgaactccgggctcaagcagtgttcttgcctcatcctcccaagtagctaggaccacaggtatgcaccaccatgacaagctaatttttacttttttgtagagacggaatcttgctgtgttgcccagacgactcgtggcctcaggcaatcctcatgccccaacctcccaaagcaatgatattatgggcatgagccactgcacccagctgcatcaggcatttctatagaaattgacaagctaattctaaaatttatgtggctgtgcaacgacttagaatggccaaggtaaacttgaataagaacaacgttggaaggcccaccctacatttatgtcagtaattactgcacaactttaggagttaagatagtgtggtaccggcataacaatagacaaagggtgtggtggaattgggaaacatggagttagtttgtttaaacaacagaggagttatattttcaagtgaaatgctcaatatatttccagatgaagggcctctaaatgtaaagcaatggctccaattgttaatctgatacaggttcactcattatatatctaagtccaaaagtacaggcaaaaatcatataatttttttcagcgtaataattggatctaccactttaaatttagatgtctttcacctaaaaaaaaaaaaaaacaaacctgaaagttgaaggaaaacacattgtgcatattacatgtaaatgtaactaacatacctcttatgagtgagtttatcgccacttcagtcgggtggccaaggctggcatccacagtgacaagccatgttgacagcatgatgtgataagaaggacactttatttcctgggtcttcctctcaaaaacccgtattctgagcctgactttgagaaaaacatcagacaaacccgaactgaagaacattctacagatactcctcaaaattgtcaaggcctgagaaactcgcagagccaaggggtgtctaaggagatgtgctgacaaagcgtgctggggtgtcctggatagagtgctagagtggaaaacggacgttacgtaaaaactgaggaagtctgagcaagtttgtctgaaaattatggacttcttttttttttttttttttgagacagagtctggctctgtcgcccaagctggagtgcagtggcgtgatcacggtgcactgcaacctctgcctctcaggctcaagcgattctcctgcctcaccctcccaagtagctgggattacaggtgtgtaccatcacatgggctaatttttgtatttttagtagagatggggtttcaccgtgtttcccaggctggtctcgaactcctgacctcagctgatccacctaccttggcttcccaaagtgctgggattacaggtgtgagccactggcacctggcctggacttttcttaataagaaggtatcagtgttgcgacaaatgcaccatactaatgtaaaatgttaataacaggaaactgggtgtggggataagggaactttctctactctctttgcattttctgtaaatctaaagttgttcttaaaaatgcggtttattttttaataagtttatcttatgtgtctttcaccccacagacatcctgattctgtcctgcagaattgagacacataggataaatgaagctaaatatagtccataaataatgcatataagatcacacactatttgatgaaagtgctaatgcaattcaacagggaaataaatgccttttaaacaaactattctggagggatgtccatattgggggcgtggtgggggtggtggtgaataatgtccgagccctatccaacactacacataaaatttaagttgcaatggactgtggatcaaaatgtgaaagctaagtgatgaagcttctagaggaaaacataggataattcttcacgacattgaggtggcaaatatattttagaatacaaaaatcgctaaccataaaataaaaggttgataaattagactttatcaaaatttaaaactgctcatcagaagacaccatccaaaaagcaccaaggccacccacagactgggagaaaatgttcaccattcatattttctgacaaagtacttgtacctggtagagataaacttctatgatcagtatgatgaagactaacagtccaatttttttaagcaggcaaaagaattagacatcttacaaaagaagatatctaaatagccagtgaaaagtgctctgcatcattagtcatcagggaaatgcaaatcccaatgagatatcataacacacccacgtaaattactaaaattaagaaatattacatgttagaatggagccactggaactccttgtacactactggtgcaaatatgaaattgtacgttcactttggaaaacagcctggcagtttttaataaagtaagcatacagctaccccgtgttccaagaatgacactcctagatatatacacccaagaggaacgagtgcttatttccacagagacttctatatgactcaacactggtgatgttaatgttgaccagtaggtgaaagtggtgtctgccaaccttcttccctgtaaaatgtttttcttttgtaattaataaataccttgagagagatactttgaaactctgcaaatatcctgtttctccccaagctttttcacattaattttagcatccatcggtggatcttgcctgcaacaatgattactatggtatgccgatggtgattttcttttcttttcttttcccctcccctcccctcccttctcctcttctcttctcttctttttcctttttgtggagaacagtgcctcactatattccccaggcaggtctcaaactcctgggttcaagctatccttcccactctcccaccctaagggctgggattacaggcatgaagcatgaagcatgatggtgattttctattgccattgttccttctacatttattaattggaatcttctgtaagaggaagctgtctccctccctccttctacctccccatttgtttatttatctgggggctctttgtaaaggtgtgggtggagagtagggaaccaagagggacagtgtggttacctgaggtggggaacgataaaacaaataaataagactcatgagtatttagtttgtggcacaggctataatcaatacggttgtcactcattttgttgctcaggttgttctgggaacccctctcagcctctcctttcatcaggctcccataattattgttactgttgatcatgatttcttgtgtggtcagttgctaggtgcagatgcctggatttcaaactgggggggatgttacaaagcttaaaaagactccggagagtttgtgttctaggaaaacccaagaaacccagaactggaagagccccagagagatgaatgttaccgggcgtgttcccttctctcttccctgacgctcccctgtgcagaggatcctgcagacatggctaaaggagatgcagcaggagatcagagggtgggtggagaatgagagtgtttattcccttggctcccttcttgtcccttcactgaaggccgcctcctatgggacacactccttccaggtttgggaagtaatttccctcttgtcccttccccttacaggtgttcacagctctgccgttccccacctcaggtaaccacactgtccctcttggttccctactccccacccacacctttacaaagagcccccctgtaagtcagcactcctcagaggatcccacccgccttctgctttcctgttgggaccctgattcacacacctcgtgactgtctacgccacgtaggacacatggttatctggggtaaaggctgtacggcatccctccattgttcactctgggggttcatcacctcaaccattatgtctcagctccaaacaaaatctcctctgctttcatttaagctccttttctgttttctggcactctgtgatcaaaataaaaaaaaaagtagatgctcaaaatccttctcactgaaaactttatacggttgagaagagtcattgtcaccccctaaacttctctgtgattcctttaacctgacctcagaggactgcttttcttcccttccatcctgttccttgtttgccttcaagctggttccagatcctattattaagtaaaagggtgactctaaaacgcaaggggggatggacacccacactcaacagcagccgaggtggaagtagcccatgtccatggacagatgaatgggcaagcaaaacactgcgtttccgtgcaatgggatatcactcggccttaaaaaggaaggagagtgtgacccatgcagcaacatggatgaaccctgaggacattacgctgtgtgaaataagccaaatactgtctggttgcacttacatgacagacctggaatagtcaaatttatagagacagaaagtagaagggcagttgcgaagcctggagtgagtagggaatggggacttcttgttgaatgaatagtttatgctttgcaagggcaaagagatctggaatggatggtggtgatggttgcctaacagtatgaatgtgcttaatgccactgagctgggcactcagcagtggttaagatggtaaatttctgaggtgtattttatcacaattttttaagtgaaaaaataacatggtagacaacagaggtgacaaaatagtaaaaatatcagcacggagcttctgtgacaggtgcaatgggaactcagcttagaggccctctcctcacactgggtgcagctcagctgaatggcttagtcgggtcaagtgagaggaacggggcagggaaatgagagggatgctgaagaagaggaaatgggtgtagagcatccaggttttatagattcaggaaatgtctgcgggataaacatacaaatcacagaagatgtggttgataaagaagagctattagtcatttttagatgtttagtttatgactcagcaaccctggtcatccaaacaggatcccaggagctcaggagagtggactgaggagcagcagccagccctcctgtggacaagctctgtccaggggcccctggtaaagaacacagcgtggccgggtccttgctcatgccctggggctttgatcagccaccattctccttggaagcacaggcttggggtagggcatcattcaatgaattgacataaaactttgaacagattccatctggaaaacattaagcacaggcctgtttgcagatgtgttaacgctgactcaattgtaatacaggctttaacttctaagcagcatttcttgctagtccattgtggaatatgcctgctgttgactgcatgggcattatgtgaacaggggctgtggctgcagaattcatctttgctttggctcagacccatgtttgtgtacgtaggtgaccaaaatcacaaaactaaatgagctcagagaaagattgattggctccattgaaaatttttatctgaaactttatatttcaagagtaattggtggtgcatttgcgaagtgctggtttgggagttccgactgaagaccctgtgtgttgagcgtagaagcgggtgggcagtggtgattcagcttctccatggtccccacctttacctcgatcacactttgccctcccagccaccgcagccttcagcctcccactcccacagctggcattggcctcatgagtgccctgagaacggttctgcttgatgtgctgacttggggggcgcaccccagacaggtggggctctgggaaatgtgtgaatgaagaaaggagccagggctatgcagctctgaggggtggagggaacccaggcctgcgtgtggtaggagaggaagctggatctgtgggcctgagaagcatcaagccagtggcctgggagagtagaggctccggtgttgaggaagaacattcctggattgttacgtaatctttcacatctgtgcaccttcgctgtctcaaggagagtaaacgccctaagggaggaactgcggattacactcctttggggctgattcttccaggccacttgtcagaggagcttgtgtggtttgaatggacagataaacactctcctttaggatgtcataggccactggggtcctgcaagcaggagtgaacaaggcccgctgtggtgtcgctaacggatcccaggcaggcactgggaggtgcgtgcgacctaaggcttgagaggaacagatgctgcttcactgagcaggtctggacagcacttctcaaagtgtggtctgaagacccttggggtccttgaggtcaagacattttttcaaaatataattaactcgttatttgctccttttaaaagagctctccttgtctcatgagtgtacacgacataattgttctgacttttccagaagttacttgacatctgatgacttcattgctccgatgcccaatgaaagagtgcctgtgcatttaaacatttctcagccttaacccacatacacagaagtgctttggagacctcagtccattttgagagtgtaaaggggtgccaggaccaacaagtttgagaaccactgggctaagaccaaaatgacaacaacctgaaagacttttaagaaagatgtagaagcagacagtaattatccattctttttaatttttttttttttttttgcaggaaaaactgcatagaaaatctaatggatgaagatgagaaagacagagccaagaggtaagatgcagctgtccccctgctcagcagagctctctggcccccgggggtctgcctggcagaatctcgctggctttcactctgtgcaggtgaggccaccagcaagataggcagctgtaggacacactctctgtgacatattgcagtgctccatgagaaaccttctagagagctcactcagccctgcccctcactgtgaaatgacacattgtctaggactggctgagtggtctgggtttttgtcatgctcctgtgtacccctgttgacactggtcatctttcagggcttctggttactgcttttccaggacagacactgcttgacaagtcaggctgactggagcccagcaggcctggattcaagtcctaactcagttgctggggctctgtctggctttggataataataatgatcattgccacacagtgagcatgcagtcatcacccagcactgtgctaagcacttttgtatacatagattagctcagtttcctcggctgtagattggagatgtcatagacaccttgcgctgtggttgggtcaactaaaaatactaacttggcagctggcatgtgagagccctgataacctgtctatgttgattccttcattggacatgtattgaatgcctactagatatgcagtggaatcataacagtgacattgagagggtcaggaacagttgaatgtcatcagtttcacacgattcacccaagtcggcagttactgtgccatgctctggggaaaaaaacgtgagcaggaagctcctcagtggctcactgcaggtcattcgggtggaggcccagccacgagccttggcagcaggggacatcctctctggagacactcttcattgcaaccccactggaccagcctccttgctgtgatctcacccctttctgcctctgccactgcttgtgtgtggcagggctctccgtcctctgtgacagcctcgtgagcctgcagagctaaagggtttgcccacttcccttcacagaacccactgcttgcttgtcacctgtaaatggtagtgccctcaggtaccacccagctctgtggctgcagggcagctgtcgttccatgtcacctggagaggcagccatgagaaccacaaatccctggccacccccagacctgccagacctgagtctgcaaggcataaggggagtctgggttgttttaaactcccccaatatttcctttaaaaaaatcagggagcagaggaaatggccagaagtgtagacagaacagccttcatcccaggatctgggagatcagcactggggactcttagtactctttacttttgcatatgtttgcaaatttctgcaataaaaattcaaacaggcatcagtgcatagaactccccagcttatcctgaagtgacaagccctttacttggcattgggacccaggtgctttgcaaactgtaggtcacaacctacaagggttgcaaaatccacttgggttccaagcaacaaatgaatagactagattagaccagactagagttccttcctctgggatgttttggtttcctccagcatagctatggatggagcgctggagacagatgtgagctgcattcctggcctgccctgtgctagctgatgaattccaactgacccctcatctctcaaagcctctgttttctcacctgcaatgtaagggtagtagtgtctgtcctgctttcctcactggttattttggaaattagctacaaaatacactgagtagtgctttttaaatattcatcattacatgtgtatgaatatgcagcacactttacagtaatacatttacagggcaatcttttttgtgtgtgatggagtctcaccctgttgcctaggctggagtgtagtggcgcgatcttggctcactgcaacctccctctcccgggttcaagcgcaggccattcttattagaaatgatggaaagaacagcagtggtagccagcattcgctgggtgcccacagtactgagctaagtccttttatgtacgtcatctcatattatcttctcaacattcctttgaagtgtgtatcattcttattcccattttacaggtgagaagactaaagttcaacaaggttgagtacattgtcagagatcagaaagctctaggaagtggcagaatgagaacttcaatacagacttctttaatcttagactctattcttatccccagaccacaagaggcttttcatataagaccaaactcaatctacctggccgactagacaaagagctgcattctggcatgactaaggagttcataggagttttacttttgctgttgtcatctttaatatcaccctccaaaccccttctagtcccatccctgcctctctcctgcaccgcttacctctaaatcaggaagagataaaaatgcatgtttaggctctaccatacgcagaaatcagcaaatatagacatgccaaaaaaaatctgggctaaaagttcctagaaataaatcagtttgtatgcagtttcttttcattcattcccctccccatttgctttgggccataagcatacctcccccacccaaaaacttctctacttggaaatctttgcacagagacctgtgtagtgaggctggggcccacactcctcccttgtactcagatggaaaaaggagtttagaacgtttggtggtacccagaaatagcaaggacgcagtacccctcctaacacttgggaacacacacacacacacacacacacacacacacacccctaagatcgtattcttttcaaagtagtttttatagcagtaacatgggaggcccttcccctaatcccacctggaggcctggcatgaattgtttttactcacccattatttttgatgagattagaaatgtttaacttgagatcaaaactctcattgcctccagaaaacatgctttgtgttaggcaaggctttcgatgctttagggaattcatggtgtatttgggttgtttgatcaagtattccaaacaagggcacggttccactttcttccgtgaatttccatgtaaatccagggagtattaattgagtgtctattgtgtgttcagaactgagtgctctattcttcagggaagacgcaaaaatatagtccttgtactcaagaaggaaacagcttgattgagagatatttgtaatccctagataatgaagttcacagctttttctgtattccagttataagcatgtctttctaattctgatgtgaaacagtgttgtagggtgtgtgtgtgtgcacgtgcatgcgcgtgcatttgtggtcatccaggaagcagtgtggggtagcaggaagtgcgcagggttagaatcagacaggcctggctttgattcttgccaatgtttactgtctgtccttgggcaagtcactaaatctctcttagcctcagtttcttcttctgtcaagtggggtgataatagtagctacttattgcagaaattaaatgtagctgcgtctgatcccctggcacagtgcagtatgcagtgctgatagggaaagctaaaatttgcagagcgctcacagcctgcctggagcattttacatgcagtaattctccaagccttacaacacctcctcacaaaataggttattcttagccccattttacagttgagaaacctgaggctcagggattgcacagccagttggcagcaggcagggattcaaatgcacacatctgtttctaaagtctgggctcctaacagcgtctgtgacattcagtaaatggaagccgctccttttgagtcaccaccttcccaaggggtagagaaaataagttctgataggaattcttgctttccaaagaaagcaattatctaactttgccgtattgcaaaatccagcttactccatttcttgacagaaatgagcacctgttggctaagaagaaactgcttcatattcacctcttcctttaatccagtgttaaatgagtccatgacctcctctctccagtcagctgtgaggttgtttccatagtcccatacctttggttgagagacggagagtagaaggggagtttatggctctgctgcctttgttcatgagaatcaaaagtgtcaggtcagattcgctgattcttggggctcttaatggagtggatgctggttctgaaacatcagctaaacaattttatgattctttgaccctaattcttagtctcaatgtcaataaagtggttcagatgagagggaagagttcaaacataagcaaacaagaagcctacgcatgccattttgcagaagcagatatttcagaaggaaaaggtttagccatttggttatttcttctggtccccctggggtggaggaaaaggatagggtagtttaatgacatggaccaatgaatggctgagaccatcccatctgtatttgttgactaagtgatgtggtgagcaagtggatgttacagatgaggatacatagcattatcctgccctcagagcgctttcaggcaagttagagatgcattcatgaaaataagcataaagaaggaaaagaaaacactttctgcagagtctgttttaggccaagacaggatggagatcgaaatttgtaaactcaaccctttcagccaattgctctttcagggagagtaatgtggcaaagaagagagactgttctcgtttcatttgtaccatttctttggatataaattctgtaggtctgaaagcaaaggtctgcccagaaaggctgtagcccttttggaggactccagccccatgcacacttgcagagtgcccctgcatgcaggcacagtgcagtgagaaccccgggccctcagcattggacagtgggctgatgctcccagctggagcctgtcgtgctaattttgctgtgatttcctttcataggctttggattgggttttacttacatcatcataagctcccacacggggggaaaaaatggcagtaaaacatctctgaggcttcctctttgttttttttttttttatggttaaggcagcagcaggcattgtgagaacgcaggaggtaataggacatgcgattcgtgtatattaccttgtaatttccagatgagtgattctgttctcaaaacaaaggggaaagtagaactgtacttgcaggcagaatgctaattcttcctgtagcccagtaaacgatggaatggaaaaggggcctccctctgctgaggggcttttggcttttaccctgctagcgttctttgattggctcagaggagttgtcagagaagcgtggtgtctggcaggcttagaaacttgggaatgtcttcgttcaaggagatccagaacctctctgggggcatctgaggcaaaaggcagtttactaaagccttttcaataatttcagtaaattttaaattgaaaagagatgatcaggaatgcaccacttgaaaatgctgcctttctttagaaaaggctaaacgtttctttttagaattttggtgacaagttcctaactatcatgttccaattaaatggtgcctgtgttactgttaactaagagtcactatgaaattaggccagcttcccatttgggcccagacactttctgctaactgtggttaagagtaaagctgttctgttgcttctcgggagaatagacagcctcagctgctctcagtcacccccagacgctttgctaagtctctgcaatagttccctaagttctccatgaggtgaggatggtatcagcccttcctgctggggcaacttttctccccacacagccagatgacatcttctttttttttttttttttaagacagagactctgtctcactctgctacccaggctggagtgcaatggcgtgatctcagctcactgcaacctctgcctcctgggttcaagtgattctcctcccacagcctcccaagtagctgggattacaggcgtccaccaccatgtctggctaattttgtatttttagtagagttggggtttcaccatgttggccaggctggtcttgaactcctgacctcaagtgatccacctgtctcagcctcccataatgttgggattacaggcatgagccaccatgcccagcctaatgtcttcttcttacaccaaacttcttgagactctgagcccagtgatgcccccaaaccgcatggcctcagcatgcagggatgctgcctgggctatggaagtgaggggttgtgcacctgtctccagactctaagcctgggcacaggaggggactgcactgaccttatatggaccttgatttatgccgaagttacccaaaatgtattatggagaatattaatcccaggaaatgcccccaaaataattgcggactgtatgtttactgtttctcccttgtggagaattttagggcttctcagcacattaaagatgctaagactgcaattagcaaataaccaaaaatcatacaatcctgcatttaaaaaattatcctgaaaaataaaaacatagtggcaagaaaataacctcctctggccatggtccttcccctttcttcaagtaattcttcatgattttccacagaagacccattgaccaacactatcttaggcaatagatatgtcatctgtattcccattataattatacattttcttatatataaaaaattccaaaacaacatttgaaaaattctgaaatgtttgaagatgtgagcaaagattatttatttattgagacggagttttgctcttattgcccagactagagtgcagtggcgcaatcatggctcactgcaacctccgcttcccaggttcaagcaattctcctgcccggccacaaagatcatttagaatcataccacctggagatagccactgttaatattatagcatattctctgtcagcctttcttatacatttccattcaattttttttttttgagacagagtctagctctgttgcccaggctggagtgcagtggcacaatgtcggctcactgcaacctccacctcccgggttcaagccatcctcctgtctcagccttctgagtagctgggattacatgcatgtaccaccacgccaggctaatttttgtatttttagtggagatggggtttcaccgtgttagccaggctggtctcaaactcctggcctcaagtgatccaccagccttggcctcccaaagtgctgggattacaggtgtgagcaatggcgcccggcttccagtcagttttaataggaatgctcatagatgctctttgttaatgtgcatgaccagctctaatgtattctttaggaaagttcaccttttatggacagcactgtcttcactgagcatcgtgtgctgcagttgcctcttaaaactgtgagcacctatttggtatatttcagttctaccagaaatgtgtgttccttctacaacctcagtcgtaggcactgtggagactacaaaggaagaataaggcctagtcctgatatgccttctagaaaggttcagtttgctccatttatttatttatttatttatttatttatttatttatttattattattattttgctcagtttataaaactcagatttgagaagcctagtgctgcacccttttcagttcctgtcccatcctataatgcagaactagtgaccccaggtaagatatgccagaattccccgtctggaaggaacttgggtatcagtgtgtctttggtttaggcattaactattctgggtttctgttgctatgtaacaaaccaccccaaaatgtgagggattaaagcaatggcattcattttgctcatggatctttgactagggtagggcttggcagggagtgcctgtttcgttccaggtggtatcagccagagtagctcaaagatggtgggtagaaccccctgaagacacgctcactcccacacctttggttgatgttggctttcaaccagcatgtccactggaagtagctttccctatggagatatggcttcctcacaacacgtggttgcattcaagggcgaatgtcacggggaagctctatctcctcttagtacctggctttggaagccaaacattgtcactgctgctgctatctattcatcaggagccagcctccaagtccagcctttattcaagggaaggagaattagaacccatcttttgatgggagagcttcagagaatttaaatgctgtgtgtcagaatcaccatatcaatgtcctcactgttttttaagaggaaactgaggaacgtgtggttgggagtgccttgcttactctctcctggcttaggtgccgaacgaggatgagaactcacatcttctgaagtctgtctagtgctcatctcagccaagccaaattgtctggattctcttcttccctccacctctcttcagctcccggtgggaattgggaacatgaaaataggatgcctcatagaatgcctttagctcctcaccatagagaccctccaagggcaagaagtcactcttcagagagctgcacatctatctgcatacctatttgtacctcttgttcaaataccagctcttcttggcagcaagggagcctgctagtgctcccttcaccagttccgaacatagctttccaacttgattggaaagcatttaatttatgagctttcactccatttggtcaactgtctttgattcagagagcatcttctatattcccccatcaggatgccctatttactcagttaacagaactagacttagtggagccagtttaaaagatggcacccttgggaagaggcaccaggaaaagcatcttagtagcagggaagcctgatagacgttatggatagtttcccaatggataccagagatgcataagctgaagacattgccagccagagcagtccacatatgaaatggattaaaaggaagagcttcctaggaatgatagtttttcccccctcttttctctttttactgccttttatcctcattcctgatccagctcacagatgaggagttccgattcaatggtttttaattttttcccaagggaaacataggacttttggtgatgtataaaatgtacctgcaccactatgcatgcgttcttgtgaatttaaggaagacagagggccaaggacacaaacttgggggtgctcgatgtcattcacctgcatgctcaaagtattcttggcacagggtctctcccagcaggatgggaaatgagcatcttccttcctcctctgtgccacaggcctctcagaaggacctgatccccatcccagctacagccatgcatcttgggcagctgggtgtgaagtccagtcttgcacactaagtgtgcacacctgtatcatctcttcaccaagaaggaggggagagaagcattgagtatggtgtaaataatatgcatttgtcttatgaaatcctctcagagaagcgcctccaagattccacctgtgggagaaacccaaggggtatgggtgtgggtgtgtgtgtgacactttgccttggaaccatggccctctcctgccttgcattatgtggtgactctccttccttcagccttcctgaaataccacagacacagcccctttgtaagagtatggggctactgtgctaggactcgcttggatcctgagctgcaagtacaaccctcctctggattccagagttctagagagctacgcctgaggtgcacatctactctcagagggtagggaagcataggacagtagttttattgggttagtaaaactccatgttgatgtgcaatggcggattccttttgatgcttttttaatgttagctcattccagagtgatacactaataccaagggaagaagggcctgcccagttcgtctgtcattctctttgttctgcaagagctacccagaaatatgtttcttcaagagtctcttataattacagtccagctcaccccatacgcttttctgcaaaaggatcttattaacagcccctgccaccaggcttttatattctctgttcccaccctttgatttctatgggttttttacaaactcattaaaaaatatatgaaaagatatatgagagttttggatcttggtaagatggagttagcctactccgtcctgtccatcacactgaatgcagctgtaaagcgtgagcagaatgcatgaaacagccatttgaggaccctgaagagtaaatagtagggtgcagattggggaagcactaccaaaccagcagcgagttcaccattttttcccctgtaatatctcctagcctagactcaatgcagccccacacccagaagtgggcctctgctgacagagagaggaccaggagctctagtactggcttaaggagcaggaacaaggtctcctaatgctcagattgtgcaaggttaaatctgcccttttttgttttttatttatttccttgcatcccagaagcaatcctccaacagcagcatagcaggagcaacagtggccatcagaatccacatgaaaccttttatgcagaggaaggggaacctctctccagacagagcagctacacttccaagagggtgggatgaaaccctgctgctttcttcccccttgctctctatcttcctactgcttggccccagatgaaagcgcagatgtaggtagtatgaggaagggcaggataaatagagccagctttctggccaacggaacagaaagggagcctgggaaccagaaggtactgggcagatttcagagagggaggtgctcaggaaagtgactctataaagctggttgtgagtttctgagctcacccctgagctgaatctgcatggatctgatcttgagcagcataccatagaccctcaggtctgaacttcagaatagaccaccacccaaggtctatgactggccatgtggaacatattttagtagcactatggatttctcatcagaaaacagggaagccttctgataggggtaaaatattttttaaatgttaaaagaaaagagctattaacccagaattcaacatgcagtgaaaatatccttcaggaatgaaggtaaaatgaagattactctcaaatgaacgaaaacttcctgtcaagagacctgctctgagagaattactaaaggaagtttttcagcagaaaggaaatgacactagatagaaacttggaataggaagaataaaggaagaaaacagaaatggtaaatatttgacaaaaacagcataatctgatagggtatatttagtgtatgtatagatagtacataagacaattgcagcataaaagaggggagaaggtagagggggctatatagagaaaagtttctagattccatttgaaatgataaaatattctaagtggactttgaaaagacaagtttgtatattacagtccctagaattattactaaaagtcatacaaagaaatatggaggggaaaacaatagataaattaaaatggaatactaaaaaatgtttaaataatccaaaagaaagcaggaaaggggaaataaacaataacccaaaacaaagaatgtacaaacagaaagcatgttaaaatagaaaatgtaaatccaaacatatgtgattacattaaatgtaaattgtctaaatatgccaactaaaaaacagattttgttccaatgatttttttcagtaacctaaatacctaaatatatgctgtctacaagacattcaactcaaatatgatgctataggtagagggtaaaagtaaaactatggaaaatgatataccaaacaaacactaattaaagaaagccaaaatggttctattaatatcaaatgaaatagatttcagagcaaagaaatttactaggaataaagagtgacattacgtatgatacaggatcaattcaccaagaacagataatagctctaatatgtatacacctaaaaacaaagcttcaaagtacaggaagcacaacctgaagaagttagatgagtctttaacatgctcctcttagtaatagaactagtagagtaaacttcagcaaggatatagaagaactgaaaaatgccatcaaccaacagaatctgattggtatttatacaacattccactcagcaataacagaatacacatattttcaagtacatattgaacatttaccaagctagaccaaaccctgcttcataaaacaaatgtaaataaattcaaatgaaaaaattagaaacagaaagatagcgggaaaaatatctccacatcttggaaattaaacaacaaactgtgtagtaatccatgggtcaaagagaaagtctcaaggatattagaaaatattttagctaaataaaaatgaacatacatttcaaaattagtgggttgccgctacagcaatgcttagagggaaacttgcaacattaaatgctcttattagaaaaaaaggaaaggtctcaaatcaacaactaatctctaccttaagaaactagaaacagaaaagcaaaataaactcacagcaagaaagatggaaattagatataaacacagaaagtaataaaattagaaacagaaaaacaatatagaaaaatcaactaaactaaaaggtgattttttaaaagattggcaaggcatggtggctcatgcctgtaatcccagcaggttgagaggccaaggtaaggggatcatttgaggtcaggagttcaagaccagcctgatcaacatagtgaaacccccgtctctactaaaaatacaaaaattagccaggcgtggtggcgggcacctgtaattccagctacttgggaggctgaagcaggagaatcacttgaacctgggaggtggaggttgcagtgagccgagatcgtgccattgcacttcagcctgggtgacaagagcgaaactccatctaaaaaaataataaaaataataaaagttcaataaaattggtaagtctatcaagggactgaaaaagacacgatttatcaatagcaggaataagaaggcctatcattagatattcctgagaaattcaaagggccataaggaaatactatgaacaattagagccgcataaaatccaaccacttagatgaaatgggccaattacttaaaaaccacgactaccaaactcacaaaagatgaacgagaaaacctagagtcctataactaagaaattgaatttgtatttgaaaacctgaacaggaaatctccagacccagatgatttcactggtgaattctgccagacattaaaagaagaaatatcaccaattctgttcacactcttccagaaagttgaagataaggaaatactttggagtttattttatgagaccagcattacccaaagacagtatgagaaaggaaatctacagaacagcatttttcataagtgtagatacaaaatttctcaacaaaacattagcaaattatatccaactatatatatttatatatattttaaattacaatcaagtggagcttatctagggaatgcaaggctattcagaattcaaaaatcaatgtaatccgttatgttatgaagttacaaaagaaaaaccacatgattatatcaattgatgcagaaaaagactttggcaaaatgcaacatctattcatgaaataaaaatcaatactgaaattataaatctaaatgtaaaatacgtaaaactgtaaaaccataagaagaaaaaatagaaagtctttgtagtctataaggttaggcaaagagttcctagacctaacaccaaaagtacaactcgtaagagaaaaaattgttaaacctggacctcatcaaaattaaaaactcactctgtaagttactattaagagattgaaaaggcaagctatagtcgggtagaaaatactgacaaatcacatttctgacaaaagacttgtatccagaaaatacaagcaactgtcaaaactcaatagtaaggaaatagacaacccaattttaaaatgggcaaaagatatgaacagatgcttcctcaaagagggtctacagatgtcaaaaaaagtgaaaagatgtccactgccattagccattagatacatgcaaattaaacctctaataatgtaccaccgcaactttcttagattagctaaaatttaaagtactgacaatattaattccctttaaggttgtagaacgctggatcactcatacattgctggtagggaggtaaaatggcatggccactctggaaaacggtttggtagtttcttataaacatatagtttccatatgacccagacgttctagtcctggattctttacttcagaaaaatacaaacacgttcactgaaaaacctgtacaccaatgggcatagtagctgtattcataattacccaaactggaaacaacccacatttcctcaatgggtgaatgcataaaccggctgtggaacacccgtacagtagaaaactactcaccaatgagaaggcacacggtattgacagacacaagttgaataaatctcaaaggcattatgctgggtagaagcagccaggctcaaaaggttacatgctataggattatacttttacgacattcttgaaaagagcatagggatggagaacagaaccgagctggccagagttttgtgggagtggagggcatgagagttttgtagagagctctctctcgtcttgatggtgatgacggttgcatacctttatacatgtgctaaaacgtatagaaccgtgtccccgaagaaaaagtcaggctcactgtgtgttaattttaaggggaaaaaaaacaaaaacaaaaacaaaaaaacgttttaaagcacccaccgtcagcgtcactttttcgaggctaatgaagtttgactgagccttgcttggctctttccctacatcccccgctgggggcggtagggagcagcagcgccgtgctgtgctttggggtggaggagcctcacggacccttcctgtctctactcacttcccctttaagttgggtccctcatcctttcctgaggacccatttcatttcctttccctgtccccactcatccaaaagctcagaccaggttgcttggcctaccattcacgactgcgccgtcggtctccccgtgcctccccaccctatcctttccttctccaattgagcccaactctgctgccaaacttgaccacccagctttcccctgggctgtcctctccacccctgactatgcacccctcaaagccacctcatgttcttgcctctaggggctccgtggctgggctccctccttggtgagcacccttggcgattcgttggaacttctcaccgggcagtattgtattgcaccccctataccagcttctgaggaatgagttccatctcttcctctagacactgagctgcttttagttgagggccaagacctcttcattgccgcctcctccatatcgcttgatggagcgccttgtgcacagaaggtgctaatcagagaatatagaacaaatactcttcctgtctctaattgcccttgtccagagaaccctcaagtcagaagtggaagagggtcctcctgtcaaagggggagggagtggggagatgttagtcaaagggtagaaagcttcagttagacaggaggaatcaggttttgagatctatcacacagcagggtgactgtagttaataataacgtacagtgttgtatatttcaaaattgcaaggagagtaaatgtcaaatgtctcaccacaaataagtgaagtgactgatatggtaattagcttaatttaatcattccatgttgtatatatatatatcaaaacatcacattgtaccccataaacatgtacagtttttaagggtactggaaggtaacctgtgccccacttccctggaggtctgtctgtattgcatttaataactggatgtttgagttccacccatgagtgcctttctgctcaatcccctactatgtgtatccagatagactagttgggctatgtggcccacaatccccatatctcagtaaagctgacgtgctcatcacagagctgctggccccttactataaagtgtcctcacccaaggacccaggctgacagaggcttcacctcccattgccaagggaggtgaatggaaaaaggaatgaaacagattttgcactgactcttcatgcttctccctgggaactgacacatggcacttgtgcgtacgtgttcttggccaagcgaaggggcagggaagcacaatcctgctctctccagaagacaaactggaaatatttggtgaacagcaatcctaacaccacaggtgaccacgacagtgggaaaggccactcctcctaggagctgaagcgaaggtcgcagtcttcccttgatttcccgcagtacccttccccaacggggaacacaaacaccagcctcctgttagtgtgtggcactgtttctctgcacggtgtgcttagtttttgtgctataaactcaagcagccagaattagtcactctcagttctgtgttcccagaacactgggtccgtaggtccataacagatcccgccacagtgatttggagggagctgtaggaagtggcaggagggtgcacggcctcacagcgtgggcactggagccagcctgtggcaccacttcccagacctgtgatggtggtgagttacacagcctctcagtgcctcgctccttccccttggaatggaaatgcaatagtacctgccttaaagggttgccatgagaattgaaggaatgaatggatgtaaagctcttaacatggtgcccgttacatacatagtaagtgcccagcaaatattccttgtgtaaccagacccaaactccccaagatgcccgatgatggacgcttcagaaccagataacttggggtttttgagccccacattcaaaaatcaatatccatgtatatttaaaacacacacataccttcccttcctccctcccttggtctctctcttactctctctttcttaaactcaataagatgatgacaaacagcccaactggaaaataggcagaagatttgaacaaacgcctcacaaaataagatacataaatggccattaagcatgtaaaaagatgttcgacattactagtcactaggaaaatgcaaatccaagccgcagtaaggtaacatttcaacggctaaacatttcaatgcactgtatgtcagtgcagccgtgtcttatcaggttaaacatacgcttagcagatgacccagcaattccatgcctctgtattcacccaagagaaatgaatgcctatatctacacacagatctgtacatgagtgttcagaacggcattattcttattacccctgaactggaaatgaaccagatgttgtggcatattcatacacaggaatgctagtcatcaggaaaaaggaatggggtgttaatatgtgcagcaacatgatgcaactcaaaaatgtcatgctaaatcaaaaagactgtatactctgattccaggtctgttaaattctagaccaggtgaaactacactaccagcagatcagtggttggttgcctgtggctatggctgggggtgggcggatcaatcacaaagacacaggagaaacctctttaggatgaaggaactgttgtttatcttgattttggtggtagttacccaactaatacaccaaactatgcactaaaatggatgaattttattgaatttaaaaaatgccttataactccaaagcctggccaggcatggtggctcatgcctgtaatcccagcacatttgtggaggccgaggctggtggatcacctgaggtcaggagttcgagaccagcctggtcaacatggtgaaaccctgtctctcctaaaaaatacaaaaattagccgggtgtggtggtgcatgcctgtaatcccagcttcttgggacgctgaggcaggagaatcccttgaacccgggaggtggaggttgtagtgagctgagatcgcgtcactgcactccagcctgggcaacaagagtgagactctgtctcaaaaacaaaaacccaaagcctggttgttggggttgttggagtgtctttcaaaaccttcgtcccagtgtctgtgtgtggtggtctcggggcctgccgagaggaccttctttttggaaataaggtcattccaggctcattttctttctcttgcctgatagcagtggaaccagctgacagcgaccagtttccagtggacaccacagtgtgtcccagccggaggcggatggaaacaagcttgtgtctctgtcactaacgataggagccttcgtcggagttgctaccaggccatgttggtcgtcattacacccattgaagacgagaacagagcagtaatgagctgggtgttatcagctcacaaataatttataatgggcaaactaggacaggaacagagctttttttggctaaggaggttgcatgtcactctttaaaatctaggccaaaaaattatttataatgcatagacattcactctgaaagttaaaggattcctttcttctctcccatgtgtttgaacatggtcttttagcctggactagcaacaagactccgcaacatcttgctgccacgcctgcagttagtgtgtgatgtgagagagtgcaggtaaagagagtggctcggcgagggacagggcctttgtagaaggccaagaacagacagggaggaggggagaggcaggaaaagacccctaggtaaagggtagtgaccacacacgttagctgagctttgaagaattgcccaaatgttatcaggaaacagcctaaactgagataggaccggtaaaagatgggttgtgaacatgtgtgttgaaataaaggcaggttgtgtgcaattaggcaggggcaaactgagtggttatggtcctcgtgatgtctagggaaagggttttggaaatacgtccttttgtgtccaagggctgtttattgatactgttacctatagatacttacacctgctccaagggaggtgaatcagaatccagcagcacactctgtcctgaccacacattggccaggagcctcctggtgaaggatttgctcccctgagaaccatgaccccgggcccaaggtgcctggaaaagcagcaatgttttatgggcctggcctctggggcccctgttctctctcagagagttgacttctggaacaagtctgtcttcagtgaactggggaggagtgagccagctttctcagccctggatcaccttcaaatacgtggattgttgatgaagggcctgtggcgtgtcattgaagatggaggcccctcgagtagcactgcttccggacttttcaggagggctttttgcatcacgtgttccttgttcgttgttaattagagcattcctgagagccacgattccctactcaagttcctgaggatctcagggtcctcagaggtgcttgggtggcttgggggaggcccctcctctctaaccaagcagcttccctttgatctctcctataagtgtgcagcacagggtgtcacttatttaaaatagactttattttttggagcatttttaggctcacagacaaactgagtgaaagacacagagcgttcccatatccccctgagccctccctagacacactcagcctcccccattatcagcatcccccaccagagtggtgcattagttatagctgataagcttacactgatacattgttaccattcagagttaacatcaaggcacactcttgtgttgtacattctccaagtctagacaaatgtgttgacacacatccaccagtatggtgtcatacagagtggattcactgccctaaaaatcctctgttcatccctcctaacccctagcaaccactgatctttgtgctgtctctgtagttttgcattttccagaatgtcatatacttgctatcatacagtgtgtagctttttcagactggcttctccaacttagtaatatgtgtttaactttcctccatgtcattttaaaaagtgttcgtctgctcttagcagcttgacagccatggtgcagtacctgtcatacctctgccctgggtctgtacagccctggctgttgtaggcagggtgtgtcttgcctcccccaacagggcgatgagctctttggagcaggggccaggacatatgcactggtggcacacgggatacctggccaccccgtgggccctggaaccaggctgggtgttctggattgaaggggacttggtttgagtcttaggaagggctctccgagcacagccatctcagtcagcagtgtgtcctttgctctctgaaagtgaaagctctatgagatccgaatgagcagcatccggcctcagagctaatctgtcagattttgcgtctgagtcagaacttactggttattaatgctgtctgtctttgtggccaagagtctagcaaaacattttctatcctcctgccttggaaatgtggccagcgtgaccttcctgaaagagttttttgataagatagatgatcacaatagaatgtgctctaatagaaagtgcttttgtttcatcacaaagcctttgtgacgtggaatgttccagtaacctgctcgttttgtgtttacagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatggtaaaggtcacccttctctctgttttttttccaccctgccccgtccatgtggtgatgacttcaccaatctgggctgcctggttggttttgtctccccagccaggcccagccttaccggtcgagggcttcccattgtaaagacactccaccctctatcagcccgtctctggctgggtggggagagggcacacacctcccaattgcattataagccagacgagagaatccaaaacaacctcacaggtagcacccagccgaagcagcgtggcattcacagtgacaacatcttgatcaaaaatccctggaacaagtgtcttttattcaatgctgaacagatgcagtggctgaatactcacttcctgtgggatcagactatgtgggccttttcatccctctctgccactgccctcgaactctttggtcttttgcgctacatcatgaaaaaatacattgaaaagaatttattttcttaatgtcacattcattctgtttttattgagatataatgtttataccataaaattcaccattttaaagtgtagagtgcagtggtcttcagtatattcacaaggtggtgtaaccatcaccactctctaatttcatcatgccaaaaaagaaaccctgtatccattagccatcatttcccattcttccccctccctccagatcctggcaaccacgaatctgttttctgtctccatcaattcccctattctaggcattttatacaagtagaatcatacggtatgtggtctttttgtatctggcttctttcacgtagcatctgtgttttagcatgtgtgagtacttcattccgtttcatggaccaacaatattccattgtatggatatattaatatcatattttgattaaccattcatcagttgatggatatttgggttgtttacaatttttggaaattatgaatgatgctgctgtgaacattcatgtacaaatttttgagttgatatatgttttcacttcttttgtttgtattcctaggaggggaattgctgcattaaatggtagtgtttagctttctgaggaactgccaaactgttttccaaggtggcttgtacctatttatattcccagcagcaatgtatgagggttccaatttctccacatccttggcaacacttattactgtcttcttttattatgactattattaatataatctccctagtgggtatgaagtgatatcttatgtgactttgatttgaatttcccaataactgatcatgttttccttttcgtgatcttttcatgtacttattggctatttgtgtatcttctttggagagatgtccaaatccatggcccctttttaaatcattgatttttctttttatgctggagtggtaagagttctccatgtattctagatactagacccttatctggtatagaattcgaaaatatcttcccccattctgtggattgtctttttacttttcaagtgatactctttgacacacgaaggttttaaattttaatcagttaatgtcaaatttatttttttcttttgactacttgtgcttgaggcattctatctaagaaatcattgcctaatctaaggtaatgaagatttatatctatgttttcttctaaaaggtttataaccttttttctttttttctttctttttttttttttttttgagacagtcttgttctgtcaccaagactggagtgcagcggcgtgatctaggctcactgcaagctccgcctccagggttcacaccattctcctgcctcagcctcctgagtagctgggactagaggtgccaccacacccggctaattttttctatttttagtagagaaggggtttcaccatgttagccaggatagtctcaatctcctgacctcgtgattcacccgccccggcctcccaaagtgctgggattgcaggtgtgagccaccacgcccagcctaaaaggtttataattttaaactgtaggttaagcatagatatttgatccattttgtgttcgtttttgtagatgtcgtaaggtgggctatgaaaattcatccttttgcatgtggatttccagttatcctggcactccattctttttctaactttgtaatactttataaaagtaacacatacagagaatatacaaatcataactgtacagttgaattaattatcacaaagcagacacagccagggaaccaacgacccaggtcaagaaatagaagctccttcctgtcttcctctgctttcccaaaagaaggaacctctgtgctgacttctaaccccataggttgcttttgcctgttggaaccttattcagatggaaccatgaattatacacatgatgtttatgagattcctcccattcttcccatgctattgctagttccctttcattagtgtatagtattccatcacacgatcacctgcatatgccacttgaactcatccttgagctcacatctttctcaaatcattctctctcccttttcctctccttcaaacacttttacctgttagtgtgtggtcacacctaccctgccagtcacccaggatgttacaaaaagtcacagaatagttaagagggctcagaacctattagcaagcaggaagagcagaattcttttttctttaatcatgacaccaaacataataagtcagaaatgtcagaattagtgaggaaataattacagttcttccatgcaggcagtgatgtgtctcttccactgaacattttcctagacaagatgatttcataaaagagggtgcggctgggacatcagaaagtttcattatacttcttagtcttttattatttctttgatgatcatatatacctattaaaaatgtgacagtgatgatatatcctcatattattttttccaaagctgcccaggagagagtaaagaacatgttaattgcttttgttaaaagtcaggaaagaccaatcaagcaggattggaacgaagtgttacagcagtatttgattgccctgataatttaatcaaatggttatatttcctaaataatgatttagccaagtgaaatagcaggttggtttgattgccaagatattttgtgcaaattactcaaactaggtcattgccaccgagaagcaggacagctgttaaataggacagctgggatcaagttcatcagcctgacatttatgccgggctctgtccactgtggaattacagaattgtcaaatctgggccctggaaaggataagtcagcagaaatgcagcctccaaataccgggagagcctgcttcagctcgcctttttcataagatgaaggcctactccgcacaacctgcttaaacacaatgaggatcatgccaggatctcactcatctctgtgatttcatattcaaaataaagcagaaaattcatggtacgttttttggggaagtagagttgttggagcaaaacttggattaaagcaaaaaacaaagcaatcactttcctttacttgcagtccaaatggacatgaactctgcaggcacctgcaacagagtagagaatactgaccgtaagcatctgttcagggcttgctatgagctgggcaatattctaagagctctacctacaggaactcctctacatagagctcctcttcatggcagcactttcttttgggagacagagtcttggtctgtcacccaggctagagtgcagtggtgcaatttcagcttactgcagcctccacctcccaggttcaagcgattctcctgccttagcttcccaagtagctgggattgcagacacgtgccaccacacctggctaattttttgtatttttagtgaagacggggttttgccactttggctagcctggtctcgaactcctggcctcaagtgatctgcccaccttggcctcccaaagtgctgggatcacagacgtgagccactgcacccggcccatggcagcactttgagttagttccattgcacagatgagacacacaaggtcaagtcactcatccaagtcagacagccaggaaaatgtggaatctaagcccagcagcctgtctccagagcccaaccttttagcactacactcaatggctgctccacaaggggtgatctacagggcttcttgtggctatttatatcacagctgcactccagctgttcatgagtgtgtccatttagactgctggttctcaaccttgtgtgcacatttgaatcacctgaagagcttttgaaaaatacatattaccaggtaaccccccacagaccaatatgtcatgatctctaggggtgggaccacaatgggataccagcttgcaagagaagattgttcacttttcaggagttttgcaagccagttgacatcaagttggtagcttgaaatcagccatggtaggcgtatttacaccacagaaaggggcaaacactgcaaatcagggctgtttgttgtagagggtggagagcctttcaccagcagatggctaggtaaggcccaggcatcagcatttttaaggcccccaggtgattccggtgtgcagtgagggttaagaactatgaatttcaacatgcttcctgccgtcatgctaaagggagatcacatgataagtaaggaaagatgattaggtccaagtagttattatttagctctttccccaataatctttcagcattgctattttctcagcttcggaaatgaattttaatcctgaactgtacacttattctctctgaagtaatccaaatcaaaatgagaatctgatcatgattctttgtagcaaaattttgtaacagtagctattataagagagaaatccctaaagtctgtaaatagcaggacatattggacatccttatctacatccatctagatgttctagtgggtcaggctggcctacacattatcctcttcctgagtgagtctaaatgaaattttctcctaacattaaatcccattcctcattcacacttctttaatgtgtctgtcttcatggatggaagatgaggtggggagagctgtagaacaaggagaaatttccctattgaacagggtaatatatacccaggacagctgtggaatttctgctccattttccaggcttttatttgaccacatacatcccaaacatatactgcttattattcagatataccaggagcagtcgggagttgagcactctaggaaatgggtacaagtgatatcagagtagaatttggggggttggctcttaatcacaatgttttcctacaaaaatggctctcaggtggttttgtttcccttgaaatttggaaaccacttttaccataacactgaattttacttcccagtgtaacattttttcctcgattcgagacatcgtatctaacatatttttttaatatgctatgaaatgaaccttaacttccaaggagtctaattcagttgttgaaatacaaagtgaatgagatggctgctttcagtgttattatgctagcgttaacaaaatacccagtcatacagaatgatctaaaaattacttaagttaaagaaatgggtatttcattttccttcaccattaagttgaatggatctctatttaaatgaaatttgggctgccataaagactcttctgctagaaaaacagttagtctatagtttgatcctagtggtcaaaagagtctcacagatgagtgtgcatattggggagaagaggaaaggcatttatggggttaaatattatagcacatcttcagtccctctcttttctaagtggtcgaactgtggcaaccatctgtttgaagaactgggagttgcaccctctcttccttgcctcagccagcaccacagaatggattctggcccacgatgtgcatgtagcacctgcctctgcttcccatgctgcattccaccatgtgcatatgaggcccgacactggacgtttccccacagcgcggccctccctccaggggccctctcagtgtcgttggctgcctgaccatcagcacggtttcctctcctgggtttcttctcctgggtttcttccagtgttctattaccaaaggctcatagcagctcttttctgcccctttaaactcacaaagacaaaaatccaattttgtataacagcagcagcaactcgttctttctgacatctcgaaggaaggagtcttcctggtggagacgagcactgctgggaacattgggttttggaacaagtggaggttcacagggtgatgcgcataactcagctctttttttttttttttttttttgacatggagtcttgctctgtcacccaggctggagtgtggtggtgcgatcttggctcactgcaagctctgcctcctggatttatgccattctcctgcctcagcctcctgaggagctgggactacaggagcccaccaccactcccggctaatattttgtatttttagtagagacggggtttcaccattagccaggatggtctcgatctcctgacctcgtgatctgcccatctcggcctcccaaactgctgggattacaggcgtgagccaccgcgcccggccataactcagctctttacatcttttgttcatgagtagctgctgcattcactaagattcattcattcaaatggcagaatgcattcctcatgcgccacgtaagagagattatcaaaaacacaggcacaaaggagagagccttgaaatctttctcctggcttaaagttgatggattatctgcctggaccatatgcattctccaggaagttgttaaacaggttagttttattctctgagctatgagtcttatgttcttacatttttcctagcaccaaggaaataatctctgaagaaacctcttactacatgaaatggagcaaaatgttggcttaagatggaggataaactgaaggaaaaacaaacatatttgatattacatttgagccacctataattatcttatcagaaataattcaataatagaacaaaacattctttaaaaatgcagaagaactaaaatatttaaggagccccttgtaggccaatgactatttgaatttacaaatcggcataatgtcttcagtacaaggcagttctgtgaaatggataaactatagattaaccccaaaaagttttgagaagagtacattatgtgtatgtgtatagcacgctgtatttcagtaatggaaatgctgaaaaatatggtacattctgtataacacagtgggttattttccacacgcctaaggtgtttctggaatttttaaaatcccaggtctgtgaagtgttttgcttcacctgggccatgaagaagccacttatgaaggtgtcacaccatcccagtgtttgttcctattgccttcataggtggtaactacctaattccaactgttgacgatggagttcgtcatgtagacattcagggccatggtaccacctgcaagggcaggcaccacagccatagagaaggtgggggatgcacctccctaaagcctcattaagggagatgagaacatccgaagctcccagtccttggaaatcagggtaacatatttccttctgctggcttcttaaattaaactacacagaagtttacacaaaattacatagaagtaacatgtgcttcatttgttaattccaatttctaggtgccattgaatataaaggcttatttgtgtctcttttctagaagtctcagcgcaaacggaaatctgtgacattcagcaagactggaagccttcattcctcagtaatgaagaattcacccagctgatgttggaggtgaaatgcactttcaaaatagcttaaacagttgccagttaaaatgtagctacttgttgcagataagtccctgtacccaaaggaaactactgttcttgatcctgggaagacttgactttgaaacagatacctccctgaggctctctgcctgctgttgcctatgggccatgtcaagaagaatcccaaaattgaatgtggtcacgtgttttcactacagtgaccacaggatgagccccttgatggtgtcacaaccagaggacaccttgctggggagccaggaagggtgggttcgaggtaggtagagagaggagaaggacagagggaagatgaatcagcttgcactgtcatttgactcagagagtcttctcttagactgctatgattatacattttttcccttagtagaaacacgttttgaaattaaaaattgtctttttaagatatgctttgaacttgaactcatgttacatccacatggcatacagatatcagccacagggatcccgtgcctccccatccagctcatgtcctttctgtgctgagtgagatgctcatgttcctccctctgggtcagaggccccatactcatctacagggccgtatttgtgaaaacctggctgatctaaatgagtccctttcctcaacatcatgtatttgtatatgggtgaaactcctcaatgcagataagcataagcctctacagaaacaactgccaacgtgctgtggcttctcacctggagataagttttggagtatatggatatggcagtgggtcagagaaagctccaggcatgacatatccacgcccgcaaccaagaggaggcaaactgggacagatgagctcagcaaaaggaagttagacgctggctgtgaccagtggttcctggcagggtgtttggagagtggtttctggggataaatctttctatctcatatcttatgtgcctatataagactgatgtaaacttcaatttacatagattaacttgcagaaaacagaaagtactggagtaagaaaatgccagaatgaagatgtccaaatattatgaaatgtaaacgcattaatgaacatttgcataagatgaaagatacttaaatctacatgtgaactatatttaaagaaaatacagaactttctgcagaagcaatgcatttttaagtatgttaaatttaaagcagcttgtgaaatgttgaattaatgtatcattatgctaatttacataaatcgatttatcttttaattcttatggaaaagtagttaaaacacataaccctatagcagcagcctttttttaagagcctgtagcacaaccttttttttttttcccagttagtttcaaactatcaaaagtatttgaggaaatagggcttttgtaaagttaaaaatgaataaatttcggggctagaagacgggactgagattcaggagactggaatttctagacaaggaagattgatatttgtatagtctttatgcactttcccttgctcccggtgtagactcctagaagccggtggaaaggaaatcatgctagatgaatgaattggatctgaaattaagcctgcacaaccagcaggccttctgggtgaatggcagctgtgagtggtctggaaagtccaccaactagtactgttgaccctgactgtgtcaggcttctcttccaacctgttgctcttcagtagacacagacctagtgctgagtgactggagccttctagcatctcctccctggtggcctgagccccagctgtggttgggggagatggggagctcccacggtgatgtcaccattgtccagtgcaaccttcccatagcatgggtctctctccagctgcccatctctctgttttttttcagagccatttcagagactgtgaagaatccaggtgccatgtcttagtggccaggatgttccctttctaaaatgaggacagagcccaggagataacccatcatgtccctagggaactgctaatgccctccagatgtgactcccgtcttcttccctcttctctctaagaggcacaaaaccagactccaggaggactcacatagctgtgaagtttgaaaaaacaaaattgacctggctgaaaaaacaaaattgacctggctgcagaccagccaagctggtaaagtatcagctggcaaagactgtggctaccagcattggagcagttgcactcaaaaggagccaaagtgcctgtggcctgcggaatagggagcttgtggaatttctgaattttaatcagaaaagcaatctcttctcttagcccagaggttgtcccaaggaacacaagaaatgttccatctgattcaggaatttgcagaaagggaaggtttcgtttccctctaatgtgtggcggttagaaaattctgggccattatggcacctttggaaacaccccagtcaaaatcaccattccatggataggggcacagcactttgcaatcacttgctgttgaatccctttcagatgctactgatgggacttccagaaccacagccagctttcttaaagcaatgactcagtgcagttctcatagagttgatggaaatgccaatgagctgatgaaagttatctcccgtctataaataccttcagctttttaacacccgcttgctttagacattcaggagggacatgggctcactgtgcaagacgatttgcactgcccttgcttttcccagctttccaatctgctttttccagaaaagtctcactgatgtcatcaacagtgcccttaccccttaaaaaaattcacctcctagagggcttcatagatgactttaaaacatttttagaaaaatacctgggaaggaaaagttactgggatgtacttcttcgtttactgtaactcaaatctaacccagcatttctcaatcttgcactatggtcattttggacctggtagttcttcgttgtggggactctcctgcatattacaggatgtttggcagcactagatgccaaagtcacccactccagtggtgacaatcaaaaatgcctccagacattaccaaaattgcccccagttgagaaccactgatgtcatccaagaggacgaggtccatttaagaaacgtacttgaatctgtttttcagtctaaatcctaccagctgtcggtgtaaaataataaatgagtctagtgttaattttcctggtgaaaagaactctttcccctttcggcatggtataaaggtgcccttcatgcactgctcgtggcctcttccgggttcccgctgccatgcacttcagccacaccctcctaatgtgaaagaatgaattgtccacacagattctcagacatcacgtgaccatctagttgagtgcatgcaacatgtttccagagctttctaagcacatatttcactttttttcctaagcagaaaaatgtccagattcggggaagatagtcaaagaaaaagtcagtgaaccgacagtgacaggtttccagtaaaagtctccctgagctattattcccttaaagacttgctttctggagaggtaggcttcatttctagtctcctccccctcactggcacaccctagacagccagttgccactgtgatcctattctctgctgaattatgtcgtctttattttagaaatcaactatcagatacatattgtgaaagcactgcaagcatccacacaaaaataaatcccaataaacaatctaaaaccagcaaaagtggctgggtgcagtggctcacacctgtaatcccagcactttgggaggctgaggcagatggatcacttgaggacaggagttcaagaccagcctggccaataatggtgaaaccctgtctctactaaaaatacaaaaattagctgggcctggtggcatgtgcctgtaatcccagctactcgggacactgaagcaggagaatcgcttgaacctgggaagcagaggtggcagtgagccgagatcatgccactgcactccagcctgggtgacagtgagactccatctcaaaaaaaaaaaaaaaaaaaaaaccatgagcaaaagtgtctgctttatgagaaagcattgcccaccttcaacctattatatcacaagcacccaggacagtgtgcccagcatagagtaggcactcagtagagactttcaaatgcatggatttttcagacattctgaaatgcttacggatccagttgagttacgcaacccccacacccacccagccctgtagagtaatgtgaatgttctttacaaacagttccttcagtgggcatttctcttgtggcaatgaatgtgagcagaggcctgccttggccaacaggcacactttctgtttttaatgcatctgttaggtctgatacctttatcagggcaaatgtttaccattgaactcaaagtgatggcaggggtagggagatgggaaccataaactatggctgatgttttctaatggcaagggtggtatttctgaatcaggctaataatatgcttatcattaaacctacttagggaatttccatggctaaatgttatttgattatgccactaggtcacatttttcactgatcctgtagtgcttttgcaaacacttttcctgggccagacacattttctgtaagaagctgtcctccgtggaaggccaagaagtgccgtgaggttattcatggaaatattctgaggattataaaacaaagccagtgtcctaaaatagtgtcctctgcatcagtgacatgctcctccataaacgcattgctaaggagctttcaaatgttgcattttccacaggcattagatggcttcattatcgcagtgacaacagacggcagcatcatctatgtctctgacagtatcacgcctctccttgggcatttaccggtgagtttccactccaatggcctttaccggttcacgttaccatgtttctgttgagaatcattagatctcagatggaaggtggtgcaggtgtcagggggctgcaggtgagaagagggcggagagtaaaggactgctgagttttggggacaggaccaggccgaggtcaaggtcccaggagccttccaggaaaagggcagatgcaggcgtgtgccatcctggaacaggcaaggcctggagtgggagctgtggctacagattctttttctgggtcagaaatggggactgatgagagagtcacagcactgttagtggagctcagagccatcatggaggctgacagacatccagggtcacctgacagctgatcaagggagaggacaacagatggcttgggttgaaacacggtttggggcttacttgggacatgtctgaggttgcaagtgggtagcaacacttagtggtggtaagggtttggcagcagggccggttcctgggggttgaactgctctgggaagactgatgtcttggaagaccttggggagtgaggagtgtctgggtggaccaggagagggtcggctttgcattccagaagtgcacgatggaagctccaaggtggcagaaggggctgtggtatggtcacaggccctgacagatgtccctccccactctttccctccgttccttcccttcttattccctcctccctccctccctccttccctccctcccccctttcctccctccctccctccctcctctctgcataagccttgctggctctctggtaacccccaacacaggatgaagtgactcatgggtctgcacctggctggtggaggacccaccgttgaggctccctcatgggcatctggccaggcttccatctcctgccacaccattgcctgttcctgttcctaggcggcagcttcgatctgcacacagcatcattgtgaatgacagctgtaccaggagcagcacgtgtgatggacaagaaaaaaacgtcctctctccgctctcctcccagtgagcccagccaaaaccttccccaccacccccgacccctgctcatccatggataggtggccagtttatgtgatgaaaagaggaaggcttgccctggattcacacataggaaagcttgggccaggatgatgctggaggaccgcggttccctctccttagctgcccctgcccagggaacagcgtggccttgttccatgggcagcttccatctgccttggggtgatgagcccagctctgctgatggcccagggctccacatcatcctgggtcatacctttccctggaagccactcccttatcccaccattagtgcaaatgatgctgtgtgcagatcgaagccgctgcctacatttttctttgcattcgctgagcggtggcccacaaaagcattttttatgttgctaagcagatgccttcccagtaggccctaatctaacctaatctgtctcccctttgtgttccagcccatttcctaaaacgagggtgcatcaggctggtggtggggagctggggggctctctcctcttgatagccatcagaagtggctcatcctcactcggcctgaaggaggaagctgagggtgcagctgcaccttgattttcatctctggccaggaagctagtgatggggctgacaccatgaatacagaagtgatccccatcatcaccccagagaagctgggctgatctgagggtgtctgaggacagaagaggagctggggtattctttggagggcgcttgtgttttgtattgaatggcaagggctcggcagtggtaggcactgaccgaaagcaaccacacgtggcctgcttattgacctgggaatgagagacaggagccagaactgtttgggtaaacaggatttgcactgttctgctttatgctcttgtaattatctgatgacccagttgctgtacgtggcagacgggacttagaaagtaagagggaaattcttctgacttgaaattatggagcaatttaggaccactttcataaattattttctaactctacaagggccagaaatgacccgactctaatttatcaatgctggacccacttgaatgcaaactaagactctgtatatatatacccatgcccagacacatacagtgagtcagccctcaactccctggtgcaggtgagcctgggccaggcagtccccaaatttaactgcaatttactttcagctttcattatccagttttcaccaggatcttcctttgcaagtgggtaggcaaaggctgctgaggatggaaacttccctggtgcaatcagcatacagctggttgggcagaggagcggatctgggagtcagacctctatgacttccactatggggaggaagccccaatggcccaggcagtgagaggcacagtggggcttaccccaggggtagctgactgcagaacccaggctggtcaccagtctgctctggtgtctttctggtgcccaggatttgggtcataatttaggaattctgattttggtttggtttacttagatgcatacttaactattaaatatcactccttgtgagcccaggtcctttccacagatgatgcaacatttcaaaacttgtgaggttgtctttccttttgcaattttgttgagagattttacccattaaaccttgggtgactaacactgagcacttacaatgtagcaggcaccattaagagtcactcacatgcgttaatatgtgtaggcgcatagaaccgtgcctggcccagagcgaggctgttttatatttgctctccttatccttatggatcctatgaagtacatagttacccagttcacagatgatgaaactgaggcacagagagattgaataatttacccaaggttccacagccagacagtgaagagctgggatttgaactcaggcactttggctccagagcttggtgcttaaccactcctcagaatcctatacgggacacagtaaagctgaatgttctcagagtgtggggctcagaaagggagaatgaggagctgagaggtggtggtcgctcctcgaggaagaggcggctcttgaggtggaggtcgggacacagggtagtcagggggcaggaggctgtgggccccagcagcaacgcccctcttggtgtcaggccaagcacaggctggcctgctggggtcccctcccatgccccttgtgtgactggggattggagagccattgtaagggggatgagagcagccagaattccttcccacttctcaggctgtggggcttcaagtctctctctgtttccttcacactgccaacatctcagatgtaacagaagctcatgtgatagattttcgtacagcaatttctgatgaaatagcctagaactttctttaccaaattggcagagaaaaaagagaataaaatagctgaaagtgaaagtgattttaagatgagaactggcaggcgcggtggctcacgcctgtaatctctgcactttgggagactgagctgggtggatcacttgaggtcaggagtccaagactagcctaggtaactcagcaacacccgtctctacaaaaaatccaaaaattggtcaggtgtggtggcgcatgcctgtagtcttagctacttgagaggctgaggtgggagaatcgcttgagcctgggaggaggaggttgcagtgagccaagatcacgccactgcacctcagccagggtgacagagtgagacctggctcaaaaaaaaaataacaataataatgagaattgttcagcagtggcagcaccagcacattttggtgtctagaattgacacaggcaaggaacatgagcaagacagacgtgcatacaatggaggccaagggctcacgggagcctctggaatgaaaaccttgcgggagagatccaaggggcatgagtcacgtgccttggacagaatggggaaagagtacggctgaggcagaaccaaatgagagaccaaaagtaggcataatctgtgtttcctgtttgggcttttatttgatgttttgaaagttagcttcctgggttactttctgatttgttcctagatgcagtgttgcctaatgagctggatcgtgctaagctcttaaggcagacatcatatccccagccctgaacatttgccatgtgcctaagtgttcattgaacgagggactgaattcataactggggttatgagcaactgcaagcagcttggcacgggtggggagtgccttggatgtgagaactatgtgcatggataaccctaccttccccaaagaaaacaaggcacaagtgttcataaaactggagaaatctgcaggccagaaaatacttctgtatcatgctggctcgccaggtacaagccccagcgagaagaaaatacaagaccagaatgggatatggagccaagttcctgtggcaggggcacagcaggaggagatcccaggaaaggaaagccaaagcccctggcctgtgttaacacaaaacacagcagcaaggccaaagccatgagacaccttttcaggaagcatccctctgcccttcccaccccaccctgccctcacctgctggaagctcccatctgattgatccacatcattttgtcagaggtgtccctgggtcggagcagagccctgacaggtgcagctgcagcttagagttgatcatggattaaaagattccaggcctctagttagattttttttatgccttttgatttttatataccataaatacagatgtgtgtataaaacatatgttcagtattaaattgaccaagtgaacatacatgcagctgtcactgaggtgagcaaatagaacatggctgggaccacagaagctcctgtctgcccctttttcgtcacacgtccaccttccacttggaggcaaccattttcctgacttttaaggtcattgtttgcttgttttcctttgtagtttcaccaactttgacttcactgctaaactctttagtatcgccttttgtttcaccgtgtataaatggaatcattgaaaatggactcttgtgacttctccttttgctcaacatcgtttgtgcttcgcatctgcctcacactggcagatgtagctgctgtgggctcttcttattgctgggtgtgttccatcgtaggaatgtgctgcaattcctgcattcatcccagttagggattcttggaaggtgcttccatgaacatcctgtagtgtttcctgatgaacgtttgcaagcatccctggaggactgactagatgtagaatggctgggttgagggaagttctgcctccacctttactaagtaacaccagaatgatgccatagtggtggcaccagtctgccctgcaccagcaaggtggagacgtcgcagtgctgtggcatcagaacttggcattgtcagacttcttgtttttgtcagtctggtacatgaaggtgtctcatggagttgtactttgcttttctctcgattaccaatgagattgagtgtctctttatatgtttgtcaaccatttagatttcatcttttccgaattacttgctcaggtatttggacatcctctttgattgggttttttcttgcaattatgagtaggctttctttccgcgatctggacacaagttgtgggcaggtattgttttaattacctctcattcatcccaccctagggtaatgcggatgtctgaagactccacagctgacactggatgaggccaacagcagttaattagtcacagatactcacagcccagatgaggaccacacagggccacagggggctgcacgtgggaaaagagtgaaccagcaggggctatgggaagcaggctgtgcagtaagaagagggtgaggtgacccctggtccccacaggaggacatgattgacatgtttgaataattccacaacctgctactcagggatgagcagaaactgtacctgtccccatgataagagatgggggcttggctgggggacctcatccatgggtctgtgtggggagggaacctgcagttaggccatttgaggcccttccaattttaccagatgccaaggcagcatataatttagaaccttaattttgggccataccacagacgtatgtgttgcaaataccctctctcactttgtggcttacctttcccccttttttagggcattttgatgaacagagattctttctgtataattggtaccttttatatctcaattaattcttactattacaaagtcaaagccattctctacactaccttctgaaagcttaaccatatggccgttagtttgactttgaatctaaactgaatctaagtggatcaaatatgcctccaacttcctggacctttagggagaccaaggccccagtgacttctcttaagccgttcttttctcaaggtgaagtttctccagggctgctcaccattgcctcttctcactgcagccagcacagatctcaagccaaaactgccagagcgcctcagggacactctgggaggaagtgtccatccagcctacttccagctcagcctcagtgtgcttttagtacaggctcatttaacatagctgggtgtccctgcactggtgctgctggttcaaggcccgtcaggcaattaggagagaggactgcccacctccacaggcaggtgaccttcccgatcgtgggactcggctgtaaagacggctgtggatggcacattccctcccttgtctccataattgctattattttaataaacagaactcagctcattcaagggaccgttcaactgccgatgtaattttctcacctgtaagcactagggttaaaaatttcaagttatcattgtttgtgttggttttcagcatgtggaagtagcataatagcaatgtactagcaaatacatgcaagagccaagcacagtctggggccctttctgtgtgttaattcaccatcctcgcaacctcccacatatcatacctgcccctacttgcatccagcgttcgtctttattctgtgcagaacccgtgtcctgatattggccctcggacctgtatcagtaaagttctctcacacaggtgacccggccaggcagccactcagccttgctctctgccacacccaccgtcaggggaagtggcttcagatggagccctccaagaagaggccatggagtcacttagttttcattttcaagtatttgaaatatctttatgaagaaagactactgtcatctgtgaacatgagtcatcttctaaaaaaactagagagaatgggcttaaaataaaaccaggaacatccgaagaaacttggagaaagccagaatgagaaatggtagcatagacgagagaggatcctggtagagtttcgtccataaagataaagaccggtgcgtccgagccagagcctggaagccatgctgagtccttcctttccctcctcctgtcctccgatcagccaccaagctgtgtccactgtcctcacacccaccggaacactgactgcaggcagggaggggctctgcctgcttcccaacgtgtcttccccatgcccaacagcggctggcacatggcggccctcagcaagtattgtttggactacgatattgatgagttgcctgggactctgtctgctcctctccactccttcccctgtctctcttgggaccctggccattgccagcctgacttccagtgctctctccttccagactacaagcaggatctctttaaaatgcacgagcagttctgccacccccttccttcaggttcttcgtggctcctcctggcacagggtcgagccctgactcctccgaggcctctctcatctgggccctgcttccctgtgcaacctcctctgtcatggcttctcgccctccctgttgttcccaccttcctgcagtgctgtcagggtacccaccttatgcctctgtgcatgctgagccccctggctggagcaccttcccaccctgtctggcagacactgtcttgtcccctggctcccactcaaggattcctccctctggaaattgttccccaggagtctcctctaccctttcattgtggaggcagcacaccatccacagtgttctccgggcaccttgttttaatgcctgtcatagtgctggccacgccattctttcagctggtcagttcagtcaccatcctggacatcagggatgtggtggtgaacaaggcactgggccctgctctcctgaagctcctgttggagagagggaggcggaatgctcaactcagcacatagctgtacaggaaaacgttactgtggtgcaggtgcccttgtagtcattctgtaactggtcattcagtgcctaatcgcacttggcatttattgaatgtctgccacgtgctgttttatcagcagtggaggcaggtgagctcatggaaccttcatggtttcctcaccttgcagctgaggaaaatgcagcatggaggggtagaacctgctttcaagcctgggctctgagctctcacgccttgccatgtcacctgatgtcccatcaagggggtcattgtcccctcagagccccttaaatcatcagtgggggtggagggtgtcacctggggctttctcagaggaagtgacttcaaagcagggacctgaaggttgcacagggcttcgttaaacacaaggggagggtgcagcatgttcctgcctgagggaacagcccaggtgaggctcggggagaacagaaggcaaactggaggaaaaaaggctcggaaggattagagaagtgctgggagctgggagaggcagaggctgagctgtgaagagctgtgaaattgtgttgagcagttgaggctttgttcctggagcagtcggaagccaagggacagttgtgacttgatctgttatgaggctcctctgactgctgatggagaacaaattgcacaggcactaaagtggatgtgggaagaccagtttggccaaatcattcccaggcaagagaggatgggggtctggactagggtggaagctggagaaatagaagtgaatggagcagagaatttgagggagaaaaatgggcagtactatggacactgtttggtttgagggtaaggacgagaaggagagaagacaaaggcgccaccagagggtctgggacaggcagatgaccaactgatgatactgttgatggagatgcaaacacaagggttggagatgatatgggtgggaaagaatgccgatgttcaggacatgtattcatctgtggtccccagggagcatctgagtggcagttggaaggctgaggctggaacatgagagagttggctggatattcaaacctgaaagtgtatacagattgtgtttgaagctgtgagagtggatgggtttattgagggaaactgaggaagagagaggtgcctgtctcctcggtccactgtgagctcctacctgcatatccaatatggtagccactagctacatgtggctgtttaaatttcaattcaaattaaatgggccaggcttgatggctcatgcctgtaatcccagcactttgggaggccggggtgggcggatcacctgaggtcaggagttcaagaccagcctggccaacacggtgaaacccgtctctactaaaaatacaaaaaattagccggccatggtggcaaacacctgtagtttcagctacttgggaggctgaggcaggagaatcgcttgaacctggaaggtggaggctggcagtgagccgagatcacaccattgcactccagcctgggcaacaagagcaacactctgtctcaaaaaaaaaaaaacaaattaaaattcagttccttgttcacactagccacgtttcaagtgctcagtaaccatgtggctagtggctcctgttacgggcagcacagattacagaccatttccatcatcacagacagttctattggacagcactcaatctgaactctaccttgtatttattttgtaaccacagtgccaaggcactcagaagaaaacgtgcagttccataacttaaagacctttacgaagtagactggcagccctttgctgccctaagggtcaggaaaggaaccctgtgggctctttggagccatttaaatcaatgattggcctcgcactgggcgtgcacaggggccatgctaccccagccaaaacgcaggagtgtcagcaaacagcacttctcaagcaacaggaggactcagtccttcctacatttgtctgacttcactcttagttccctccttggcccacagacaacagcacatatgcatttgaacaaatacagccctttaggttactatttaaaacaatggagtgataaactgagagtgtccacagaaaatcagatattgaactttccatttcagaaaccagttctgcgttgttgtgaatgttcaatttttgtttttgcttctgtttttcatcttcgttgagggtgtacctttgtcctttattttctttttcagtcggatgtcatggatcagaatttgttaaatttcctcccagaacaagaacattcagaagtttataaaatcctttcttcccatatgcttgtgacggattccccctccccagaatacttaaaatgtaagtttaatttttctggttttacaagctagaaagataagaattttgcttttgaaaggaggttagaatgaattaagaagggagaactaattttaagaataattttcctcatgactcagaacatttccaagatccttagaggtatattttaggtttaaagctaaaactggaatttggaatatgtaagacatttggcttttatgtggaaaatttgaaagcagagaactcaagaataataatttattttgtgtatatgataagatttctctttttttttgcatgagagtcttttagtaagaaacagtgcaaacatcagtgaacaatcagctcatcatggaggatactaagatactaaattcatataatatcaagaaaccaactgaaaacggaataattaggtcaaaaatccaaattctgtcctcctgaggctctcacctggttatttatatacatttttgtgttctgtggaattcagacgtttttatcaaaatatttggcaacctaggtagaaggctaaccttgatgcctcgtgaaccacgggtcacttaatgaagcatacacaattgcatgaggtagcaaagctgcttgcatcagtgcaagcctgtgtccattttccatgaataatctgtcctgtcgtacatctgattttacttcaaagcaaagcaaaaagattaaattaaagggagcagctctatatgagccgctttattttaacataccatatgaaaacagccggaactaatcaatgccaacattaccaaccacagacatctgggagcaaattaagactaattgggtccatgtatggaatgcaaaatatctatgaactatggaaggaaacccctgtgcagcaaggttacaaaccaggcccaaaagtcagtcgtagtgagagaactagcctggccatgtgtagactaaatcccataagagttttcacagagacgctacttgtttagagtctgtgcaatgctcacgacccctttctctcctcttcttcctttaacggcccagctgacagcgatttagagttttattgccatcttctcagaggcagcttgaacccaaaggaatttccaacttatgaatacataaaatttgtaggaaattttcgctcttacaacaatggtaagctttaattgtcatataattgtgacagtgtcttttctcatgcaaacgtgcacatgggggcattaagaatcgcccagggaggaggagggagaacgcgtgcttttcacatttgcatttgaattttcgagttcccaggatgtgtttttgtgctcatcgatgttctctcccattcaagaggaacacactcccacacctgtttgtgccagtgcacacagtcccactgaaacacacattattcatttatttatcttcgggctgatgaaataattctgtactgtgagaaacaacatacagggaataaagaacaggctctgccaaacaggccttcgtggtgacttgatgatccataaccttgccttccacactgtttccctcccgctgcagtactgtcatgagcgtattttagtagacctggtccgtaggtcttctgctcactgtggccctcatgcacagcaaaggggtcattttacaatgagccaggaatctgcattggatgaattatcaagcaggataagccaagtagcaaagtcttattttctgaaagtacccggttacctgattaaccaaactctggctacagagacaacaactctgaacgagactaaaacacttatttttacttttgaaccatgcaaaatggaaatgcaggcctgaggccaggaattcagaaaccaagtcctaagccaacttggttatgggctgagctcagcatggcctgcattttgttttctgggctcctccaaactcaacacaaaacaaataactttgaaacagctaacatttcataaagcagcaaagatggaaaaaaaataaaataaagcattgacagggaatgggggaaaaaagaggaaatgagaaaaataccaaaggaaacaaaaacagaaagatgagctgcagaaatgagggggagatgcagagagcagatgatgacagcattaacttctgctgcgttcttgaccactgtttcactctggacgtggtgggtctattccttcagtcaaatttgtcccagggtttctattagaaacagccaaagtaatggcaccaagtcctcacatctaaccaggatttttccttctacctcagatggtcctttgttgtatgttatttgcataaatatacatgctttgtttaaaaggctccaactagatgctaaacctttagtgtgatcctgccagcatgattttcaggtccagggtgcagggcttatgcctggatggtgggctccttggctgactgggaggcctttctgggaacagacccatccagggcttaagatggtcggaagtggtgggaagtccatcgtcccaggtgggcccctacatctgggcaaagtcagatgaggccaaggcctaaccatgcctcatcctactcatctgaaaggcttgtctaaacttcatgaaatgaatgtttaatgaaccacacaaagaagtaaatggaagctctcgttgggctactcagttaaagaaactgacctaagaggcaccttgtagagaacccagcatcgtactaaccctagcgcagtggttctttgggtgaggcaacttattaaaatgcagactctcagcctttgccctaaagagtctagctcaggagatgggagggtaggacccaggaatgtgccgttggggagtactgtggggttctggttccaggggctgtggactttgaaaagcactgtcctagtgtgataccagtgccattctgtggagaatgcaatggccttcctcccagacaactttatcattgagttaatgtaaacagtgatttggaatttgctttacgtgtgcactggttcctcaaaagattaaacatagaactagcatatgatccagcaattctacttatgggtatgcacgcaaaagaagggaagacaggaacttgagagatatttgcacacctgtgttcatagcagcattattcacaatagccaaaaggtggaagcaacccacgtgtccatcagtggatgaatggataaagaaagtgtgatatatacatgcactggaatattattcggccttaaaaagaaaggaaattctgacattctacaacatggaagaactttgatgacattatgctgagtgaaataagccaacagcaaaggacaaatattgtatgattttacttacatgaggtaccatagccaaattcatagaaacagaaagtagaatggtgagtgccaggggctggagggagggggaaatgggagttgctaaatggggacagagtttcagttttgcaggatgaaaggagtccttgaggtggatggtgggatggttgcacagcagtgtgaatatactcagccctactgaactgtgcacttcaaaacggttacgatggcaaactttgttatatgtgttttaccacaatttttaaaaaatgatggccaggcgcggtggctcacacctgtaatcccagcactttgggaggccgaggcgggcggatcacgaggtcaggagatcgagaccatcctggctaacatggtgaaaccccatctctactaaaaatacaaaaaattagctgggcgtggtggtggcgggcgcctgtagtcccagctactagggaggctgaggcagaagaatggcgtgaacccgggaggctgagcttgcagtgagccgagatcgtgccactgcactccagcctgggcgacagagcaagactctgtctcaaaaaaaaaaaaaaaaaaaagatgtgctttggccataatggcagctactgtgatagcaacataccccagtggcctcgtgcacagagggcaaagggcaaaggcaccctggccctcagggcaccaagactgtgggaatcataggatgctgctccctcttgccccatgacaacagtgcacacacttcgggcagatcacctgaggtcgggaatttgagaccagcctgaccaacatggagaaaccccgtctctactaaaaatacaaaattagccgggcatgatggcgggtgcctgtaatcccagctactcgggaggctgaggcaggagaattacttgaacctgggaggcggaagttgcagtaagccaagattgcaccatttgcactctgcctgggcaacaagagcaaaactctgtctcaaaaaaaaaacaaaaaaacaacaacaaaaaactagcctgtgattggctggcgaacagcagttgtatcctttgtgaatttacatttccatgatctcattaagatgctgctgaatatccctttgaagcatcctgtcatttaccacatcttggaggatttcaaggaaataggcaggcttcattctgaatacctgggactttttttttttttaactagcagggctctactttcactatgggttgagatagtgtttgtttgcctgaaagaatgtgtggaaattatgtgtgaggttttttttttttttttggaaactattactgctgtaaacacgcagcactgaatgtggcaaatttaaaagaaagagtgcggagtgtcttttcagagtctgttctacaaaccagcattgaagaggctttcttgagacaagagttccccatgtaactgtggagtacgtgaaatatcattctaactgggattaaaatagcaaaaattgtcagagacaaatgaatttctcaggttaaaccctataaaggccagatgcagtggctcacacctgtaatcccagccctttgggaggccaaggcaggagatcacctgaggtcaggagtttgaaaccagcctggccaacatggcgaaaccccatctctactaaaaatacaagaattagccgagtgtggtggcattagcctgtaatcccagctatcaggagggtgaggcaggagaatggcttgaacccgggaggcggaggttacagtgagtcgagatcacgccacagtactccagcctgggtgacagagtgaaactccatctcataaaaaaaaaaaaaaacaaaaaaaacaccctataaaattgccaacatttaaccaccgtgacctatgagatatgctttaatataagaactcaaatttgacttcataggtttacttctgaataaacattgaacaatgaggtaacaaaaaaagctcaccctaggagtgctttctaagcacccggcccagagttcaggctttgcattgatcgtgtaatcctcgccacagccttttgaggtggtttatggcatcatcccatcttcacagaggaggaaatggacacgtagaagggttgcatctatgatgtgtgagtgggaagtcaggggcccacattcacagccagaccctctaacccggagcccacactcttcaccccagtgcctgctgcctttcacacatctgtgtcggaatgaaacagacacaggcccgctccggcctcctggcattctgctgatccatgatgcctacaatgcctgtgcatgtcagatgccctgcacccacatgccaggctgtgtgaagggcacccaagatgtgttttaatcaaacacaaagacacacagtcatggaaatgactgtcatgaagggaaaggttcatgctctcgggtccctgggaacaggaggcacacatggcccaccatgcagggccacacagagaagcaccggggttggtcaggaggccgagggaacctttattgtcgattccaagagaaagaatgggtgagagagagtagtatgaataagtgtagtgggatctgggagggaggagctgtccctaattatctggtgtctgcccggggattggttaagtcaggggacagggaccaggacatgagagcctgaaggacctggttggggtgtgagctttaggtgcgttgctttgcatacgaaaggtacctggaaggtgagttgtttgtcctctctaggaattggctaaccctgggagaggcagtccctccagcaccagcaaggccccagatgtcaaagcatcaaaaacagaaaccagaaaatgtgggccaggcacggtggctcacacctgtaatctcagcaatttgggaggcagaggcgggcagattgcctgaggtcaggagtttgagaccagcctggccaacatggcaaaactgtgtctctactaataatacaaaaattagctgggtgtgttggcacatgcctgtaatcccagctacttgggaggctgaggcatatgaattgcttgagtctgggaggcggaggttgcagtgagtggagattgtgccactgcactccaacctgggtgacatagtaaaactgtgtctcaaaaaaaaaaaaaaaagaaaaaaaagaaaagaaaaaagaaactagaaaacatagctattacacaagcctccccatacaacttctccaactccaagttcccaggtgtggtgacagttgaaaaaataagatgtaatattaataataataataggtaatatgtgtagaagaaaaatgaccactaacatcatttttttgttttttttgttttttttgtttttttttggtttttttgagacggagtctcgctctgtcacccaggttggagtgtagtggcgtgatctcggctcactggaacctctgcctccagggttcaagcgattctcctgcctcggcatcccaagtagctggtatcacaggcatgtgccgcgatgcctggctaatttttgtatttttagtagagatggggtttcgtcatgtttgccagggtggtctcaaactcctgacctcaggtgaccccaccttggcctatctgctgtatttttataggacacttgctcataccttgatgaactatttaggaaacccaccttggtccattactgtgaaaagtcttagtgtttctgctgggcagtttagttagtggagtgttacatggtacattcttatttgatgcctgtcctttttatatatatgtataaataatggaatgggaaggacagcgacccttactgtacccgcttcctgggcctagcatggtccttacccagcacataaataagcagcggataaaaataggttgacctaaagtgaggcttgatcttggccccgggacacagctggtggagggcagagcagggttcagaccagacttgaggcttagagagcttccctaggagctaacagagctctctcctagaccagctccacaatacactctggggatagagtgcacttatatgcagaagagctgcagtcacttctttggccttaaatccaaagtggagattgaacacaggtgggtacgcactgggtaaactggattgtgtcactcctggtgccttgtgatttgtccacactgagggcctctgaagcagcagtgagtggctggggaagttcgtctgtgggctctgtgcactccccacccactctgtgcctcccaccacatcaagccgcctcctcacttcagctgcttgggtgtttggaggccagtagcccccttacctgatgtccctactcaggactccccgccccatgctcctgacaccctctctctcttttgaaaatattttcagttttttgtttgtttgtttgtttttttgagacaggatctcactctgtcacacagactggagtgcagtagcaccatcatggttcgctgtagccaccacctcctgggctcaagagatcctcccacctcagcctcccgggtagctgggactacaggcgcatgctataacaacctggctaattcttttatgttttgtagagatgaggtctcactgtgtttttcaggctggtctgaaacttctgagcctaagcaatcctcccgccttggcctcccaaagtgctgggattacaggcacaagccacgcacccggcttaacttttatttcagattcagggggtacatgtgcaggtctgtcacatgggaaccctgcctgacgctgaggtttgcagtaccaataatcctgtcacccaagcagtgagcacagcacctgacaggcagccagcccctcagccttcaccccctccttccttcctccctccagcctccagcagcccccggtgtccactgctcccatctttatgtccatgtgtactcaatatttagctcccacttaccagtgagtgcatgtggtattttgttttctgttgctgtgttaattcacttaggataatggcctctagctgtatccatgttgccgcaaaggacatgttttcattcttttcatagctgtatagtattccacggctaacgcgctctcttcttgctcctctgatcaactgagttggtccaagactgagagagtccctgggccaccactcaaaaatcacatcaacaggaagcctcaggccccaaaccaaagagagatgtgtaggttccagggcagaggagaaagggtgaggctgagctggagagggctctgtgtgagccttgaagcacacagacgaggatcccatcttgttgtctgctcgcccacatggctacccgggatttgtcaggctctgtacacaatgtgatggggctgagttcgtaggaatttgaggggaagggaggaacaaagcccctttgctctggtgaactaggtgacgttacactctccaactggacatgtccaggttccccagtggaggatgcccccctctcctctgcccccattcactttggcagtgtgaacacaccagccattgctcaggtccttcagccaagtggaattttcccctacttcaatgtttgcacattttggtcactccttagggcttcatcatttgccacagatgttctgggggcaggggagggaagacaggacttcacatctttaacctagatttttaataaatgtgaagaaatatgtgtcaggaaatgggacaagaaagtagtcttttttagaagagtttcacttgaggacagtttctaacccagtctgtgcaaagcctcttggagggctctgagctgggatatgtaaccccgtgtcctattctcttcccctgaaaagcccacgctggacctggccagccagcagcactggcatggaccactggtaggagcagcccttttcttcctctaatcaactgtttccagaatagagcttaacaagatgattttatttagggctatgtttgcttgtaacagatactttaaacaacaacaacaaaagagagatgctttcagacaaatacacaattccatctcttgcttctccagcgaaatagtgcctcctttctcaaaccccaggtgcccaagtcctgtagccccacctgaccactcttagtggaaagaaactggccgggtgattttcaaaggcatggggaaaggtcctgccgggcgcggtggctcgcgcctgtaatcccagcactttgggaggccgaggcgggcggatcacgatgtcaggagatcgagaccatcctggctaacacagtgaaaccccgtctctgctaaaaatacagaaaaaattagccgggcgcgatggcaggtgcctgtagtcccagctactcgggagactgaggcaggagaatggcgtgaacccgggaggcggagcttgccgtgagctgagatcgcgccactgcactccagcctgggcgacagagcgaaactcagtctcaaaaaaaaaaggtctttgctttacggggtcctaatatgcaggcttccagatcctgaaagataacttcatgcaagaaggcaatcctttctctgagcctttttgctcctcctccagacttggatgtagatgtgtgtctgacaaatccagaaagcagtatttcaaaagttgctggtgtggttccaaataggtcaccctcggcaaacattccactctgggctttccagaaaccacacaccagagtataaaagtttccctgccctcgttttacctactcgcctctaaccgcacaaccagatttgaaatactggcagaagtggaggcttttcagcttacaacactcgattttgtatgttccgtgggatttctggaggttgcctcattttatggctttggggtggtttgaattttttccttgctgagcttaattgagatgcctcagtaaaagggaacaaagcgcatgcacgccagacctcactgggaatggagacgcgagtgtggacggcttcgtggaaggagtgtctcatctactccggactctaagagtgggaagcagagtgtcccctccacccagcaaagaatcaggccgtccttcccctgcaggggtcagtgctgccagagagatcgcaggggagttaaaatcactgtaaaaaaattgtgccccaggagcgtcatcctgcacagacacctggggttcatattaaaatggaacaatgaggaatggtcaggcttttaagcaacctcatctttctgctcgtttcagtctgggagtggggggacctttcatacaagttgtcccataatcgtgataaaaatgtgtgtgagatatccactttgaagacaggggcgagggaagttcactttcctgaacatacaaataatttggcccatccacaccaaccgtctagtggatatcttctcaacgccattacactcttctggcccctaaaaatactcattttaattaataattgccagaggaaagaagaaatatttgagtaagacatgtagtttccctttagagtcattttttaatccagcaaattgcaaagccaggccaggcacggtggctgacacctgtaatccccgcactttgagaagttagataatttgagctcaggagtttgagaccagcctgggcaacatggtgaaaccccatctcttcaaaaaaaaaaaaaaaaaaaacaaaactaaaattagccaggcatggtggcttactcctgtgatcccagctgcttaggaggctgaggtgggaggatcagttgagcccaggaggtccaggctgcagtgagccaagatcgcaccactgtgttccagcctgggcaaagaaggagaccctgtctcaaaaaaaaaaaatttttttgcaaagccccagctctctcttgtggctcctgccttttctccaacattgctcttctctatgcaaaacacagctgaaacaaaggaaacagaaaggaaaggatcaaatatgccctgggtaaggtaggcagtgcccctgccaagaagtgggcaggattatcacggtgctctcctaggaacccagccacctggctattcagaacacattgggtcaagcacattgtgaagagagaaaaataagagtctgaaaatagtgcttaattagtgggagatgattcctcatgaatgtgcagaaagttattttcccctcaacattccaaagccatagcctgaatgttttggatgtttatcacgattgggacttaacaactttattcttcctggagcgaaacctcatcactgatagtttcatatcttctcagacacctgtcagacttgtttttcatttgtttcgagaagtgccgagaaagctatttgtcacttccttgtggactattagtatgttttcctccagccattgcaactaatttatcataagcaggtcgtctctgatgagaatacttaattgttctgatgactgagctggtaattcagtggaacagagccagacatctttctccagctctttgtattcttttgctgttaactaatgctattaccatttctgcatcttccttgctccttcctgagccctttgaaaaaagttctctaccacctgagatcttcctgccctcatagtcatctttttctcctcatcatggctgatttgggagctcacctttgtcatcagacagacttggaagccaaccttgggtgcttccaaatgaggcagacatgattcattctgagtcccagggactctcctggttttggaatcccaagaataccagcccaagacaaaactttctcagggtctttgaagttacagtgtaatgaaagtttcaggacgtgataacctgtggactgttttaatagaaagaccatcatgatagcacgaggccgggcacggtggctcacgcctgtaatcccagcactttgggaggctgaggcaggtggatcacctgaggtcaggagttcgagaccagccttgccaacatggtgaaaccccgtctctactaaaagtacaaaaattagcctggcattgtggcacatgcctggggcacagagcaagactctgtctcaaaaagcaagctagccctgcatctccgcaagcagaagaccacgccacgcacctgctctgttttccatcacagagtggtgattgccgtatgctgatttgcagcagtttccctgactgcagcaggcctcctgctgactagtgttaatgtatcagtcgggcagtgagctcacctgcctgccagtggaacccaggccatgtgctatgggcacctcccacagctggcagagtgaacgggccaccagcagcaccaaggtgggtcacactgcagaggggaagccaccttggggtcccaaggtctgtgtgctagttgctggcaaggatgagatggtgtcttcccgaactggaccttaagctaggatttggagatgagccgggccatctcatgggagagtcatctgataaacacatgttgagcacttgttgtgtgctcagaggtggagacagagaatgagccccagttcctgccatggggaaggctatatatttagctttcggcaagagtaaggtcaattttgagtaagatgaccctaggagggaaaatgtagcaagaatgagttgcttttctctatattgtgagtggtcagagatctgagcaaacagggctgctcctgcagttagtgggtaatcctgagagtctcaggaagccagttgtaattagatatattctttctattacttaaattgaaacaactaattgaatccttaattaatgtctttaaactaccttgggatacaaagtgccagagaagttattctaagtgctaaatatgactaggaagtcccagggagcagtttgcacctgtgttgcctctagaatatgcaagaagactcgtgctgcaggaaaaagttatttcaaatgcaactggcaaaatgttcaaagtatcttctttgccttagttttccccaaggttttctccttggcctctattaaagcattcatccttgatttattatcacccttgatcatgccctcagtttttttaagttttttggtgggaaaggcatattgaagagagaagttgccccgttctggacatctgtaaaatatctagctcatcaaatgcaggctacaaacaataatgaaacttccttttggggggtgcatttttatctttaaagacttagatgctataaaagggcagataaaactgcattatgggggcagccaggccaacagtaagctctgcaaaaca[450 bp omitted]attcatttgcaatagcctaagccaacttgtgacagatgtaagctctccagagaccactgttttttattttgcccactttatattcatgtttggaaacattagtatttatgtgaatgaattcagagaatatgtttggtaaaatgaatttattcatgttagtggagagaagaccacattatagaatcttttagaaacctataaatatatatatttaaaaaaatgattggaaagctaaaatccaaagaaaatcttgcagatttcattttataatgatttagctttctgatgctcgatatgttcctcattaacttggagaacatcatgatattccagttcagaatgtgcaggatataattgtgaaaaacgcagcacagattatcagccctgggatcctcagcctggctgcacactggtgaacctgcagagcctttgagaaggccagtgcctgggcttcaccccagagtttgtgaattagctgatctgtttagggcccaggcagcggtgcccagggtcccaagggaaccccacccgtggacgactttgagagttccacgtacgtagtaaattggcttttctcctatttaacagggttctttatcccacctaaaaaactccatctaaaagtaactaactttttctctggcccagaaggtcagtccgttctccacagttgccctggaggcagggaccaagtcccacagagaagactctgccgaggctactgcaggtgtgagacggcatcatgatgtgggcccatggctgtgggcctaggacagtcccccctctgccctgttagaaccctgggcctagagcccaaaaacttgatggcatccctgctgttatttctgagtgaccgtggttaattatagaaccattccgggcctaggacagtaatgccctcctagatgtttgagaagatgtaagaagatgcgtgagagcagattttgtcacctgggccacactagggaactagcaagttttgttgtaggcgttgtgttcctctgggggtgacccctaaatcctgagccctgtctcctcagtggcccagacccaacccctgtatcagcctgggctcccaagggggagtttcaggacagaggcccttgaaccccaggtatgccagccaagacaggggcagggaagggggtgtcaatgatgccgagacacccctactttccctgggaccatcagtatcaggaacactgattatagaattcaccttaaaacactggctggagtattcaaaccgttactgcagaatgaggctgtcttctcttttttttgtttgttttgttttgttttgttttgttttgtttggagacagagtcttactgtgtcacccaggctggagtgcagtggtgctaacttggctcattgcaacctccgcctcccaggttcaagtgattctcagcctcccaagcagttgggattacaggcacacaccaccatgcccagctaatttttgtttttgtttgtttgtttgttttttagtagagatggggtttcacagtgttggccatggtggtctcgaacttctggcctcaagtgatcttcccgcctcagcctcccaaagtgctgggattacaggcgtgagccactgtgcctggcctgtgttctcattttgtagactatttttcccagcattataagccatagggctagtggaagtgagaggcagtgctgaatgctggtgaccagcatgggctcaaatcccagctctagcaagctttttggtcttgcacaagttacttccctctgttcctcggtttcctctttttgcaatgggaataatagttgacctacctcatccagttgtgaaaatgaaatgagttaatatactctacataaaccctgggggcagcgcttggcttacagttaagtgccaactagggattggctgctgtcaccagacagggctaacctatgtgtcctcttcttcccaaccccccagtgcctagcccctcctgtaatggttttgacaacaccctttcaagaccttgccgggtgccactaggaaaggaggtttgcttcattgccaccgttcgtctggcaacaccacaattcttaaaggcaagtacctgagaggcagttcattgtgcggagctgttatgattgactcacattttgttatatgtaattaatggtcttttgggagggaataaattgcagtgaagttgtcactggctttgaaaatcgaagtgtctggcttctgtgcctgcacacacgccctttcccctgccccgtttcctgcaagtggttctctttgaaggcagcatcgcttgctgttcagcccgcagaagtgctgtctgataactgtaaatcttcccacctttcacaccggcgttaataccatgcaggccaggcctgggtgagaaccgagtgttggagcgctgggggtttgtctgccttctctcatctgtgattgcttcaacatcgatggcatgaatgttgagttaaatgagtaattcagattccgatgaaaagccattttccacatgtttgccacttctcgataatgggaagggatggtgtgacattctggctcctaggtatttttccctagcttgtgaaataaatttagtatcagctaataccgaaattagctacagatgatgagtttcagtccaacacgacttggagacttgctcgaaatgattttaacttctgttacccaccacgcgttcctcttgaacaaacctagggtgagcatctggcacccaagcaactttttttttttttctgcttccaatacaggaaatgtgcatagttgacgaacctttagaggaattcacttcaaggcatagcttggaatggaaatttttatttctggatcacaggtttgagaaaagaaaaacatatttgggttgggcccttctcaagtcttgtttgcgtgagccaggctctccttgggagagaagagtcggccctggtccattgaaagaggaggactctctggcactaggaaaagtcgtccctgccaagggtgggtggtttccctccaacttcatctgccccatcgtgaatatgttctgtgtttgggtctgatggctcagccccgggccatctttgggatgatcctcacttgaggcccttcccggctcccagtaaggcagcagcaagtgtgagagaaatctctcatctcatttttttcaacatcctttgatcttttagcccaatctttactgtttcttttgtaacattatttgcagttgaagaactccaaatctcccctccccaccctttaatttatattacactttggtgttgggctgatccaatttgtagctgtttttaattacccagtagtgataaagcttattgttatttgggccaagttatgccaagggaaaggagtatctatatgccaaaaaaaaaagctgagccctttggaaaacacagcctctctgattttgaccattacaaagttatttttctccccttgttcttgagaaatgaggcctccatgttgatcattatggaaaggcatggccaccagggtgagccctgcagggtgtctcctccctgatgacaagtcctccttgtccttgtgcagagcacctccaatcataggatacctgccttttgaagtgctgggaacctcaggctatgactactaccacattgatgacctggagctcctggccaggtgtcaccagcaccgtgagtaccactgcccagcccaggcatgggggccttgcgttcactccactggggcccagcagcagggctctgggactccagaagcctctgctcgttacctggtttctttttaaggtgaggaacttggttttctctgagatgatctgggggcatggtggaggccccttatccgcgtctacccccatgtcactggaattcacttggccccaaaccctagcaccttcccactgtcatccagataggcgccctgtttaaacctaattaagaaattaaggtgatgcagggatttttttttttaagttatgcaatacatttcagagataaaataccgaattctcataactgttctttcatcagcagataagtattggtcactaaccataggccagatactgagtaggctggcatatggggatgatcagtacctacttgctgtcccgcagggcaggtcttctgggaaagccagaaatgggtgactttgtgggatgtggtcggtgcattgaaggggatgtacacagcatactgggggactcaagaggaccctcacagctggggttcagggaaggctctttgccacatacgaggcgaacacattagcaaatgtatgggggatgggacttacgatgtgggggagtgagaattacaagcttgtccgagttctcacttagcaagtggtttcaagaattaaccacttacagctgtattttcagtgccaactcttaacttgaaataggaacactgacctattgatcctaatgcatgaatcgaccactaacattgtgctttaaaagatgcctcacctgtagtacccattagaacttttttttttttttttttttttgagacagacagattctcgctctgtcacccaggctggagtgcagtggcgcaatctcggctcactgcaagcttcaccttctgggttcaagcaattctcccacctcagcctctagagtagttgggattacaggcgtgtgtgccaccacgcccagctaattttttgtatttttagtacagacagggtttcaccatgttggtcaggatggtctcaaactcctgacttcaaatgatctgctcacctcggcctcccaaaatgcttggattacaggcataagccactgtgcctggctagaactttctcttctgtggagagggaaggaagaataggcttgagttccatctggatcggctgttagaatttaaagctaatcattaaaactgtaactccttgctcctcaaagcgtggtctaggaccacactgcataggcatcacgggaagtttgctacacttgtagaatcaggcctactcagagtgtctattttaacaagatcccgaagtgaagaattacattcagcaattgaaaggcttctccatggcttgggcaagacctccttgccctgtggagcccacaccctcaatctgctgggcttatctcctcttcagataatcacattctccaagtcagtgtcctttttttttttttttttttttttttttgagacagagtctcactctgtcacccagtctcggctcgctgcaagctccgcctcccgggttcacgccattctcctgcctcagcctcgtgagtagctgggacaacagacgcccgccaccacacccggctaattttttgtatttttagtagagatggggtctcaccgtattcgccaggatggtctcgatctcctgacctcatgatccgcctgcctcagcctcccaaagtgctgggattacaggcatgagcccctgtgcccagccatcagtgtccttttgtagcgttagtttcctagttgagatttctcttaaccatttacctaaagaggtgctaagttccaggcactatggcaataaaacccaaatcattcttcttccttggatccgtagtccatctttctgccctgcccaggcttgatacaccatcagcatccattctgctctggacacccctagaaaagccaccagcagacatcactatgggggggctgcaagcagctctggggaagggggaagcctggggtggaggcatctgtccccgactctttatttgagaactgtgtcgactgggcatgaactgctgactggcagccacagaatccgtccagaggttgctggctggcaggtctgttttcgggccaattctggatgctctctcctgggctcctgcagctccaaagacagctctgcctgcggcgggaggatgagcaccaggcaaacctgagcctctgtttcattaaacctgcagtttgaaaatctgtctgcatctgcccttatctgaggatctctttaagcgtctgagcatttgggaaagtatatggatcactcttccactgtttaagaattcacgacagtgtaccgtgatcctgacagtcacttaaaatacagggcaaccggggaaacaagccatgtttggtattgtctttttttttgaaagcttatctttacaataactcttggggaaaagatcattttcatattaacattggttatatgcggaatccattttctaccgacagtgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcaggtaccgcgcacgggcaggggtgcggctgcgtccttgtcgcacctgggggaggggtgcaggatggcgtggcccctgatggccaagtcagatcagcagtcactcaggtgttccccatttcgaagatgaagcccaggccatcccctgccgttaacagcacaattcccagagctcagctcgcttccaggcaccactggctctgccctcccagggctgagactcctttcaagctctcagtcaggcccctttgaacgcctcatggactctcgcaggctgccaggatattacttagtaagtgactgcttcactgacctacttacatattttcccatctctatccagcccacagccttcccttgttcctgctttgagtagaaaatttaaattttacctctaaataactcaaacacatattcccctttatttttaatgctttaaaaacccctgctggcaactgaggcagtgttgggaaaacagcctggctgccagtgggcgcgggttcctgggaggtccctgctggcctcagggagccctccacccagggcgggtgagcaggactttaaagagacgcggcatgcccagggtttcatagatgctgcctttgtggggtcactgttcccaaggatgaaggggaaaatggtcttctccccgactacggaaattttaagaacgtaaattagttttaagctggcctacagaggagccttggagaagggcaaagaaagaaaagttggaaggacagcatgcctttctttttttttttttttaaactttaagttctgggattcgtgtacagaatgtgcaggtttgttacataggtatatatgtgccatggtgcatggtgccatgcacctatcaacccatcatttaggctttaagccctacatgcattaggtatttgtcctaatgctctccctccacttgtcccctaccaccacccctgtcaggccccggtgtgtgatgttcccctccctgtgtccatgtgttctcattgttcaactcccatttatgagtgagaacatgcggtgtttggttttctgttcctgtgttagtttgctgaggatgatggcttccagcttcatctatgttcccgcaaaggacatgaacttattctgttttatggctgcatagtattccataaaattagaaaaacctacttgaaatttcatatgcatttcttatatacagccacttgctgcttgatgatggatatgttttgagaaatgtgtcattaggtgatgttgtcatcatgcaaacaccatagagtgtactggacacacctagatggtgtggcctaccatacaccttggctataccgtatagtgtattgttcctaggctacacacctgtacagcatgctattgcactgaacactacaggtagccatagcacaggtgtaagtgtgcacctaaacgtatctgaacacagaaaaggtacggtaaaaatacagtgttccaatcttagggaaccaccaatatgtcccataagcacatgactatatatatgtaacagacagatgtagacagacagacactacacacactcacaccatacatgtatcaggtcaccaaatcagccattcttccttaacacgcagaagaggggagaaacactagttttcagcagcaaatgaccctgattctacttgaccacacttcatgccttcgctcagggacttgatcttggattcccagcctgccactgggcgtgcagcagcagtggtctctgactccatggcagccgcctgttgccacccagcctggtcctctgcccaagggccccctacccccagggaaggctgggcagcactcacccctcacccttcaggctgtgccctctaccagctcttcttctccatcctccacctctcaaatccttggaagaaactctcagagaaaggaggaagagaacagagtgaatgaatcaggtggcaggcgttccggaggcccaggagccacgttgctttccaaggcctcttgccccagggtctccacactcggggcagaggcactgtagggtcagctgggcgtccctgtgttgagttgatttacccacactgctgaaaagtgggcctgtgggctcatctacagtctggatttggctagtccgggttggtttgagaggaaactttctgagaaatgtaactactaaaaaagttttgtgtcactcttccatatgcacggtccagactgagcaggttttaagaaagccttctaattatttaaaggcagaagcttatcccatagacgaaaatgtgttttttaaagacaattacaattggagatttcagggaagtaaaaagaatagtaaatgagaggggaataaagacatcctggaaataaaaagattttgaatgtaatattataagtcactcaggtcgaatttaaggcagagaacgacgctcattccttccaacaagtcacaggctaggctcctctgtgttgactgttgtggggggcaggggttacgtagagaacctcgatgtaccttgctgtctgttcaggtggtgtcatcccttcctggaatgccccatctccactgtggtctcttaatttcctgtacagttacgcagatgtccgggtggaaaggaggcaggagctggctctggaagacccgccatccgaggccctccactcctcagcactaaaggtacgcccatccctgccagatggatacggcaaaggttggctaggaagaaaatgcagccaaccagtctctgaaacaagggtttcttttcatcaatggaagggtacaaccaagctattcaggaggctgaggtgggaggatcccttgaggccgtcacattgaggctgtggtgagctatgattgtgccaccatactccagcccggatgacagagtaagactctatctcaaaaaaaaaaaaaaaaaaaagagcctgcagagctgggctagacacagcccctggactcaaagcacggctcggcgactttccagccttacaagcatgtctccagtgagtccactcggcatctcctccacagataagacactgggggagttcctccctccccggctgggttgtggaggaattccagagtccctggtcttcctttgcttgagggccgtggcactgcctccaggacccaggcaccctatggggagactgccctcacgccactctccctgtcacctgtgctttctatttctgtgtccaggggtgttagtgaacatcatgctggagccagctctgggtcagcgagccctgctgtagaaaggccttccctccacagagtctcttccatccttccttccacacactgagccctctactcgcctctgcctagccagacgtctctttgtccctggtcctggtccatcacacagcttcagggaaccttggggatcatctgcaagtagaccagagccctgttcctcggagtccattcttaaagcagacacaaatgttgggagaaaaaaaaaagcaagaaagggagggagtgttgtatttcatcaaagttaaggaaggtgtcaactggaagatccatatgaatttttcttttttttttttttttgagacaaagtctcactttgttgccccagctggagtgcagtggtgcaatctcgatctcggctcactgcaaactccacctcccaggatcaagcaattttcctgccttagtctcccaagtagctgggattataggcgcccaccaccacacctggctaatttttgtgtctttcatagagacagggtttcaccatgttggccaggctggtctcgaactcctgacctcaagtgatcctcccacctcagcttctcaaagtgctgggattacaggcgtgagccactgtgcctggcctccacctgatttctcccactgagagaaaaattgctgccaaccaatctctgaaacaagtgtttcttttcatcaacggaaggacacgtcttaatttcagaagtgttcaaatgtgagtgctggagaggggagtacctcttagaactggtgaagctcaacttccagggtgcccagtgactgcgaatccagagccttgggccagaggctggtgccacagcaatggtccagtctttcaggctgtctgtggtccaacagaagcatctctcacccctgaagggccaagttgggaggaaggagaaatcacctttcaagatcagagagcagtgggtgccttggcagagcctccccggctgctgtgccatgtggtggtgtgttccatggcaattcatcaccagcacgctgataggacgcagctgacattgtttattacccagctgtgtcacaccatacattatgtatcacgtcatagaagggaattcagctgctaataggcagatgttagacacaccatacatcatcgctgaagaacaggtgtagtgtgtatcatccagtcggaaatttatcattgaggtttctgatccttggggagtcctggagccctgcgaaagaatgtcttctcatcaaaatgcatatatgtataaatacaaacgcaatcgccgggcacggtggctcacgcctataatcccagcactttgggaggctgaggcgggcagatcacaaggtcaggagttccagcccagcctgaccaacatggagaaaccccgtctccactaaaaatacaaaaattagccgggcatggtggcgtgcacctgtaatcccagctactcaggaggctgaggcaggagaatcgcttcaacccaggaggcagaggttgcagtgagccgagattgcgccattgcactccagcctgggcaacagagcgagactccgtctcaaaaaaaaaaaaaatacaaacacaatcttgggcactgggttaagaaatccctttaaagtaaaagctcccaaactatccgtggtattgaaccagtttggtttttatagcttcgctgtctgtcactgtgcagtgcatttgtaaaatgcagattcccgtgtgtggacgtgatgtgcagagatgtcaaatgggcatcaaggttcctccgggcttattctcgcttcctggaccgacttctctgctgactaggaacacataattcacaaacagccgtggtccagggaccccgctctaaggagcctggtcaaaggcaaactgtaaccaagcagcaaggtccccaaattgccatttacctcagcacatccagccacatctggtatttctgttttgcacaaaggcctgtaggtcacatgtcagtcacttcattcctactgtaggtgtacaatatccacccccactgcagccgtgacacaaaagacaaaacggccacgcagacgcacgcatgggatttcatacccaaggccatgggacacagaccagcccattgacatagcccagagatgctggcagtttccattcttctaacactagctaggaatgcggctcaggagggtaatcactgttttgttttcttctttagcttaaaaattatcccaacctttgtttggtttattattatttttttagacagagtctcactatgttgcccaggctggagtgcaatggcatgatctcagctcactgcaacctctgcctccgaagttcaaaccattctcctgcctcagcctcccaagtagctgggattacaggcgcctgccaccacgtccagctaatttttgtatttttagtaaagacgatgtttcaccatgttggccaggctggtctcgaactcctgacctcaaatgatccgcctgcctcagcctcccaaagagctgggattacaggcgtgagccaccgcacccagccccaacccagcccctgttttcatgtgcctataacagctaagccacagaggatggaaaaacggtccttcggagtcagactgtcacagctgctttctcgtcacactgtatttgaagcagagacatcctgggagccagggtcagtcaggagcgagaggtcgaaagacaggagaccccttgccctccccggttctccactccaggggacactgaggctgcagagaatgagtaacaggagaaagcctgggaaggacccaggaaggtccaaaggcacctgtcccagtggatgagtttacagtccactgccagcagcaaccttatttctagaacctccttcccccttcttggaaagtcaagatgctgggtggtgaggtgacaatgttgaggaaataataaaatggaaagtcagttacgaaaatgtaaataataaaaacaaaaggcgagaaagggtaataaacgctgcttttcggctgcaagcctctctgaggctttaggttacgtatatgtatatactctacccaagcatctttggaatcgtccccaaacaactatggtatttgtctcagcagcttctgaggttgtcgacatatttagaactaaagtcacgcccactgattctttcctcttgatgctgacatgaggactgtttgatgtgtgtgtttcaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctgtgagtgcgagtccatggatggggagtgggatgtccacatcagaccagagggacagccccacagagggtcccgggcccaagtggaatcagggcagtctgtgcctccgacagaggttgccgtgcagtttatactcctcctttcctttcccagacttcccgcctcctgatcacctctccacactctggtatccattcattgccaagcaaagacattgagtgggttgtgcacagatctgatcccttgactgcttttagtaattctggggaggcgtctgatcaggcagctcattggaccaagcagccgaaatgaagtttagggagtgtttgtggtgtctcctacctgctcccaggctgggcttctgtggttcagctcaaccctgcatggtggacttcctttatcagagatcccaagcgagctcttgtactgtgcacaccacggtcatgggtcccctcttcggatgagtacatgctaagtacatggaagttagaaggtcattcgttgctttcttacagccactcccaccaagctgatggcagaggccagcaccccggctttgccaagatcagccaccctgccccaagagttacctgtccccgggctcagccaggcagccaccatgccggtaagtgtgtgaccccaaactcctccacgggtgtacgctacaatgtggtgggggctgcagagccaggcgatgtgctgcgtctccccagagaatccgttttacttagggattgagagtgtagggtggcagatgggggtgggaagttaagtaatttaattggcaactaattttaaacatttgcatgacaaaattaacatggatgcatatccattagaatacaaaatccaagtgaattttaaggattaaaggcaaaactgcaaacccggggtcataccctcatacccccagagcccctggggctacacaattaggattcttctgttttgaatcccctttcatgctggtgaaaatatttgagcagctcagtgtcaacaaaaatgtacctctgcacatatcaggtagcgtccccaacatgtgccagatccttccagaacatcgggatgtatggccctggctatatgtaaagtcactggcatgcaccactctggtcatctattgccaggtagcaaactacacctaacttagtggcctaaagcaaccacatgtatgaagttcatggagtctgggtcaggaattcagaaagggcatcatggggatggcacttctctgctccttggtgtcggggatctcgtgggcctaggctatggaatgcacccaccagatggtgtctgcacatgaatgtccagcagccgggctgggtggctgagggctgggctcagctgaggccatccgtcattgacttgcatgggcctctcaagccttaggcttctcctggcatggtggtggactccaggttccaagaggagacacctggagacgcaggcaggaaccatgcagacctctgtgacctagccacggaagtcatatagtatcaccactgccatacctcttggtcaaagcagccctgagctcacccatgaagagggatatagacctccacttctagacgggagaagtacccaggaattttaggggccacctccagatagttgccaaacccctcccacccacacttcactgtcactttggagatggagtgaacgtgccaccttcctgcttgctgtctccataaaggctgtgcacaccctgcttgagaagcttgggcgatgcgttttattttcaagtagaatgtggcaaagaccacttactttctctccagccacctccagatgcgcttgcaagctgtgcctgccattcttccagactctcctgtccagtgtgactcactttgccaacaacggaggcccagagtgcttctgtctcctcccagctgcgcagggaaacagaacccagaccagcttctggatcagccctgtgcctgggatttctcactgaaacaaggtctcctggtgtcatttcctcccaatgctgtcctgggtgacactttccatttgagctgcttttttatataggccctagcaactaggggccgtgtcggaataacttcagacgagtcctttcactgttctttaaaaaaaaaaaaaaccactagaaaaccactagcccgtgaagcagagtgtttcatttcttgttactatacattgtctcccccacccacccgagtgatcagggagcgcagatgtgactcagctcacttcccaggagtctcttaaaaggttctgggcagaggctggtgaaactgccccagtcctcactgcctggatgagttcatggacaaacatgcatggcgtgtctgtccatctgcattagcgctgagcagaaaagatacggacgcacagcagctcatggtagcagtccacgcacgtcgtcctgcttgatgacaccgctaagaattaatccatttgggaggagagcaaccaaatccacccagggcggagtccaggacagcaggcaagggaagggaagtagagctgagctaccaggcttgggcaggtagcagcagcctggcagagcacactgtggtggggtggaagcctgcaccagttgtgcaggggctctgcccttgtgccctgcgtaggaagcagtgcagccagggaacagacacctatactttctagaactcttgacttggagctgttcaccccagtgcggaacgcagagaacccaccggaccaagagaccacatccctgtcccctggaatggcagaagcagtggtaacaaagcccctttctctcccacaggcccctctgccttccccatcgtcctgcgacctcacacagcagctcctgcctcagaccgttctgcagagcacgcccgctcccatggcacaggtgagtctgggacccaggaaagggcagcccctctcaagccagaagtccgcagtgtgctgcgctgatggtcttgtacacttaggtcccaaccaaggccctgacgtgggggaatgtccctcccaatgtgtgtgtggcctgtgtcgagccatgaggttccccccacacccaccctctcgtctccaagttcttttttccagtgtctggggttttctttttttaaatttcagtagttttgagggaacaggtggtgtttgattgtatggataagttctttaggggtgatttctgagatttgtgtacctgtcacccgagcagtgtacactgtacccaatatgtagtcctttatgcctcacatccccccacccttgccccaccagtcccaaagtccatcatttcattcttatgcctttgtgacctcatagtttagctcccacttagaagtgaaaacatacgatatttggttttccatttctgagttgcttcatttagaataatgacctccagctccatccaagttgctgcagaagtccagagtctgtttttttaattcttttaacagtctctgttcacctctttgccacttttccacattcctcttgttctttacgactccaaattggccatggtattttagaaaaggtctgaattgggctgcatgtcatagaaagactgaaaggatctaaaagccgtgagtccagcactataaatatcacatttgtttaaaaaaaaagaaagaaagaaagaaagaaagaaaagaaaaggattacggctttgctgagtaattccatccttgtttcaacaacattcggtgagttactatttgggtcagtcagtgagcgaggtgttagggatgtaaagatgtaagtcagcccttgcttttagttctcagaactaaagggagagacaggcatgtaaacagagacgccgccgtggcagggcatgcgtttttatagaaccgtgaaggaaatattctacccagggaagtctgacgtggcttcctggaggaggtgacgcttgagttggccccggaaaggtgggtaggaggttgccagatggtttggcagggggacagcagggatgtgcttcagcagggagttctgaacacggggagtgacaaaccctgcccaggcctgagctctgacttcagttccctcataggagacttagctctgcccagaccatggccacaggctagagctgcgtcccagacggcagttcagcagcaggtgcccctctctgtcttggcacacatctgtcaccactgatgaaaactatttcggaacatatgccctcttagtgggggtctctcatgcattcctggagtaagacacatgctaacgcgtgctgcttgccagagtcaggcttgaagattggtgtaaaaaagctacccttctggaatctactcattaaaactgcctatattcaccctcattaggccaaaagaaaaaaaaacctgaatactgtttttctctttaaatttccaaggcctatttggtaagaaattagtaaccttttaatccaaaggggcataaaatgaaaatgtctttaacttctgggtcttgcattatgaagaatgtctgtgtttacaagacacgatggtgtgatgcagtctcttttggaattctgatttttcatttattgaacttcttagtctgtcatgtgtactatatttaataataactatatatatatatatatatatattttttttttttttttttttttttttctgagacggagtttcactctttttgcccaggctggagtgcaatggcaccatcttggctcactgcaacctccacctcctgggttccagcgattcttctgcctcagcctcccaagtagctgggattacaggaatgcaccactaccaggaatgcaccactacacccagctaattttgtattttttgtggagacggggtttcgctgtgttggccaggctggtcttgaattcctgacctcaggtgatccgcccacctcaacctcccaaagtgctgggattacaggcgtgagccaccacgcccagccaataactatattctttaagacatccctgcataatactgactttccaagtcacacagttcttcccacttcatgtgaaatacccacttcatgtgaaacaacgagattctgggatttttctctcactcccctcacccttcagggaaagaagggaaaaatgaaatccaaaatctgaggagcggttatctgggtaactggtggttttccaaaaaagcctctttcttcatactatggttctaaaatgtctttaaattagagtagctctctttatcaaaaacatcaccatcaagaaggtaaggagggcctaatgatggggtgtctgggaggccttgaaaaaatccgaataacgtgagaggcagccaccacctcctaacccagcccatcgccactccctttccaagccaactgggcaccgatgagccgcctccactgcaggtggaaggggcaacgctgagtttcccgacttcgtagaacctgccagagaagcttttgtgtttcgttaaatacttggaatagctcgtttgctttctccgttgaattccctttcaaaatcctcacagagtggtctgattagtcacaatctgactgggatttttgtgagtctgggatagcgcagggttttttttaatttttgttatttttgtttatatatatattttttgagacggggtctcactctgttgcccaggctggagtgcagttgtgcaatctcggctcactgcaacctctgcctcccggattcaagcaattctcctgcctcagcctcccgagtagctgagattacgggtgcccaccaccacgcctggctaatttttgtattttttagtggagatggggttttgccatgttggccaggctggtctcaaactcttgatctcaggtgatccgcccacctcggcctctcaaagtgctgggattacaggcatgagtcaccgccccaggcccagcacaggtatttttaaatgcatgggtagcaacagaaccttccttttaaaggaagtctgaggtcaaagccactctggtcaagatgggagtgtcttgtgggcaaaacttcttggccttgctcagctcctaagacttgggatttacatgttggtgctgccaccatctcgctgtgtgatttccagcagggtgcagcctcttggggtggcatgggctcgtcgtgaagcacaacacacgtacctctacttgcctggggcagcagctggcacctgagggtctctgcacatgtcagcacctgctattcttactcttactggttctttttattattattttgctgcttcaaaagctatgctttcagttatttcatcctgtttctcaactctcctgctctccttgcctccctgtgtctgggaggtcaaagggcagaggaaaagagagaggccctgggggcatttgcaaaagacagcgggcaggaaacagactagggagattgttgggctagagattgagggagtggaggttaaatcatggtaaaaagggagaaagagaaaaacagaatgaatctagcaaactcatttgcctcaagatatgggagtcatagccccgaagagcccagagcaggggctgcaggcccctcctgccatccctcccaaacagtgtttcctggaagcggaggagcctgtgttgagggagacgggacaggaggcagagactacctgcaagtttcctaaggccagcctccttccccagaaaggattaagggtccaaaggaaggggagacccaaaacaatcaccgtgtctttaccccgaggtcagtcacactggagagggggccctcggggcaaagactgggtgattgttttgttcgttttttgcacagatttccgagacgtgcatagtagcaagtaaggctggagaggggagggtgagggggaatgaaaagttcttgatgatcccaggctgttttggagagagccaggatcagatttaggataacgaccggacccaaaaatgcctgtgaagctgtcacgtacaaactgctatgccctaaatgagggggaaaagggactctctgatgtcctgcttttgacattcatctccagaaccatttgttcatctctctaaatttggaatatcagtttgtgaacattgcttacaaaatcctgtcccaattctgtggccctcccggactgcagggcagtaagtcaggtctgcagattcaggtgggcctgctgtcatagccagcctgagaaagactggtgcaggggcccccaggatgcccagacctcatctgcagcccctgttcactgcccaggacccagccgtgggctccttagggatgctgggaaagacggctaagggacggaaatgaagtgtacagaccgagcagcagcaagatctgcctgcaaggctgaaataactctttcatctgattatgtttttcggctccaccttgaagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccaggtgatccccttcccgggctggcctctgtccctgctgctgtgtgggaaggggtcctgccgccatttccgggcagccaggacttcctcccaagccctgtgaactgccctgccaagccccatttgcttatgaaagcatattgcagtctctgcaaaggacaaggaacaaatcccggtccccatccctgcctccaggccacacccctgatgtcctcttccctcgcccctcactctgacaggcacatctgctcactgcctccacctacgtttgcacttgtgcacttggcgttggattgccctgcatggatgcctgcctcggtcctgggtagtacctccctgcacctctataactttgctttcctagctcccagcccaggctgccatcaggaggagatggaagcagctctgttgtttctcatccaacgcaggcatccagggagatgtgggaaatgatgatatccatatcacagcctactggagactgcagagggagctgggtggctccccatttgtggtgtgccagcagggaagctctgcaaagcctagcagcagcagctctcactgtgacccccagatattagaattgtttggagaggtgttgttttgttttgttttttgttttgttttggaggaaaacctttacatattggatctcttttaataatatataatgttttacttacattagtccaggactgtgtatcttcagaagtgcctgattctgacccagcctttgattgtaaatgtaactctagctaaccttggcgtctgccctgggagcactaagcatttggagacccttagaagggacagaaagaagcagaaataacatctctgctggagcactgtccctgttgcttcccccatcaccatctacgcagaccctcccctggccacacagcttctgaagtgcagccacacctaccataggtgacaggcgggttctgtcggggcacagcgccgtgagccggtgcacgctgagattaatacacagtggtgcaggtgtctgggggcttagggagatgctcatttggccatcctgcctcgctgaggtcccagcagctccgcctggccctcaggggcactcctggtggctttctagatgctcactgtccctccccttcctgcccctgcacaggcctctcagaggtggctgctcaccttaaagagaagagccccgccctggacaggccacctccccacctgctcccctcaagacacggcgtgtgcgccttgagcaggcttcactcagacagcctgggccatgccagagccctgctgctctccccacctcctcagtgcacccttaaattgaccagaaaaaggctcggccttctcgtgaaaagaaatggagtcaccgagctgccattccaccttttaccagaataggtaaaaagtggcttttgacttacgccttcccagctggaatatttttctcactgatccagggcctgactgggagcccaatgcttgcctgactccaattactttaatggaatttttacactaacaggaagggggaaatcgagccagaaactgctaaaattgaggtaggcgtatgaacatccccctcagtgcctggagtttttctacttcctgccttttctgaattttaaaataacaggcagcaaggttatcgctttcactcctgttataacaaagtatttttcctccttgtgacctatgcctttggttaaccccaaagtacctatgccacagtgcactgagggatgttctgagccggccggcatgggaattgcaccctccggtgccttcctgccctgtgttcattcctgaggccttatctttgcagtggaattttccagagatcatggaaatccacagatagtcgagacagaggatatttcctcaaggagcctgccttgtttttttgtaagacttaaagaaatatgttccaaaatgtgatatttgttttttttaaactaaactgtgtgattcaagtgtgaagaataagcaagtagaaatgactccagcccacccccaaaagtagagggatagataaaataagaatgacaaaacactgatgattgttgaagcctaatggtgatgccaaggtttcattatattacttgtctattttgtatacttctaaaatgtcctgtaatgacaagtatttgtagaaataagcagataacactaatgaaaaatcatctgtgagtgtaggattggtttgttcttgaaaattagaagttgttggtttgttttctctgataacttttcccacttggagaacttttttttttttttatgttttctataaagttgacctcagagcccttttaagtcaccatctccttaagccacaaaattctactttattgttgataaacagaagtacggctgtgcccagcagcaaaccaggaaccagtcccccacccagtggcctttatcccaacctcagtggacttgtgatgctttacttcattgcttcaaaactttcgtcgaggctatatgtgcctgtgatgcttactatttttttttttcaaaaaaaccttgggttatgaggaagaagtcctgaagggctgttggtgtttgcacctggatggggtcatgaaaatggggctacctggacaagagctgttgtgctgaaaggcccatcgccccctccaaggctgcctcttgctctttttgagagcatgcgcgccctctgctggctgctcaaaggaatgcctagaaggacacctgtagcaatggcaaatgacgtgttcctcaactggttcatccatccatctatccatccttccttccatccagccatcatctatccatccttccatccgtccttccttccttccatccagccatcatctatccatccttccatccagccatcatctgtccatccttccatccgtccttccatccagccgccatctgtccatcctttcttctggccaccctcccttctatacatccttctgcccgtcctttcttccttccatccatcctttagtccatccatccatctgacagacaccctttatttaccaggcacgtggttaagcactgtgaggatacagaaagataaacagggcagggtttctactgtcagaggatatacatcgatgggacagagtagcacaccttgctgttacagtctgttacataaataacaccagcagacatagtttgcccttctctgagtgaaagcaccattcatatgtttattcattcatacatgcatttattccattcattcatttatcaaacagtttttatatgcccaaagaggcgaaggaggaaaaagctccttttttcattttgaatgttattatctgacattcattcagtacttactatgtctcaggtcatttatatgcattaacttcatttagtccttaataagatatatgctcttaatgtcactatttttttttaatgtcactattttttactaatgaggaaactaaggctttgaaaagttattaaaattgccgaaggccatactgctagtaaatggtagggtgggaatttgagctaagataggtctgctttaaggtaaattatactgcctctcatcaataaaggttggatttattcaaactctaatcaaaaggtaaattgtgtcctaccagaaaaacgcatggtaattgggtttgactactaggtttttgctgaagtgatgaagtataggttgccctatgtgctataaatgagtcttattttaatagggagctgggattgcatgaaacatgaatcctcaaaatgtgtaaaatgatggatacccagaaaattcttcttaatttctaaagtgacaaggagtcctcatttcaaaactgcaggcttctctgtggtgggtggggcatgagaggagtttggggaggtcccgtgggatggtagaaagatcagaacccagccccagctcagccacctgcccatctcgggcctctggtaagtggctcgaccccacccatgaaacagatgcttgagcgaactgatccgtaagtctccccagcgcgcctgcatggtgggatcctcgcctgcctctccaaacctgcgctgacactcagcagatgtcagcctgtcggtcctgtactgcatatgaggtgggactgcactgagtacaggaatggggtgaaaaacgtcagatgctgggagccagagagccttccccctaaagaactccaggctaagggcctgatggactggaacagtgtatgttgagaatcatgatagacacagtgccatctgatgtttttaatacccaagaggtacttttgtttaaaaagccagtttcaggtctgtcattaaattattattaaaattacaaaagttgtctttcttaaaactttagagtcaactgacagattccgttttatttatgaatctactaatttggtctaaaaagagcaatgctctaactagatttttatttatgttcaattagttgataggttgattgtgaataatcaacattatctaccaaaactattcatttacacatttaatttatctgaatctttcaagcattttatgtacctaacaaggcagacttataaagctaagaagtaaaatctttctaagcacctaaacaactgttttatttatttattcatttttaagacagagtctcaccctgttgcccaggctggagcgcagtggcacgatcttggctcactgcaacctccgcctcccaggttcaagcaattcccctgcctcagcctcccaaataactgggattacaggcgtgcgccaccatgcccagctaatttttatatttttagtagagacagggtttcaccatattggttaggctggtctcaagctcctggcctcaagcgatctgcccgccttggcctcccaaagtgctgtaatacaggcgttagacacagcgcccagcgtaaacaactgttttaaatcaaatacaccaaacttatttgaactaaatcaggattctcaagaacacctcaaattctcttaaatctttcaaattaaaaccaccaagctaatatcccatggccttttaaatgtctctgagacaccttaggtaacaaaacacagagatgatcatgatgattacaaaacttgaacataattttaaagtgcatggacttaatgttatgtgatcatatccatgttattggcctgcctgggtatgtggttccttaattaatgacagatctgccatctcagctgagagcactggattgaaaattctcaacagtaatgtgggtacagacacgagtcactggtcagagattcaagggcaaacacagagcctggtcctactgcgagggcaatgtggcccatgccacaggtgagccatccctctgcccctatatcatgaggcaatattatcatgactgcatcatgcattccactcaccaggtatttctcccttctaggaagaagctggtaagccaacctcgactctaaacaagtacatcacattatttagagaacatctgggtctaaacagctttcacattgttaggcctcagtcacttgcctgtaaccttcatgaaggcagagagagtgtctctccagcccatggctctgtggccagtgcctgacactgagcttggggcatcacaggtgctccatgtccaccagtggagtaaatgaactatttctaggcagctcagagcaagaaagttcttactggcacagggaatgcaaaggaggtgcacactggtgaggtacccatgaccccaacttcacaggcatttctattctgctcccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccaggtaaatgtgctccttgccagcttcactccttgcctctagagcagacaccctcttgcagtttgggacatacttgattcctgcagcctacgtgaactgaggcctactgccctgttccgttatggactgagggtagatttgggagtgagccttcttttccttcttctgttaaagtcactttgaaaccccaagttgtattggcttccttctgtgttttataaatgtccacctcagtcccttgctctcgtgcttaaagatatcactcggctgaaatgttcacctttgatgctgacttagggttggaggcagatatggccatcccagagacccactggcagctgaatgtcccaacactcaacgtccatggtccccgccatctactctggttttaaccattacccacatgagcagccactgctgttcactgtcccttgccccaggtgccccctgctcctccaggcgccccctgctcctccaggcccccactgctcctccaggtctccctgctcctccaggcccccattgctcctccaggtctccctgctcctccaggtccccctgctcctccaggcccccactgctcctccaggcctctctgctcctccaggcgccccctgcccctccaggcccccactgttcctccaggtccccctgctcctccaggcctccctgttcctccaggcgccccctgctcctccaggcccccctgctcctccaggcccccactgctcctccaggccccccagactctttgccaaacccttgtagccatttccacctattccaagccaccagtgaccttgcaattggacaaaatcgccagcagataaatggcactcaaatggaatggaattcagaagtctggagcagggcttctggaggataacagatgggaaggcagcctttcctccagcctcacattcccatgccctcgtggctttggtaaagtcagctgagctcctggaattcaccaagacccaggggaacaatgatgagcaagagttgtcctgggcctcgaggagcctgtagtccagtagagaatctgggaacttagataacctgcagtacaatacagataaacacacatatggaagtgtttaggccatctttcttcaaatgtaagggttttgcttgaaaatacagccttttgatttaaaaggtcatcagaaaaataggtgagaagagctaagaaaattttggaaaagagaaaactgaggaaggatttatactatctgatattggaaaattttgtaaaaactaagaatgagagcactgtgttatcggatgaatggacaatcagtgaaatagacagaaaacccaaagcaggtgcaagcccacttcctcactcatttattatttcactcagctccctgcgtgccaggcactaaattctgagcactgagggaaagcagtgaacaaaaaagaaaaaagaatttctgttccaagtgaggagagagacgaacatgtgaaaattatagtatgtgcaatggtacaggaatgctggtgagggccaggaatggctggaggtgtaaagaggtagccaggtaaggccttttgaagaagataatatttgagtcaagacctgagggggtgaaagaatgagccatgtcaatgtcaggggaagagcattctacagagcagtcagctcgtgcaaaggccctagggcaggagtaggcctggtgagttggagaaacagccaggagggccatgtgtctgcagtagaatttgaagcagaaagtagttcagttcaaggcacatttgctacttgcctgcctagagtccggcactgtcctaggcccaagggattcaaatacaatccaatggggaagacagtcacagatcaaagtaattcagtagttgggaggttctgatttagaggaaaggcaagggtaggtagaaggaggagacactgggaggtttcctggagagatggcccagggttgagtccaagtcttacctttctcattgaaatgatgctccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggtacgagactgcccttgtttaaaggataacccaggcatcattttaccccattcatttcagctctactttctgctttagacggaggcagagttcagacagattctaaagtgtccacagttgatctcagctaaggaagcagaggacagggcttgggatcctgaggtccaggggaggttacccgctgcgtccatcatcctcagagaatgaagccaggagagtggggattagagtcaaccataaagggtccagccaggctgagcaagtgctgccacgaccagtgggtctgtggttcaggtgctgatcagtttcctatttccccacctctgcttaaaggctgttgctgagccagcccatccagcccatgatgcccgggtcctgtgacgcaaggcagccctcggaagtcagcaggacgggacggcaagtcaagtacgtggaccctggcgggaggcaggaggcaagcgctggtggaatggttccaggctggccagactcacccgcctgggccagcagcactcacatgagccttgcgctaaaggcaaggtctgagtgtgcccacagctgtgaaggggacgctgcccctcagcttttcttctaccgtgtcccaattaagcagaaaaaactcagcgctccatgcttacagcagcactgaatgaaacaattcacaccccaccgtttgccatcatcttccgacttccttacacctgtaaagccctctaaagccctcacccctggagacatcccccttcccaaggaccctcccccaggctccagctgacatgccgcaggcacacttggtgctccgtgcttctggcaccgtgctcgggcccgtctctcccagacaagcagccccctctctgccttccccagcctcctctccactagcaccggtaggaccagaagcagctttactcagctacttaattactagggacaacggttactggagacacggggaatagtttaaaagctgctggaaaacagtttctagcccttgggaatgaggcagaaatagagctatcacacagacatctccttcatgttaacactggttgactttgtgtccagaactaaccaggacagtgctagccgatcaggcctgggatgccctcatgtagaagcctcgcaggcacccccaggcccctctccctagaagtccttcttctgtgccctccttcagccaggacagagagtaacggcagatggttactgcctttctgagggtcagggtctgtatgttcattatttaattttatcccgataaaaaccctagggtgtaggcacatgctcggtctttttttgtttgtttgtttgttttttaaaccagtgaagaggctgggctttaaaggggttagattacattctcgaaggccacacagtgcagatggtggggctggaggccagctaactccaggccacgggccccttgggctccctgaatcttcaaagtccaccttgttggccctgtctggggtctccctatgcctcaggataactttctaggcagcctctgcccctgagactttctggccctccctttggtcacaggagggtaaggagggacctgcaggttgtggggagccatctgtaaagttccgttcatgtctatcattaggtgggaggaagtgggctggttttgcttctggattttacctgttcttcctaaatgatccaaataagtggaaataggctgggcgcagtggctcatgcctgtaatcccaacactttgggaggccaaggcgggcggatcacctgaggtcagaagttcaagaccagtctggccaacatggtgaaacccccatctctactaaaaatacaaaaattagccgggtgtggtggcacgtgcctgtaatcccagctactcaggaggctgaggcaggagaatcacttgaacttcagtgctctgttggtgggaactgtccagtgctgcagccactgtgttaaatgtcggctctgtgtccccaccaaaatctcttgttgaattgtaatccctagtgttggaggtgtggcctggtgggaggtgattgatcatgggtggggacttcccccttgctattcttgtgatagagttctccctagatctgtttgtttaaaagtgtgtagcccctccccctcgttctcgatctcctcccggccatgtgaagttacttcctggttttttgataatcaccattgtaatgagtgtgaagggacatctcattttggttttgatctgctttgccctaatggaatggctactgatgctgagtatgttttcatgtgtgtgttggccatttccaggttctctttggagaaatgtcagccccaatgcccattttttgattgggttgtgtgggtgtcttgttgtggagttgtaggcattctttatatattctgttatcggtctcttattagatatgtgatgtgcaaatatcttcccctactctgtgggctgccttttccctctgttgatagtgttgatagtgtcttttgatggacaaaagtttcttttttttttttgctttgagacggagtctcactctgtcgcccaggctggagtgcagtggtgtgatctcggctcactacagtctccacctcccgggttcaagctattctcctgcctcagcctcccaagtagctgggactacaggtgcccaacatgacacctggctaatttttatttatatttttagtagagacgggggtttcaccatattggccaggctgatctcgatctcctgaccttgtgatccgcctgcctcggcctcccaaagtgctgggattacaggcatgagccaccgcgcctggccaaaagtttcttatgaagtccaacttatttgttttttctttgttgctcgtgcttttggtgtcgtatcaatactgctttcttaaaggacctgttttctccttcccacgtgaaacaggtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtgggtgccacggcccagggggcccccgtgcaggcctgggagccgggccacgctccacacccgaagtctcagagatattttattcccttgctttcaaggttgttctatccctagtatagaagtaagccccagaaagattgttatttgattgtttttcatgcttaaagtttatgaagtctatgtctacagagtacatgaaattacgagtcggctattatgccttatgtggttatgtgctaaaaaggttcttttttaaaaaagtagtttctactcaaggatttgcatcttgatatgttcacagtttttagagcaaaagtcgaaaaacattgatgactatgttggacttttcagtgtgtttataaagtcctatataaacataaagttaaatcacatttagttaaagatccattaacctgccttcataaatacagtgatgtgtgaaattgggcttgccaggaaaatttggagctcatttacatgtggtcactacttcgaaggcaaaaattacttcaagcaagtgccaagtatgtcaaaagcagggagggtgagagccactggtccgcaggttcacgtgggagccacacgtctgcgtctgccaagctgcagaagggcctggccttccctcacccatgtgcagggtgcccctcttcaccccagcccttccctgtcctgggggggcttcctccctggcctgcagccccacctgcacctgcaaagccatggagaatgagcagtagctgagacctcttgagtactgtagatagtgatgaagatagctgtccttgaagttctagaacgtaatttaattccagtgccgctaagccatctgtgctataattttcagatctccctgaccccacacatagtgggagtcaactcagactttggctttgcagatcttgtcagttctcgagacccagaagtgattttggatgggaaatgagcaacagacaagtttgcatgcacctgttgcagacaagatgcaggctatgaatacagagagcgcttcggcccactcactgcccttaggggcttggggtggggtgcagagaggtgggttagcacagaatgcagtcaggctcggatttgggaacagtgggagtgctgtggtggggaagcctttgtggaggaagggacttgaggagagggagggctcagaaggcacccactgcagagtctgatgtccaggaaatgcccgaaatgtgggtgagggtgaagataaagggacagtgttccagccagacagcctgagcaaaagttcagggcagctgtgcctgggcagctttgagagcaggggggtgctgggttacttgcaggaggagatttcatggaagggaatagtgggtgataagactgaagtttccaaagtcaggctttggtcagtcaaagcttctaaacttccaatcaagatgctcctagtaggtgctggtgaatctggaggtagctacgggatcagggaccagcagtgaaaagtgtacaaactgtatgtgtgtttggattctgccctgtcaactacctgcatgtggcctcaggttccatcatccaaaaacattgtggctacatgtagatcatgtgcacgtgtttacgaaaccattccccatagccatagccacaggcctcagtcgattgggccagaaggtgcccccactattggcggagaacttagcttcagaattcaccctaaggttcccttagtccccatccccaccacacccccaggtcttgccagagccacctctccccacatgaccccccaagaaagacagccctgtagtctaactcaacctgcagcatgccccgcactgccttgtaagacagttgaggagcggacatcagaaccacctctgaagccctttgttcttttttttctaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtac

SEQ ID NO: 37903 - DNA, 16839 bp, Homo sapiens; identical to SEQ ID NO: 36097

SEQ ID NO: 37904 - DNA, 22872 bp, Homo sapiens
ggcgaatagcgccggctaggtcttccaacctctaggtggggtgccagccggggcgggcccagcaccccggccgggcagtactttttttttttttgcatacaccagttctcaggatatcggaatccggtgcacagcagcttcttcaggtttgaggttccggatgcctgggggcggagaaacgggaggggaaaaacagatggcaaggtgggtgaccagcgtccagaaatccactggggaaacctcctcccgtttttacccttggtaccgcgagaatgggcggggtctggcttcggggcggaagcgacgggcggtcccggttccagggcggggctggagacagggagacccggctgggaagtgcaggcaaagccggctgttaccctgcacagccgtcaccctcaactttcccttcaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggtgggtagagacgggcgcaaggcatctgtccatgtgtgcctgcagatctcacccgcggcctacatcttccggcagtgtcaccagaatagcgaggtctctggagtagggcagaagtagaataaaatctaagcattgctacttagcagcaatgtggctgttcttgggcaagtacctgccttctctgagtctcattgttgggaggtttaaatgagataatgaatttaagcatatagtgcagcgcctggcatgtttttaaaggtccgatgagtatcagaaatcatcagaattgtccattttcagctacccggactcagctgtcatgaattggaggcagaattgggggaacaacgtttttagccaaaagcgatgatgtgtttaagttgtaggctcagtttctcaccactgcaacccatgaaaccttagtgtttccagattaagaaaagcatacctaggctcagctgaagaggaagcagtagatagacaagaagagcaaaatcaaacattaagccttccccaattaagggctataaggtgtggatgctaaactcaacttgattttgtatttagttcttgtatggctagagatgactaaagttagtctcattctggctgccgagaagataggaggacggtgtggtctctgcctttgggagttcctagtctgatggggggaagtgtctctatccaagaggtctttcttgctttctcattagactgagttcccaaaagactgtgccaatttttaatagctgctcttctgagaaggctgtctatgctaggtgattaaacccttctagacttttgtctctgtgtaagaaacaaatcaggattcctcccagaccaagcggatacacagcttctcctatccaaggaagggattcatccgccccctgggaaagcaagaaagaccatcatgtgatcaatagaaattgtgcttcacttcacttatcagccttgtgtgtgttgctgagaagggttagagagatcgagaatctaagacaggaaagggcctcagaaggctttaacttgagactcactgctcaccatactggtgaggaaagtgagattcagagaggaaaagagacttgaaggggtgatgaggctggttgatggccaacttggggccagtttatgcctccaagggcccagtgttctttcttgggtccccacatcttaggaaatatatatatttttttcttttccttctttcttttctttctttcttttctttcttgtgtgtgtgtgtgtgtgtgtgtgtgtgtgtgtgtgtggcgggggggaggggggattgttattgttgttttgttttttgaggcagcgtctccctctgttgcccaggctgaagtacagtggtgcaatcacagttcactgcagcctcaacctcctgggctccagcaacctctcacctcagccttttgatttgctggggccacaagtgcatgccaccacacctggctaatttttttaaaaattatttttaataggccgggtgcagtggctcaagcctgtaatgccagcactgtaggaggccaggagttcgagaccagcctgccaacgtggcagaatgccatctctactaaaaatacaaaaaattggccgggcccagtggctcatgcctgtaatcccagcactttgggaggctgagacaggcagatcactggaggtcaggagtttgaaaccagcctggtcaacatggtgaaaccccatcttgaatcgcttgaacccaggaggcagaggttgtggtgcgccaagattgcaccactgcactccagcctggacgacaaagcgagactctgtctcaaaaagaaaaaattatttttagtagagacaaggccttgctttgttgtccaggctggtcttgaactcttgggctcaagcaatccttctgcctcagcctcctaaagttctgggtttacaaatgtgagccaccatgcccagccagaaatagaaaaaaattttttttttctttgagacagggtcttactctgtcacccaggctggagagcagtggcacgatctcggcccactgcaacctccacctcttgggttcaagcgattctcctgccttagcctccagagtagctgagactacaggcatgtgccaccatgcctggccagttttcgtatttttactagagatggagtttcactgtgttacacaggctggtcttgaactcctggcctcaagtgatccacctgcctctgcctcccaaagtgctgggattacaggcttgagccaccatgcccagcccagaaatagaattcttaaaggctgattttttattcccatctaaatccctacaaataactgtcatcaggtggacttttaagaaaacccccagctactcgggaggctgaggcaggggaatcgcttgaacctgggaggcggaggttgcagcgagctgagatcacgccattgcgctccagcctggcgacagagcaagactctgcattttagcttacaagtaaacttttttagtaacctagccgtgccacaaagggtgtaacagactcagtcctctttttgtatgaactttcaagacatcctgatactcactgctgcagatacgttttcctgtatttgattcttttttttttttttggacagagtctctctttgtcacccaggctggagtacagtggcacgatctcagctcactgcaacctccgcctcccaggttcaagcgattctcgtgcctcagtgtcccaaagtagctgggattacaggtgtgtgccaccattccctgctaatttttgtatttttattagagaccgggttttaccatgttggccaggctggtctcaaactgctgatctcaagtgatctgcctgcttcagcctcccaaagtgctgggattacgggcataagccactgtgaccagcccctgtatttgattcttaatgcagacagatcaccttttgtttattaaaaacatttttttatgccaagaagatataaacacaagcaaaaagagatatttttctttagctaaaggagtcgcaaaagcaatccacaccaccttctataatcagtggaaagagagtagaatattccaagcctttataaagtttaggctaccatattagaatataaaagctgtatgtaagtccgatttttattcatttaatagtgcttcaggtgaatttaagggtactgttaggtggatccttttgtaaaaatgaatatgtaccctttatcagttatctgcatgaaaactttggattttcttttttttcctgagacggagtcttcccctgtcacccaggctggagtgcattggcgtgatctcagctcactgcaacctccatctcccagattcaagcgattctcctgcctcagcctcctgagtagctgggattgcaggtgcctgccaccatgcctggctaatttttgcatttttggtaaagatgggggtttcaccatgttggccaggctggtctcgaactcctaacctcaggcgatcctcccgtctcagcctcccaaagtgctaggattacaggcgtgagccacggcgcccagcctggattttttttaaaattttagattcatgaggcatatgtgcttgtttgttattatacatggatatattatgtgatgctgaagtttgggcttctaatgatcccatcaccaaagtagcaaacgtagtacccaggattttttttttcctagttagtcttcatgttaagtacaatcttacctcaaaattgttaatgtctgtggtttaaaaaaaaacatgaatcagaaatggtgtgggtagtttagaaaatgagttaggttcaggtggccggttagctcagttggtcagaaaatgagttaggttcatctgggaagacttcctgggagaaaagaccctgggttctgaggtaaagtggagtagggataagatgtgcaaggcaggaagggagttgattccttaggtaagtgaattattggaggtgaggggtatgtctggctcctgagtcagccacgatgtgcctccttgtcttcccccttgtccccaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaaggtgagcgggtacttggggtccctcagctatctggagaccccacccagcccaggtccccaggtcttcccatgcacactacctgagggagtgagagtgacctcaaagttaagagctgagactggagaaaggtagacctgggttcaaatcctggctctacacttactggttcaatcacttcagacaagtcacttaacctatttgggcttccccttcctcatctgtaaagtgagaatagtagtagcttaccttgtagagttgtaaggatctcatgagataatgcttagtgtagtgccagtcacaaagtaagctctgaatacatgtggccaccctgggaggtaggaagtcatctgtctggctccaaacaggtctttagggccagagctgggacccaagtctccaacctccttatctagggcacagaccaccccatggctgcatgtagagacctaggagaacctcagctgcctctttgggtaggctgaggggaagggaataggtcactttcctgcctgggtcaactccaggtgtttagggtttggctgaatctgcagagctctgggttctgcagtgattgtgggtaccttcacaaaggggatggcagtcctgggggttcatacagcatagttgtcgacccttagtggaacagctcagagtgctcctggagggaagggaggttgatagatggttatggcatgaggcattttcccctacctgtgacagctacagacgaggagttttggcccttgcccatcttccctgggcccattagcctgtttgaccctgggctgtagtgtggcctcttatgcctgtgtacttctacaggaatagtttctgtgccactcaagccgggggccggaactggggggccagcccccgaagcccacatcttttggttttgggagatagccctttgtccctcatctaatgggaggagagcttttactccactgtggtgacctggctccaccttccaccactcctcctaggaaggtggggaattcccactccaagctgtccccagctggagcaaatggagaagtaagagactgggaggggaagcaacccagggctgaaaaggatttgaagggcaggatttccagaaagtactgaggtgaggaagaaaaccaagactagggcagtgcagagtatctgggagcttagagtactgaacattctgccagcagcctggggaaggcttggcagggaagacacatgagcagtgcctccacttcacgcctctcccttgtctcctttccctagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgaggaccaggaaggaaggggaccagcatcaaggagacttcagcgaagtgaagacagaggcttgggccctcagtgctggctgagaaggagggagggatccctgactgcctcatctctcaaccaagggaaaactgaagaaacctttttgtgggggccttggatatataaccctcccctctgtgaaggagttcctttctttcctctcctctacctttcactccagcttctattcagttccaggcttggggttaggtctcttcatcctcgttctaatggccttaggaaaaaaatgtatgatgcaatcctgggtctagccaaggccaggtgatgttgctacttggaaattctaaaaaaaagactcaaaatgagctaggcctgcctagttaaaaagatgcaaccttggccaggcgtggtggctcacacctgtaattccagcactttgggaggccaaggcaggcggatcacctgatgtcaggagttcgagaccagcctgaccaacatggtgaaaccttgtctctactaaaaatataaaaattaaccaggtgtggtgatgcatgcctgtgatcccagctactcaggaggctagggtaggagaatcacttgaaccctggaggtggaagttgcagtgagccgagattatgccactgcactccagcttaggtgacagagcaagactcgtcaagaaaaaaaaaaatgcaacctgaatcccttgaggaacattggaatttctaggattctttaagtgaccatctctgccacatctgatcccaggattggccagccagcccttcagttctgtcattgcccagttcttccctccgtagacctgtccacagggcttcccatagaaacaggcccttagataactcctggggcttcaccctgcacccacctcactcaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccaggtaatgggaagctagtgggcagaacctggcacagggtgaggagggaagtggagccacttgggtgctgcgcatagatgtcaccaagagggcttagagagagcggaatccaaaacagactcatttagctttgggcaggtagatatggggctggcaagtgaattacatgatttaccctccccaaacagattgtggtagattaggagcccaaatcaagtggcttctctgttcagatccccctgcagagccatctacagtattggagctgcatggagccttgttctcctgggacccagttggaaccagcctggagaccttcatcagtcatctcgaagtgaaaaaggtttgttggacagacaccctgggagagtcctcagactaacgagagagatgggaactcatgtcagagaagcagtgaccgagccaatcatagctgatggctctgcagctctaattgctgcaggagggataggcatttggtgagcaggttctaatcatgaggagatgacacctcacatctgaatctcagaatagttgcacctctctctggtctttaggcagcttgtatccatccagtccagaccaatgggtgtgcttgtctctccatgtccctcagaagctgcagcattcagaacaggccctggggtttatgtagcatctcccccagattggggatctgggggagaggcccagcaagtgcttccaagaaatattttgcaaatggggatcctctgtttaggctggtgaaaagcaatcacaccctgtgactcatgctacagcatacaaagaacttaaaatggggcattcctggcaataagccaactcctgttcacctcctgttctgagttttcactctctcctgacctttgtccaaccctgtgccccacagctcaacccggcattctctggtggtggctgaattgcctccaccacatttggctcacgtttctggcttgggctgtatgttttgtttttcctcttagttcaggcaagacaaggctagatttgtacaaaggaattttgctaatgtgttagttggggcttttttgggtataagttacagaaacacactagagctagcttaagcaaacaagaatttataataaggatgtagagatacattgcagaatccaaaggcaggaacgcagctggatcttagaaacagcccagaaccaggcctcaactcgcagagctctctgcttctgtgtgcctctctccctgtatttgcctggttctcttctctctgtggacacaccctccactgagcagaagatgtgactacagagaatgctcgagtttacaagttacagccaacaaggagaagctgcctctgggacctgatcccaaattcccatggaaaggtctcagaagtggtgcccacttgtagctgggtcaaccctggctggcagggttggggcatcacaggcagatagagcttctgagagcccagtcccttctagagaaggaactaggacttttttttttttatatttttttgagcagggagatagctccatgaacatatgaccaaaaaaaaaaaaaaaaaaaaaaaaggtaaacagaaaaatttaagccacagaaatagggatctatgcaaagctctgctttttcccctgagatatggtaactctagccacaggtcgacttagccaacccatcatccaggccctaaagcctggaattctacccttccctctcccgttctggagtgcctgtctcagagtttaccttggaagttcttgggtggtttcctcccattctctctggcatgctgctccccttcagaggcccttcacatagacagtgaaactgatagccactctgagtggagaaaaaaacaccctacttttctagagcctgatttgttgatcagcctgtgaagcggagaattctttccctacacactaaagaaagaagaaaagagaagcctcagtgggaggactggcagcccagagtgtcaagagggagaccactgccacctctgtcctgtctcctaccaatagcagatgcttgtgtggcttccttgcagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtgtgagtgcctggccttgaaacctcttagctgcctgtttctccagtgtccctgacacctcaaaccaggagctttgcttttctggaaaggggttgcttctactcgggcatcacttatctaggaatggccatcggactgtggtcctcccagagtgtccagctgccccttctgatagggcccagtagggtggtgactgtgtgttctgcacagttgtgggaagagccctaaggcctctggagctagggagggttccacctgtggggcttagctctgcacagcctggctccttgtccccttctccatacccacttcccactgggaaggcttggaagagtcaaagtttcatttggttgcaggttaccctagggaaacctgccaagctattagatttccccttgcccccagtccagagtactatatttataggagaagagattccagatttctcccttgacttcccacccaaccctgctgtccccttcagaaatgtcaccaccactaccctacccaggtaaatgtggaatgtccctgaaaaggagcacttttaaccttgaccatggggcattctgtatccagctgtcattctttttattacttttttaaaattgattaatttttttttttttgagacagggtcttttttctgtcccccaggctggaatgcagtggcgccatcttggctcactgcagcctctgcctcccgggctcaaatgatcctcccacctcagcccctcaagtggctgggactacaggagtgagccaccacacccagctaattttcgttttgttttgttttgttttgtgtttttgagacggagtctcactgtgttgccaggctggagtgcagtggcacaatctcggctcactgcaacctccgcctcctggattcaagcgattctcctgcctcagcctctcgagtagctgggactacagctgcgtgccaccatgcccagctaatttttgtatttctagtagaaacagggtttcaccatgttggccagaatggtctccatctcctgaccttgtgatctgcccaccttggcctcccaaggtgctgggattacaggcgtgagccaccgcgcctggcctactaccctgtctttttaacagtcaaggtagtaagatatcttgggcagattttatgtaaaagcttttataggtttttactttttcgtgtgtgtgagacagagtcttgctctgtcgctcaggctggagtgcagtggaatgatctcggcttactgcaacctttgccgctcgggttcaagtaattctcttgcctcagcctcctgagtagctgggactacaggtgtaagctgccacgcctgcctaatttttgtatttttagtagagatggggtttcaccatgttgcccaggctggtctcgaactgttgggctcaagtgatccgcccgccttggcctcccaaagtgctgggattacaggcgtgagccactgtgcccggcccagctttcgtaggtttttagagaaggaatgtactacctctaaggcttcttgtggcctcaggaatgggctactaagcaaagggattcccttcctcacgcagaggaagcacccgtgatccactagatggtgagtcccctgagctaaaagctttgttgttcatctctttccttagtgcctacaacagtacctaggacctagcagacttgggaaagcaatgaatgattggccaggcgtggtggctcatgcctgtaatcctagcattttgggaggccaaggagggtggatcgcttgaggtcaggagttcaagaccacccagggcagccaggcttaacagtggtggctcacgcctgtaatcccagcactttggaagtccaaggtgggcagatcatgaggtcaggagttcgagaccagcctggccaacatggtgaaaccccatctctactaaaaatacaaaaaatagctgggcgtggtcgtgggcacctgtaatcccagctactcgggaggctgaggcaggagaatctagcttgaacccaggaggcggaggtttcagtgagccaagatcgcgccattgtactccagcctgtgcaacagagtgagactccgtctcaaaaaaaaaaaaataccagaccacccagggcaatatggtaaaatctcttctctacaaaaaaaaaaaacaaacaaacaaaaaaaacaaaaattagctgggtgtcatggctcacacctgtagtcctagctactctggaggctgaggcaggagaattgcatgaacccgagaggcggaggttgcagtgagctgagatcatgccactgcactccagcctgggcgacagagcaagactctgtctcacacacacaaaaaagtaaaaacctataaaagcttttacatcaaatctgcccaagataccttactaccttgcctgttaaaaagacagggtaataggccaggcacggtggctcacgcctataatcccagcactttgggaggccaaggtgggtggatcacaaggtcaggagatcgagaccatcctggctaacatggtgaaaccccgtctctactaaaaatgcaaaaattagctgggcatggtggcacacgcctgtagtcccagctactcgagaggctgaggcaggaaaatcgcttgaacccaggaggtggaggtttcagtgagctgagattgtgccactgcactccagcctggcgacagagcgagactccgtctcaaaaaaaaaaaagggtagtaaatgtaacaaagtagttaagaatctgaatctgaacttgtgtcctgccccttactagctgtgggccagctagttaatctgtctgagctttggttgcacctgagaaaaggaaatgataccatcttcataagattacattggggcttgaatgagagaatgcctgtaaagtgctaggcacatagtgttcaataagtgcttgatgttattggaattatgtcttgtctcctctgactagctcaccccaaatttaagtctactctcctcaagctccctacttctcttgactcccactatctcctgcaaagggataggaagtgggccagaaggtaatgggagctccctgacccactggggcacctgttccatcagatcctgcctgctggagaccagacagaggtgggggagaagggtgtcacccttagcggaggacagcgtgcccggattgcccttgctcgtgctgtctaccaggtcagttaaagatggaggttgcagtggcagggaggtggggggagtccagagccttgggaacttggctgagttaggaggataggaatattttccttagcatctggttccttccctcctcccttgcatgttcctgaggtattggccatctcatccccttttgcagatttaaggcagagttcaaggcctttaaaaagtatttgtaggctgggcatggtggcttaggtctgtaatcccagcactttgggaggccaaggcaggaggattgcttgggcccaggagtttaagatcagcctgggcaatgtggcaaaaccctgtctctacaaaaaataattttaaaaagttagttggtgtaatcctagcactttgagaggccgaggagggtggatcacttgaggtcaggagttcgagaccagctgggccaacatggtgaaaccccatcgctactgaaaaacatacaaaaattagctgggcatagtggcacatgcctgtaattccagctactcgggaggctgaggcaggagaatcgcttgaacccgagaggcagaggttgcagtgagccaagatcacaccattgcactccagcctgggtgatgagaatgaaaccctgtctccaaaaaaatttagctgggcttgatagcatgcacctgtagtcccagctactcaggaggctgaggtgggaaggatcacttgagcctgggaaattgaggctgcagtgagtggtgttcatgccactgcactccagcctgggcaacagagcaagaccatgtctcaaaaaaaaaaaaaagtgttatatgggctgagggcctgggacctaggaaagctgagtgctggccctggggtgctgttctttcttgcctgaagggatgtccaccctcaggtctcacctccttctctgctagtgtaggggtagcccccagagtttctctcaactgtcttctctgatcactttgagatcttctccggagagcctttgggtcctggtgcccacggtaccctcacgtctccataggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggtaatgggggcaggagccccgtgtgagggaggtgtctgcccaggtctggcaggggattgtgaagtacagactctgccccctgctgcatgtgtgccctgagccagtcattgctgcctcccgccttcacagaactggtgtgaggaactgggagaacaggagggaaaaggagtacgttggtaaaatgccagtgtatttgggactcatgggctttgtgactgggtgctcttgggaacttaaaggcccagggtctctgagaacattctcatatcttcagagaagagaaaggagtcaggtttagaatggtctttttgtaaaaacaaaaatttttaaactctgaaagatttttatgcagagggatgtgaccacctgcaagtttactgggagagaaataggaggaaatgaagctccagccagatattaggaattgagcgaagcatgagaaaaagctctgcagtaatgagaagtaaccctggacagagtggcaggcatagctctggcggtcctcttggggatggacattcgtccctctctgctggtcggaatcaaggtttacaaggatggacttgagtcctgctcgaggtctaggggtatccagagcagggtgggttagagagggaggcctaagagtcctgctcgaggtctaggggtatcctgctagggtgggttagacggggaggcctgagaggatgagaggtgggatctgcacacgcactgagaaaggcatagtatagactcagaacagtcctctcccaatctccccttctaccctccaggacctccctctgagattctgccactggtacaagctgtccccaaagcctgggctgagaatggacaagagtctgactcaggtatggctccccagtgggagaaaagggcttgcttttccctgccacactgtagagctttttctacaacggctgcccgctcctctgaaatactgagttttcagctggcaccctgcaagcttaattcttccatgacccctgattctcacagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaaggtgagagcgtgcctgggagtctcttacatcgtaacggctgtgctgtctaggtgcccattaccttgcactaatcattacaaagcccagagactcaccaagcatgggtcacagctgggacaaaagccatactcctaattctgagagatgcccaggggccagaggcatgtgctctatagctggcttctgttctgccccctaggttagctcccattctgcaagtctgagatcctgttctccccagagctgaagggtgacgggcctatgagagaagcccacactagggaggatatggggtagtggcagggtggggaggccaggccaggcggatggagatgggcaggaaccagaggcaagggcggagaaagggggcattggaatagaatgaacaagggagaggagcctcttacagctttttccttcctgtccccacccagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctagtgagtggctggggctgggggtaggcctggtgctctcagagtggtcgccaggcagggagtgagggttgtggccggtattccagatgctgtgacttctggagggtgggagagatggcatgggggaggagaaaggacccccgagtggccctagttttggttaccgacagccccctcctcaccacccagcatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggtgaggggctgggacctcgggggtaggggagtgcagtcctagcccctgtggagtgtcctcccaatactcgggctccactggggatgggagagtctttcctgccctgggatattcttcctcaacctctgccaatctctcttctctgcccccaaattctggggatattttagtccttccctattctctatcttgggccttcccctccaccccacctcccccagtgctgcctgccaacccctcttctgccagactctgccctggcccaatcagcgtccttctcccaggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtgtgtgaaccagagcccagggggatgaggtgttggggggagaggaaaagagagacccccaagaagaggaatatgcagggtatggttggttcagccctcctggggacaagggatggggaaggaggaaagcaacagaagaaggagatagggaggcagagtggacccccactttgaaagagcacactggcatctgcagccctgagggaggcctgtgggtatacagaccagctcccaagaaggagctgctcaataagggccttccctgttgaggccctgaggctgggtggctcagggcaacagtggagtggcttcacatccctctggccttccctaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccaggtgccacccaggacccctcacccctacctcatccacaagttagtccaccgctctcccagatctctccctgcaccatccccccaacattttcacctcccacccagggttccctgtgaggatgtatcatgattatcatcatcacccccgtttggagttgaggagacaatccccaggagggacttgcccaggtggtggtggcttggggactagaatgagtcttctgagctgctggtctcagtcccttccctgcttccaccccgtccccaccacactgccccagcccgcttcagtctcccacatgccgtccctcccagcttctccaggcccaccccctgccctgcatctggcctcctgtgctcctggctaggtcctatcaccctcctgcttctctgttgcttttttgttttgtttttttttttgagatggagtctcgctctgttgcccaggctggagtgcagtggcacgatctcggctcactgcaacctctgcctcctgggttcaagcaattctcctgtctcagcctcccaagtagctgggattacaggcgcctgccaccacgcccagctaatttttgtatttttagtagagacagggtttcaccatgttggccaggctggtctcaaactcctgacctcgtgatccacctgccttggcctcccaaagtgctggaattacaggcgtgagccaccgcgcccagcctctgttgcttcctttaaatgccagcagtccacagcctggggagtctcccacaaacgtcccggtgtccaagctctcccagcagctggtacttctctcccccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcaggtgggcctgtacccccaccccaggccaaagctctggaaccctgaaggccccagtctccctcacaattcctttctttttgcccacccatctttctcagctcccataacctctcttcatgatgaccacaattcttcaccatgtcccttcttccccatctctcattctctcattcctctcacactgtccatttctcattattctcccctcctcaccatcgctcctcatctcccctatctccctttccccgtctgtctcccacccatggaccccaccagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcaggtctgggggagatggacttgggaggggaagggggaaccagaactactggcacttagaggagggcatagccaggaaggctttatataaactcacagcagccagggctgatcagggggctgaaatggaggacaggatgagcaggcaaggacagcgaactcctagtgcccaggtccagattcatggctggtgatctcaaggtcttcctcgccctgacccaggccacctttccagcttcatctttcttgtacttcctaccatacaccctccactcttgtgccccaagatactgatcccctgagtcctaggctcagcaggcagtgcttcagacagcttgagacctgaaccggttgcccttggcttcaggtggcctcactggagggtatacaacccttccttacctccaggtcaacctagtatcattttctctgagtacggtgacatggaaaaggtagggaagctgtatcctaaagccctaggcctgcctcttctgccttctcttctaagctgtggtggccctaccttatagctccatcatgtcttcaggacccaattctaggcccactccaaccttgaagtgtcacctgccctttcagtcgctctggtcattccctgcgtagccactgccacccctggagtcagtgccacacagtttagcccatttgttttgtctggtttgtgtgtgtgcacctccgtgaaatgtaggcaccttgaggacagagtccagcctttggtttctttggtattgctcatagcactggcacagttctaggtacccagctactaacagatcatttggtggggatggggtggggagcagagtggggttatgttcaggtctcatacccaggctttcatggaggtgctagccctgtagtcagaaactgagctgggagcagaagtggctacatctccaaccactagactccatgtcattgtcccccagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtgagtgctggaccctgaccttagagcaagaagggagcagggatggcctgggccctgcaacgaagatgctttccttgcaggtggtctggatggtgagctgggtgaggggggccggagcttatctcttgggcagaggcagctgttgtgtttggccagggctctcctcacagatgccaaggtaaggtgagagaaagagacattagagagggccaggaagaaggctgggggccgggaggtggggaggtagagtggggagaggttttaggggaccaagttcattttccttttagagctggaagtggggagctgtggtaggggctgttgcttgggccaggcccaacccaccctgcagcctctccttccttcttatcccctaccccattcccatattccagatcctgtgtatcgatgaggccacagcaagtgtggaccagaagacagaccagctgctccagcagaccatctgcaaacgctttgccaacaagacagtgctgaccattgcccataggtatgtaaacgcctggtaacagcctaatcagggactgtggtagcatgcaccgagagcctccgttgctttcagggaccccagtggtcagggccttagagatcctgcccccccagatctcagctcctccttctccagggacgagaagggtcctttatagcactgcctagggccctttatagcacattatctgagggccctttatagcactgcctagggccctttatagcacattatctgagggactctgcagtcccttccccagcaccaagccaggggctaaagcctgtggggacagacctgtggtgtcccgaggggagaggagggaaagcaggtcagtgttcttacttagggcattgtccctcatcccctacactgaccatcttccccctcacaggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgt

SEQ ID NO: 37905 - DNA, 31511 bp, Homo sapiens
acgcagagcgctgctgggctgccgggtctcccgcttccccctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagacgctggtgctgctgacgctgctcgtcgccgctgtccttcggtgtcagggccaggatgtccgtaagtcttcccccgcccctgcctgcctgcctgctttccatgcgtccctcagcatccttctccccggcccgctccagctctggagcccgcggctccgggctaaaacggctcccggggtcgtagcgcgccgacttaggcacaggacacgcagaagttcaccaagaagagttctgccaatcaaggactctgtcccagggtcctcggtgcccatcgcagttgcaagtatttgcaggtccctacgttgcgctagaatactgaacttgcaaagtgttggctcggagaagtttgcgcacagatataaatgggctcttttccaccagctttgataattaggcgcacatgcacacagctcgcctcttcgaagcacttcgagttcagcaaaaacagatctcaactcatcgaacttaggtgaagtaggaaagagagagcgcgagcgagggagcaagcaaacgccaaagggttgacttcacagcctgtccaaggcttggtggctggtgggctcaaagcagagttagacaaaggggactaacactctgacactggtgggctgaaatcccaggccacaaagaacggcttccgataggccctctgagacctcagcgcctctttagggtaccctccccctcccagctggccctggagcaaggtgcagccctagcgctcatctcgacttccctccgtccgcctgcgcctctcttctgataaagggtacagaaacttccagtaggagaggccatctgaaagacgataacattccaaccagaccgtgcttttcaaatgcccccgaaaatagcgcccccttccccgcggtcttaccccattccccgccgccccgaggtactacaatgagttacttttctaaattctggaactcaccgagccaggctgcgtggtgtgtgtgtgtgtgcgtgtgtgtgtgtgtatgtgtgtgtcagggaaggggagcaggctggtcgattgctacggttgctacaactatttcaaccggtatagttagagatggctcttgtagtcgggtccaaatgctgttcggactgcacctttctacccctcctttggtaaggtccactgtctgggattatattcaggacaaacgaagcctggaaagtgtattaggtagagaggatttttttttccacgtgtttgggcacgtttccgacggctgggattccagccctgtctttgtatgttacagattgtaaatcaatcgcagagggaaactcttcggcggggggaataaaagttctctgccttcgaggctctgtgggccctctcctgccaccaggctgtttccagggatagcgtggaaggcggcgggctcaggcgggctttccggtcattagcgcagcgggggcagggctggagcctgcggcgcagctgcgaggagccgggagcaggagactctggccgggtcacccggtagtgcgctaagctggaggcgcgctcctgggcatttgaggaatacagcgtgactatacgtggcctggactcagactgactatatttttgtactacatttacaagcacacgcccacaaagctgtcttcttgactgacccctgccttagtgcgcaatggaattagctgggtggctttaaaataattctcaaattctccatccggtattagggtcgcttgcttaattaggcggtagagctctctcatcgccgcatctttcctgggagggagtgattccacagcttctccggcccaaaccttccagtcgctcctcctcccagagggagtgtgattctgcatccgagaggctgattttgcgccctggagcatcccaccttttataacttcccccgcctggggtcagcggacccaaaggtgtgacgtggggaaatgcgcagtctgcgtggacgtcaggaatgtcagacacctagagctcggccacacccctcctctccatctttccacgagtttgagaaacttactggcggcggcgtctttgaccctcatctgcatttcagagccctcgcctccgaaagtgcccctggctcaggggagagatctcaatcctcctttgtgaggcttgtttgcattgggagattggcagcgatggcttccagatggggctgaaacgctgcccgtatttatttaaactggttcctcgcggagacctgtgaatcgggctctgtgtgcgctcgagaaaagccccattcatgagagacgaggtccagtgggttctctcgtactcccagaccccctctcccacaatgcccccctgtgcccgcccgccgccacctctcggctccagccctgcgcagagcggcggtgaagcaaaacagttccccgaaagaggtagctttttaattggcttgccacaaagaatcacttatacggccctgcggtaatgaggggaaccggatcaggcgcgccgggatgctatcggcagccgttttggagcagcaattatggtggtgctgggctcctccgtccacacctaggggatccggttacggcgctggctcctttctggggcagtcatttaatcccacttttcactctcccggtgtctgtgagcgagccgtgtccagagccgcagccacagagtcactcagcggctcttacacccagcgcagcctggccccgcccctgcgccggcgcttcccgggccgcccttccccgggaaatctgatccgcacggggagtggcccctctcctagcatttccccctctcctccctgggtcctcatgggcgagggtgggctctcctgtagtctgggctggagcgcattaaccgatgccccctctcccacaccttcctcaccgcctgcattccactgctccagctattttaacggcgggtgtgtccccgcaacttctgtattttccctggaatccctcaccctcctgtgattatcttgcccaaaggctaggcggatttcttctagtgggaaagtaaaaaggaaagtttatctttggattttcactctctttaaagagcagtgggcaggctcgtttctttctcgccctctgggtttgtggctctttcctattattcatcccctgctgctgctattgccttggggattttgatgagaaaaacagcgctgggcgctccctagcacgtggtgcgggctctacagcccttggctgctaaggagcgctcttgtcagcacaggtttcatttgcagcatgaattccagacggcagggcgctggtggaggagactagtccctgctattcttcctctgcagtcttggaggaggccaggcctggactggccaatcttagccctagccaggtattcaacgacccctgctccccaaactggggtgctgttttcagatggaggcagggcctctccaggcagggctacaggtggaggtcagcactgggggcgctttggctccactggcctcctaagcagtttattagcctgcccaagccccaagtgtattgtttgaatgggtctatccccctccccaaattggtcctaattctaatatggttcaaagaatgagacaagatcctaattctaatagctcgtcttttcacccccctttcttatatacctatttttggagcctcactgcttatagattccaatttttgtaggtagaattttctacattccctctgaatgttagttgtcagttgtatttagctaatcccataattcccagaggaaggcagaagaaagaagacttctctgctcctgggctggtggaagggaggtctcgccatttttctgtctcctttctttttatagtcccagaattcctattcagaatatcttgtctcctcccttccgctcaccctccaactccctccacccactccatcacctggtctcccccgtattaggtgggtaaagagaatatagtatagtaaccccccaccttcattgctgggtcaagattttcactggtgaatagacaacatggtgcaaggtgcataataaatatttgttgaatacatggaaaaatcaatgatgttttaggaaaataatttttaagttctatatgtccaggtggccccagcctacattcttcagcatttgaattctgtcaagttgactgcaacctctctctttttctctctggctccccaccccctccttcccttggctctctgcttctccctccccacccttggtgcagaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaggaaaggccacttctcacttgcaggttgaaactgagtgaacgagcctgagacactagaggggtccttctttgcccaacatctccaaaaacatttgcttccaagacacatgaaggacagatgtgattctacaaaaaaaaaaaaaaaaaaatcctctctgaaatcatctctgcaaattactagagccactatggagatcaaatgctctgtctggccaatccacgaattaattcctcctctgccaccgacaccttgtcttctccttagaagacttctatgtatgtggtcttcagtgtggagaaagctctgccagctagtggggagactgcaggggcagaggctccctctttgagttatggaacattggtggtagtttcctctctgctattacctctcttggagttgaccattaattcagaagcaaaataataggagagggaagggctaggctttgggagttctcgtggggacgggtggagacagagccccatgtatctgcactgtagtgggtggttataaactcccagttagatccagtgctggtggatgatatatgtgcaggtgaccccttcccagcattcatacagatgtcctatctccctgcagagtgagtggggacgcttgtgtaggttttttgggtagctcttgctgtccgcttcctgctgaagtagagaaggccgtggcaagggaagtgagaagctgcctttccttaacacttcaccaacactggctccctaatgtgcagattcccagatcctttctgaggggcccgtgtgagtgaagtgttgattgcctttactattttgctgctactgtgaaggagaggttattgactggggatggcacaggctatgatgctccgatgctcttcataactcatatgccttgctgtttttgtgtttttatttgtgcttgcttcaaggagacccagctctaatgtaagacctttctaagtacctaactcttcctctgggagggcttggggttcgggaacggctccctaccctgtggggggaagagagactgaatctgtgctttccttcttgtggctgattagatcttgagctcttcattgcctttttgtgctgcccttgctcctttcttttgcatgctgcctgctttttgaataacaaagtctgggtcacctccattcctcatgggacctcagcaaccccagggccacagtggccctaacaccccaacagaggggttcagtggagtcacaggaagctgccgccttccttgattgtgtccttttacttgtttgatctaatgagtgtttgagtgacaagaataggtatttttccatctcaagattcttaccttcttcttctctatattttttcccttgcagggcaaccaggaccaaaggtaagggctttcttctttttcttttttcatatttttttggctttatattttctgcttcaaaagcaatgctatgttaatccagtctgtgattttttagacatcagaagatatctgtttcagagggtacctcaacacaggggctgctggcagggttttagactaggggcttagtgggcttactcggcttaatcctgtgaatgtttcatgtttcagggacagaaaggagaacctggagacatcaaggatgtaagtgcaaattattctcacccggtattgcagctgctgctctaaatgggtcatttccttgtgctctcctctaacttaccatcctgtggggctctctctcacagattgtaggacccaaaggacctcctgggcctcaggtaagagagggagaaatctctttctccgtcccttcctcgctgcgcgcaagttactgatctgcaggctcctggccttgctgtcatcttaccatgttcttcaccttcagggacctgcaggggaacaaggacccagaggggatcgtggtgacaaaggtgaaaaagtgagtaaaaagcaatgctgcttgaccctggtggacttcccaggtcccccaaggccccaccatgtgtttaagggcctggtcacctcttaaagagcagccaagggacagatggctcttggagaaacactgcttcccattgatgcctttttctctttatgccaagggtgcccctggacctcgtggcagagatggagaacctgggacccctggaaatcctggcccccctggtcctcccggcccccctggtccccctggtcttggtggagtaagtatccttacttcccattccttcaggctgtccctccagaaatgtggcttttaaattgctgcttgcacttacctggctggctcccagggctgccagcagtgtgtacatagcctgtccatgggctttgccctcaggcctgtaatttagaagagtcacatattaggcatgagactgtggtgctaagggctggcttttttcactaactgggattctataaagaaagtcctcagttacctggcttcctggcatctgtaccacgtagttgatgctggggggtgggtgtaagggataggaggaaggatgactgggcacttgtatttccctggaagacgagtgaccactgtccttggaagacatttatccttggttcttgccaagtacattccaagcaactattcactctcatgaaagagctccactgagtgaaggtgtgtggctaaagtcaattctggaatcaaaccaatcaacaaattatatgattgcctagtttttgcaggtttgctattttgatgtttgctgtattttaaattcttaaactcaaatgggatcacagatgcctactacatctcttgctgaaatattccaagactgttgattttagtcttttgctgggcactaaagtcttaaagaataaagaacacccttagaaggtttggttatgtttctccatatacgttaaataacatctgtcatattttagagcataaaaataattttataaaatgaaatgcaaggaactgatacttcctcaaataacactttcccttccagtgaaatgattttgccactgtcatctaataatccattcccaaaattactttccaggcatcagtggtaattctgatcaatgataggttagtctccaacaatcagagtttatctcagtagagttctttgtatccatatagagcttacctagccaagtagggaagacctagtgcctttcaacctcctaacgttgttgggtttctttgcagaactttgctgcccagatggctggaggatttgatgaaaaggctggtggcgcccagttgggagtaatgcaaggaccaatggtaagaaaagacactagttctttgcagccaaaatggcaggaggtggcccttagcagagccagagagtctgacaacctctgctttacagataattgcttagagtggctctcctccgtagttatgtaacctcccattcagctagcccaaagcatttggtttttaatggcaatggatgccacttttaatgatgcgctggagtgactaagaagaatgaagatggggagatgcatataggctgatctgttagaagaccagttgctattgctcttggaatgagaactgaagaatgcagacagcagctactgttctccagcatccacagacttccagcaggaaatctcagcccgcagctctgacttggcacatgctaaatgaaactcagcctttagtaaacatggctgctgtccaggagaaagcaaggccagcttttctgtccaaatggtgcctataaataaaaatagagtgttgcgtggggagtgggaaatgagagggagcagccactctaggccccttgcccacagagtaacttcttgtcctttgcccgggctgttggctgggagaagatggcacactggaggccactgaggaagcatgtgtagtaaacccctcattttctgttccgatgcagggccccatgggacctcgaggacctccaggccctgcaggtgctcctgtaagtatctgcaattctttttgcctccatcgtgtcgcagatgattcccaagcactatgatgttttagcagtttatagggattgacctggtatcctcattttactttttaggggcctcaaggatttcaaggcaatcctggtgaacctggtgaacctggtgtctctgtgagtaccagcacggccctgtcccttctctgggggagcctctaatgatagaccactaggaccgcagctgctgtccctcccaggctctgcccagctctttcccacagtcggtggccccaaggaaattcggatgtcacttcctagctgtggaggaactctgacagacagcccaatgtggcaaggaccaccagggactctgtcctaacagccccctttccgggtcaccccagcctgtgctatctgctgcgtcccactatgatctctgcacctttgctctgaccttcccatctttcttcttcatagaagaactggcttccaaaactacaatgtcaaagttttgtccattgcttaggtgtcttcccactataaccatctcttaaactatcttcctttgtttgtagggtcccatgggtccccgtggtcctcctggtccccctggaaagcctggtgatgatgtgagtatacacgagtagacaaatgaggagctgcctcctttgaaagggcctggagagggtgtgtgcttggggagtgacagggaggcacccagggtggaggtatcttgaggagcaagactgggcagtcccaaaccctgacgccatctcctatctatatggccactgtgactgtgctggcaagttccctggggaccgctttggatccaaggggaagacaaataattaaaacatcattagccccaggaagggaaattgagaaatgagagaagggagagaaaaaatacaaggcagaaagatgtagagaaggaaaaacaaagaaagaagcgttcaacaacccagcattatcttaattgtaaatgagttagaaaaagcacagcctgagtcaggatgtctacaaaggatgcaaacgaaatgaagagacaagaattggcactcttgtgctatttttatgaattgcattagacagtaaaagtctcttgaggttagagagagcacatacagtcagcagaacctaggagaggagagaaaaagcctctcaggggaagttggaggctggtgaggacagaggagcttgcccatgggctatgcatgtgtccaaaagaataaatggtgacccatgaaaggcatccaggcacgtggagtctgaaggaggtgagggagatgagtgagccggtaggcaaaggcatggagggctggaaggagggaagccctctggggtgcccccactatgctactgcgtctctgaggaagctgggatatctctctctctcccttcagggtgaagctggaaaacctggaaaagctggtgaaaggggtccgcctggtcctcaggtaaacgccaccgttcccagcctcaggcatctttcctagcgtctccctccctgtggccttaaacacagtgcatccagttcaatgaggtcacttctgagatgaaacgccagtagcccctatatttatcacgaccatgtttgtaatttccactcaggctctcatgagggaggctgggcagttgttatttataccactttgcataaaatggggggtacggggaggggtggtctgggttttacagaaagagctgtccaagtgtggggattcgagacaacgccctggtggcccaagggaactggaggccctcctgcagcccagggcagctttccactgttattttactctgtgctctgaacacctccactttggattgcagggtgctcgtggtttcccaggaaccccaggccttcctggtgtcaaaggtcacagagtaagtatcacgggtgagaaggttggaaggaagagatgcctggtgggagagaaaagcactttggggtgcgtgcatttcttccaacttgggtttcccagaagtctgattgaacattttctcttgttccctagggttatccaggcctggacggtgctaagggagaggcgggtgctcctggtgtgaaggtgagaggccagaaagtacaatgggatggggaggagggagacaatgaggagcccctcttcctagccagggagacactgtggagctcagtggaactagctcctcagaacagccttggctgggaacaccagccctacatcctgatgggccaacagcaggcctggagagctcagggcattgtccctcacaggactgaagtttgtgtcagtgcgagctgagatgaccagggcttttggcgtcttccctaggagtttgctggcggccaagaatggggtcccagacactgaccttgtgcatcatttttccagggtgagagtggttccccgggtgagaacggatctccgggcccaatggtaagtatggacaccctccaggaaggtttatcaaagactcttcagactatcagatggctgcaaagagctccctttgtgcaaagttcatattctgtgttgtagatttcatctgattgtgagcaaaaagcaaaatgtattagacagatgatttgttcaagatttcaccaacatttccttaagatacccattttatcacactaaagatgctcccatttaaaaaaattctgttgagtctcaacattttgtcaagctcatctactgcaaggagcaaggtgtgcttgtaacaaaggttcccaataggtagcaacaggaacattcgtgtgttccgcctgtggagaaaactgttgggtgtgatctgaggcatcctggctagtcaaggagccagcaccatcaggaggtccttgttttcctgggtgtgggcatcctccctctcctctggtatccgcaaagggcctgcaggtagaaatggtcaccctgagcaccgtaaagccaactcatgcttaggctgtcctggtgtgtgttccagggtcctcgtggcctgcctggtgaaagaggacggactggccctgctggcgctgcggtgagtaattgacaaagccaaacaccaccatttgccgagcactttagagtttacaggtttgtttctcttgaccctcgaaacaaccctgtgaggcatagggagtattgttatcccttaagaattcacccccagtgtgcccatcaaaacttcccaggctgagtctgcacagttgaaggaggaaggataggaatgggagggtcgatgggtgaaagcatgattctcttaaccagtccagattatcaggtaatcccttcaacaaccaccacccactccctgggcaatccagctggagtttacagacagacttagctggctatagcaccaccgtgctactctctgttcttcctggttgctcaaatgccctagaaaagtggaacaggtgagcatcaactcacagggctctatgctggctgctgctgtgagggatgttatgctatagtaccaggggccaccattccataggcacttcctgtgtttaataccctatatgctttacttcatctcatcttcctccatatcctgagaggtggttctattcttctccccattttacggatgaaaaaaccgagacacagaaaggtgaaatagcttaagataaatagtgccttgcagccttagactctggtggcctctagttaatgtgggaaattaagggtgaggggattggcagctgatggagggtgcagggtgccagacagaggcgtttagctctgattccttagcaatagagagtccttgtaggcacttggtcaggcgagtgatgcgatgaaagctgtgtttaagaaagattatgctttctgctgatttcatacccccaacacccaagctctgaggcccctcctcacaggtccttgcagggctggccaaaataaagcagcttcactccgttgtgctgctttccagctaatgtgtctgtttggcagaagtttccctcaaaggcagatcagtgaaataagcagaagcctcgacccccctttgtcagccagagctgctgaagtgccttgccccagggtcactttgtgtgaggggattagagagcactggggctgccaagaaacactgccgtttctacagattagcaggatgctggcttgtggccttttagcgaggctcagagctgcggtggccctagtctgcatgggctaaagacaagctccatctcctgtccttgttccctccttcctgggcacagccgccctgcttcttggttctctctgttggttcctgtccgcacggtagttaggctggcagcgtgtgtaggatttggcttagaagattgacaacattgcctttgagcccttctttgctactcctccctctcccctcccatcagactcctctctggagtctgctctgcgaggcctctgctctgtggtatcccagcagccttctcagccttgacttccagaagggggctgtgcagtgtccggggtgtgcaggccccagacacggggtaggctcatggagatccaagtgctgatctagtgtcaaggctggcctggagactgggctgggttggtgtctgcctgctgtggtcatgtgccctcccttgggcctgtatcctctctccagacttgctgcagggagaggtggcagatgtcagcctagttctggcctctcagagcagcatggcagctccctttcactcaggcccaggctgggccctcctgctggctgacccctggggagagggtgctccagagctccccaaggaactgcttcccgaagcagccaggccagcccagaggggctgtggccaatcctgaagctttatgttcctgctgacattttttctaagttttctcttgctttcctcttaaatgccaatctggagagtctccgttaggagaaatggaccccagccaggaagaagagttgagttgtatttaaaacacgagctccccctaaagcatccttctttagcttctaaggagaggcagagactgacaggcaggactcagcaggaaaaggtacccccctgacctgctcagtcaggccctaggcccagctccacccagcctgtggcccccagagtttcggtaaagagttccctgggccttaaggaaccttgagagagcatttgaggggtgccaccacaaacttggcagaaaaaaccctccccctccaagtccagtcctagagaaggagctggcaaccttgccttgctttgtaagcaaaagcctcttagggcttgagctcagatgtagtgtttgagctgtggctggtgccctgccccatcagggagccaatggtagacatcctatgggcatctttgttttccgtaagagcaggctgtctggggatgggccagaggaagaggcaacctggagtcaaccaagaggaggccttaaccaagccttaaccacagaggttaaccaagccttgaaagcgcttccccctgagcaggcaggaagcactgagtccacatggttgcctcgctgtttcatttccttacactcaattctctcagtctttaaatgatcacttggccttgaagttacggatatttggggtctgaactgaagttgaagaaaagagaaaatgatttaagctttgtttaagattaggggccaggtgcggtggctcacgcctgtaatcccagcaccttgggagcctgaggcgggtggatcacctgaggtcaggagttccagaccagcctggccaacatagcaaaacccagtctctactaaaaataacaataaaaaaaatagccaggtgtggtgacacatgcctgtaatcccagttactcaggaggctgaggcagaattgcttgaacttgagaggtggaggttgtagtgagccaagaccgcaccactgcactccagcctggcgacagagccagactccgtctcaaaaacaacaacaaaaaaagattagaagaagcccattactgccttctggccacccactcgcacagacaccaaaactgcagcccacacctcgccatcctcgtgctctgccctgggacaccccaggcacagtgtgtccttcgttttctgtaagggtgggctgggagcagggacggacagggcctgtgggcacctctcatggtcacttccttcttgctcacagggtgcccgaggcaacgatggtcagccaggccccgcagggcctccggtaagttcatttcatcctcagcaggtcattgttgctgtgctttaagtcccgttaagcagcccaaggcagtctgcagggtgtattgggtgcaaccacagcagcactctgatgtctactggaaagggggaggaaagagaagaagtttgtaaatatcaattgagcatatcgataacaagctttgaagcatgggctcattttcctcagccatcctttcagcagtctttttagaggagggaggtcaaaggagtttctgcttctcaccacagatgtagtcagaaacttgctttgccttctgaagccaggcaaagtttcctggggacgctggcaatggggacaattttcatccaaggccttttagccacaatggatatggagtgaaatcagtacagaggagggaaggagtgtgaggtgtcggggtggctcgctttggaggccagaactggcattcacctctcttctcatccgcctactctctccagggtcctgtcggtcctgctggtggtcctggcttccctggtgctcctggagccaaggtacgtgccctgttgtccagtcaggaacttctgggtgccgagaagctgtcctttccccgtaacccttgctcattgctccctcaacaaccacctgctcccttctgagaagtagctccccaccaccccacccactggcccctccatccaggcagggcaaaaagccagacactcgcagtctcacctggagggaaagtaagacagaagataaaatgtgggagatccagttacaactttggagtggggaaaggtggacagagaagaagacggggatacaccataggcctggcaggggcagaaggccaggagtggcagcacagggaagcaaacctaggggagacccaacagctgagcaagctcggggccctgacgggcactggagggaactgggcagggaaaagggcacaggcagggagcccctgctcccctctgggtttctgctttatttggggtgcctggctcttccaaaccatgttaacggagttctctggaggattactagaggccagtgggaggccagccagttcagggacaggcctcgcagcccaggaaggattccagtgtgaacgtccctgggaatgaataaggagcctccatgtgtcactggcatcaggttgcttttcccctcctgggggtttccatggcaaccagacagtgtctgaggtcccggagccgggtgaaggagacccattgtgaagagggacagcggaaggtgaggggggctgaccttttgaaaataataattaccacagtgaagcaggaatgttctgagaagaaacctgaggaggctctgccctctctccaggtcagcagccctccccagggactctgccatctagagtgggttgtaattttcaggaaaaaatgaaagtaaaagcacaagccattttgtggggagggggcttgccagaggcgcccgctaaggggaattgggctgtattgagagcagggaggggcagagtccccatgtgcttttgccttggctttctggcttactgagaacagactggggccggagccagggtgtcactgttcacccgtcagccagatgggagtgaggtggtgctctgagctgggatgttcagagacttagaagggacctcagctcctcaataaaatagaaaaacaggaggtgggggagagagcggtgtccgtccatcatcccacggtgccaggatggcagggtccccagcccacgcttttctgatggtgtcgatggaacagcaggttgcccattgctgtagtatgtagctgtgccgtggcatgtggaggctcactgtgtagagatgaggtaagcagtagaggaggcaggcgtgggaagtcatcaagtcatcagctcggtcaggcagggagaaaaacggcagcgtgaactgtgtgtgaacgcacatgttcatgtgcagggttgggtgcatgtgcataatttagtgctgtgcttgcagctggccctgagctattgcccacccactagaggtctgtgtcccctctcttcttcttcatttcatcctccctgtctcttcccagggtgaagccggccccactggtgcccgtggtcctgaaggtgctcaaggtcctcgcggtgaacctggtactcctgggtcccctgggcctgctggtgcctccgtaagtgcagcttctctttggcctgggggggtctggggtctgtggctttggaactcttgactctgtactttgctctgacagttgtgggctccaaccaccaaaccttcattctggcccaatgcctgtccccacctctagatgtattcccttctatcccatcttccccttgaaacacatagtgggaatgtccctgaaatggacagcacctatgccaggtccctggatctggatcctggagggctggaggtggttggggttcattctttgctgcttatttgacaatgtctcccttttcagggtaaccctggaacagatggaattcctggagccaaaggatctgctgtgagtgttgcccgtggactttgctaccccaggagagcccagtcctgcctctcccctctcctgacacccctcccttcttctcatgcccacagggtgctcctggcattgctggtgctcctggcttccctgggccacggggccctcctggccctcaaggtgcaactggtcctctgggcccgaaaggtcagacggtaagagcccaaagtgacccccaagttccactgacatctctggagtcaaaccccatcacccctctttcccatgctctcctgccctggcctcacagcggcctccatccgagggcatcttgaacaggggttctggggaggggcaggctccctggagagaatctggtgtgaggacctgcctctcttttcaagggtgaacctggtattgctggcttcaaaggtgaacaaggccccaagggagaacctgtgagtatctgcccccaagcccttgtcttctctgctgctgttctatgaggcacaggcctcagccccactgacccaccacctccctcctccagggctctatcccccaatctgggtcctttcagattatgcctggaggagacttaacagggctgagaaggcccagatacagcttcagctcccatccttggtttggctagtgtgaacagttggatctttagcccctctcacttccctctgccctgccatggctcgtcctttatggcctctcgtcctcaagcccccccccagccctgaaacagttgccaaggctacttccttcatactctgagtcgaggcttgctccaaggccaggtgaaggctcactctgtttctcttttttgctggtcctcagggccctgctggcccccagggagcccctggacccgctggtgaagaaggcaagagaggtgcccgtggagagcctggtggcgttgggcccatcggtccccctggagaaagagttaagtgaatgtggaggctccatcccatggggcctgtgacctcgagagggaagtggagtccttgtggtccgtgttctggtcaagtctcgtgacttttccgcatgtcatcctcctctttctccatccacaccgcggggagagggagtctgatcctgatttgtgccgccaaccaccagactgacatgaaatagtctgagctccttcccaggaagcggggcaggctccagaagttaacctctgagaatcctgcaggccacagctactgctccccagaaattggggttggtgggttagtgggatggacccactggagcctggctgggttggggctgttctcactcactgcctctcctccctgtggctccttagggtgctcccggcaaccgcggtttcccaggtcaagatggtctggcaggtcccaaggtgagtgggagaagaggggctggggtccctccctgcatcgctgaggtcacatggtatcccactgactccctgtgtacccttgtagggagcccctggagagcgagggcccagtggtcttgctggccccaagggagccaacggtgaccctggccgtcctggagaacctggccttcctggagcccgggtaagtagcagagctgctgttgcccttggcttcagaccctcaggcccttcctggctggctccttccagccctgcactgccaggattgggaggtcctggggccggctcctgaccccaccctcttctctctcctgaacaaagggtctcactggccgccctggtgatgctggtcctcaaggcaaagttggcccttctgtaagtctatcctctgagggctgctaggagggtggggggatctccctggggaagcaagggaaaagagagatggagtttgggttagggaggcctgaagtactgtgaattttgagaattgtgacagggggtagatggtaggcactggggccagatgtaacctgtgcagtagctgtgagcactgaaaatgccaccccagtatgcattcggggcttatccttgggggaatgatgacatcgtgtgtgcactttctggggcagctttctaagctcagcggtgtcttgttgtagatgggcccatgggtgtgatgtggtcaatcctagatgctgagcatgtgtggctggtgcctagtcctgggcctgccatgtaggcccttagtggatgttgggtggatggatgtggtcagagtgtctatgttctgagaatggtgttctgtctttcagggagcccctggtgaagatggtcgtcctggacctccaggtcctcagggggctcgtgggcagcctggtgtcatgggtttccctggccccaaaggtgccaacgtaagtaataatttgctcttctatttccttccatgtggtgctacctacctccctgccctcttggggaaagggctgggtcctgagtagagtttaaccagggacagtgatgagtggggctcctgtgccatgggtggcagtgggggtctgtatgtgatttggggaaaatccatggccccacagagcctcggggcattgcggccataattgttccatgtggcagtgcccagcaggctggttgccattatggcccctgaacagaagagaagggctgatactttgctttatcttggctgtccatcaggatgtggccccaggcctcagtccctgcagcccgctctgcccccaactccctcccaaaccatccgcctcatggccctgccctctctttccttcagggtgagcctggcaaagctggtgagaagggactgcctggtgctcctggtctgagggtaagtatccttccccgctgcccatgacttggtgttggccgggcatctgcagggaggacaggggaacggcctccccatggcatggtcccgggacccctcagtattgagtgttgatctctgtggctgagccccatgctggctgggccctttgggtgtctacacagggagacttctgtttgccattggtcagcaggccggggagctggggaaggcttccatgctgagaacagctaagaaaagacggggcctgggaaggaagggaggggaaggtgtggaaatggagctcagctggggtaccgtggaggtctggaaactctgggccagaagtacctttgcccaatcctagggggactgcaagtgggaagaaaagcgtgtcattgacttttctttttctcttctgtctagggtcttcctggcaaagatggtgagacaggtgctgcaggaccccctggccctgctgtaagtacctgcccagcctccccaggtggccctgggggcaggggctgggaggggtgggggtgggagagcccatccattaatggagctgacagatgtgaatgtgggctgagctgatacaccagactcactctgagctgaggcagggtgtcccaggaggctgtgtggacccacattggtggagaggagtgtgggtggctgatgggagtgcagggaggcatgcatgcactgtctgagtggtgcaggaagacgcctgtgctgcccaccctgctgacctcccctgggccctactagctgtggctctcagggtctctggaacactggctcagctcaccttttcttttccactgcagggacctgctggtgaacgaggcgagcagggtgctcctgggccatctgggttccaggtaggtggctggaccaggctctctgtgcagtcctttgccatacccagggctccctgggacagcagcaggcactatcggtggagggcccacacctcttgcagggtgccaggcatcgagccttccctgcacccctggctgtcactgctgctgcttcctttctttgggtctgccctatactgtgcctccctgggggccagggcagcaaactcactcctttgctaacgcttgtcacttcggcttctagggacttcctggccctcctggtcccccaggtgaaggtggaaaaccaggtgaccaggtgagtatggggctctttggacctgcaacctgtttagatgggaaggtcttttctgatgcctaggaggcaagggcaagagggcatgaggagccctgtgaggcctgggaatgtcctggacccatgtcccagcctccacagatgacacaatcccccatgggaggagtgatattcagccctgctgtggagaattgttcaggggtctgtgatatgaagccttcactctcacacatctttctttgttctccagggtgttcccggtgaagctggagcccctggcctcgtgggtcccagggtgagtatcctgttggccaatgcgggctgcctccttgggcctgccctgggtcctatgctcctgctcctttccccacctccctgcttctccctggaccttctcccccactgctgttggttgatcacttcttggtgtctctgccgcagggtgaacgaggtttcccaggtgaacgtggctctcccggtgcccagggcctccagggtccccgtggcctccccggcactcctggcactgatggtcccaaagtaagtgaggctgcatcctgtaggggtcttcgtggtagcctgggagtcccactgagcagggagaagaggagcgggctcaggaggaatgaagaacagaagtggggggagctggaaaggaggtctacatgggaggaagggaaggaagaggggtttggggccctggttacccaggctccatgaacatgggttcagggagaggtgctgtccactacagactccctcttacctccctccccagggtgcatctggcccagcaggcccccctggggctcagggccctccaggtcttcagggaatgcctggcgagaggggagcagctggtatcgctgggcccaaaggcgacagggtaagtactgaggttacagcctctcaccaaagctgtggctttgccacattcctgccccttgtgatcgcttccgttcccttatggcacctggtgatgaaggtttctgttagccctttttgaggagcttaaagactcctttccaaagctccctgccttttagtgacatcctttcccctgttccttcatctcacccctgctgctcctcacccaccctgagaccacagcaaattcctcttgggcagggactgggctttccctagcaccccagcctgggtgggactgagcaaaccatgggggtcctggggtgcctggctgaggcggctggttttctcttccctcagggtgacgttggtgagaaaggccctgagggagcccctggaaaggatggtggacgagtaagtgaatgcgggctgctggactgctgggcattaggatcctagccctgcacccaggagagcaggagagagggctgggcagtctgccactggggtccctggtcctgtctctgtcggggctgggcaactgcagggacttctctgttaaaatggggccagagggtaagtgggagctctggaggcggtgggagcacgcaccaaggttggcttggtgccgggccgcacgtgctcggctggctcagcctgcctccctcacctctacctgctctccccgcagggcctgacaggtcccattggcccccctggcccagctggtgctaatggcgagaaggtgagtcccggctcctttcctctccacaccttgcctccctgtcacacctccttcttatctcctgccaaaggcggttctgtcttgtcctccctcaccactgtcaccctcggccaaggccgtaggagtgaagagggggccctctcagaagtgaagccgctggcagtgttccctgttgggtggggcaactgggctggggtaaacacacattcagcagaggccctcgagagggtgcgggtatgggctgcacagtaacacaggctgtgccagggggacctggagcccccttcccacgagcaaggccccccaaatgcactttgccctctcccactctgcctccccaccttcttaccccagctcttcctcccttccccaccctcagggagaagttggacctcctggtcctgcaggaagtgctggtgctcgtggcgctccggtgagtgtctgcccctctgagcctggctctgcccgaggcccctgggaaccagagagccagggagtcagtgcaggccctcatgctgcctggtggccctgtgtgctgccaggcactggctccctccctacccgctgggtctagggtgggaggagagatgggaagggaagggggaaggcacgtcactcccatcatgtgttcagggtgagggcttttgggttaacagagcctctgcctgcgttcaggactaaggctgctttcagatccccgtctctggggaacaggaggctgggcagggcccaaggggctcttggaggggagcagaagcaggtcaggcagcggggcctgacctctcgccatgcccccttctctcacagggtgaacgtggagagactgggccccccggaccagcgggatttgctgggcctcctgtgagtatctctgtccatcctcctgggtccctccactcaggccagttccacatccagcaccctcgggcatcggagcttgtcagggagggaaatggatgctcctctcctctcctttcccgcctccatactaatagaaccatcatgtccagaccaggacacacacgcagatactcacagagtctcctgctcttctggaagagctccagggttttagcctgcccctcattcacctgcttcctccttcccattatagggtgctgatggccagcctggggccaagggtgagcaaggagaggccggccagaaaggcgatgctggtgcccctggtcctcagggcccctctggagcacctgggcctcaggtgggtaacgctgcactccaagaattgttccctcaaggaagggctcctggcgtgcagatgggaaggccccagcaggctgcgcagaggatggttcgcaggcctgggaacacccccatgttggtagaaggagcttccatgtggcatgtgggctgtgtgggtggggtgtagggactgacagagtacaggctggccacagccagccagaaccaagctgctgatctcctggggaggagggggcggtggcaggaagagcttcccgggaggccagaccccagaccggttctgtggttgcctgacaggcttctcctagaacacaagtctcctgtggcagaggggacagagctgcctgtggcagcctcttcaggctgggtttttagtgccaagaaagctgcatcttcgaaaacctcaggggtccattgttggggctcagacagaagcccaccgtcttccttgggccactgggcctcactgtctccctctttcctttccagggtcctactggagtgactggtcctaaaggagcccgaggtgcccaaggccccccggtgagtgaggcctctgacaccccaccctgcacctcacaaagaggcctggccccagaggctcccatggcgggggtgttctgggatgcccccgactgttttcccagccctgcgttggtccccagcctaagcccacccacagccaggtgggagagagggcgcctgtgggctgggtgcactgtggtcccggattccccagcccgaggcttgtccctcgttcagctccctgaagtgctgactgtggaaaccggaggcagggaaacagcctgtgcctgcttctatgaccagacccgggggccctttctccctccctggatcccccttgctgctttgcagtccctcgccctttccataccaggctctgagaccacccccgccccccgcccattttaatctcaaacctcctgagggcttgaggttctcaggggctctcctctccccacacagggagccactggattccctggagctgctggccgcgttggacccccaggctccaatgtaagtgatgctcctggcatgagaggcacaggcaggcatggaatagcctggcccagcacccaacagggtctggagagctccaggctggccttcactcctctgagtccgttcctgccccctggaggagtagctaactgatcatggggacctatcccctgagggtggctgggggcagggttgtggccctgctgtcagcaatgggtggctgccctgctggcttggtgggcaggacagggctgccatgattaccttcatcctggacagatgtttcttgagcatgttctgtgcacttgtctgtgtgctttaaagcaagtccgcatgtcctgggtcgctctcagggagtttgcatggagggagcagtggtgatgaactcactgggttcaccagcgccataggcagagggagagagtgctgggggcaagctcaggggtcagaggggcagggctggagcggctcctgaggaagggggattgaggacaaagggaggagggaggagagattccaggtagatgggagaaagcaaagcaagcaggagctggagaagttggggctgtctgcccagagctgtctcacatggtgagaaggttgcagcggtagattggggttgggggggttaagctgcctgcccttagtgtggggaggtagagaagcccccagagaggaaactgctgtcactgaggccacagtgactttggcagcctggatgaggaagggtgagatgagtcctcacttcccgcattttctccttctagggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctgtaagtccctcaccaggcccatgccaaggtccctgggagcagggtcgtgagtggcttctgagctcacagagcatggggtaggagggagcaggggccgtggggatgccagggagcggggctgcacagacagagctgtgctgagaggacagaagaggctgggccactgtcagttctcatctcctgcctctcctctctcagggtgccgaaggtccaccaggtccccagggtctggctggtcagagaggcatcgtcggtctgcctgggcaacgtggtgagagaggattccctggcttgcctggcccgtcggtgagtgtggggtatccctccctccatccaagctgggccctgcctgccaaggcttctacctccctcagcaccctcaggactgtcccttgtctgccctctccctgaagggtcagtgggccctgggcaggggtgcttaccacttgcactcatcatccttgtctctgtccctccagggtgagcccggcaagcagggtgctcctggagcatctggagacagaggtcctcctggccccgtgggtcctcctggcctgacgggtcctgcaggtgaacctggacgagaggtgagcagtgagaccccctggggtggccctgattggggagaggggccctgtgagtctctgtgctgggtcagcaaggacaagtcccagtcagggccctggagaagggggtggcagtgtcggccgacaggcctgaaagcctaggtacaatgggaaggttgtcggggagagagacgggcatagagaccaagggctgcttccggaaggaggagggaaacttggtgaggaaactttggcttcaaagtgtgagtgagttgggcagaagaggagaggcctgggcttctgagaggggctgggggagcagagggggagatgggcaggaagcagctctaagtgcattcttgtttcactttgtccagggaagccccggtgctgatggcccccctggcagagatggcgctgctggagtcaaggtgagtgtctggtgtctgtgtgtgcagtgggttggggaggacattgcctcgggcctgacaggtcagctgggggtggcaggttggaacaagtctcatctcagcctagaaggaccttctgttcctgtctcttctggaacattcttctctgagcctgagacctctctcctgacagggtgatcgtggtgagactggtgctgtgggagctcctggagcccctgggccccctggctcccctggccccgctggtccaactggcaagcaaggagacagaggagaagctgtaagtatcctgaattcagtaaaagccgccttcccctgcgcggtggggctgaggcagtccctgggtttccgcagtctctggactaaggagcagtggcctcagatgcagaggaggcccccacctgtcctggcttttctctgacgctgcgctcactctctcctcagggtgcacaaggccccatgggaccctcaggaccagctggagcccggggaatccaggtgagtatccaagtgtcctgcactgagtccccaccagggataggctgggagggcagccagcctccaggtggttcctgggcctccagccctgtgtttccggggattcctcagcttgggtgggacaggagggggctcctgtcctggccctgacctgactcaatcggtgtctgtcttgttcccagggtcctcaaggccccagaggtgacaaaggagaggctggagagcctggcgagagaggcctgaagggacaccgtggcttcactggtctgcagggtctgcccggccctcctgtgagtgtcactgcctgcgtgggacttcccgaggcctcctgccacacagagcccacttgagctccctgtgctgccaggacagcttgggatcaccctaagcagtttctaggatttcctcagggctggagggaggaggaagtggaaagggaatggggctgggacataaagctgttcccccagctcccagaatatagatagatatgtctgtgctgaccgtggccttttgcctcttccttctacacagggtccttctggagaccaaggtgcttctggtcctgctggtccttctggccctagagtaagtgacatggagttggaagatggagggggcccttcagagagtgtgggcctgtgttcccatggggagggaaatgctgctgcttctggggaagctgtgggctcaggggtcctcactcagtaatgggggcaggactggctcatgtgcctatggccagaaaagcgcctgaggccacaatggctgtaagacaaacatgaatcagcctctcgctgtcagacagaacagcattttacaaagaggagcttaggagggtaggcaagccatggagctatcctgctggttcttggccaaatagagaccaacttagggttccatgactgagcatgtgaagaactgggggcggagtggctggtgctatcaggacagccacctacccagccccagcgactccccagccttccctgtggtgaccactctttcctcacgacctctctctcttgcagggtcctcctggccccgtcggtccctctggcaaagatggtgctaatggaatccctggccccattgggcctcctggtccccgtggacgatcaggcgaaaccggccctgctgtaagtgtcctgactccttccctgctgtcgaggtgtccctaccatccgggaggcttgagctcttttttgctcagggcctcttttagggcatcagcctgcagctaacagtgatggcatcctttatcctgaggtctcctcagaggtcacagggcccatgatcagtgctgggaaactgaagagaagggctaaggaagaaatagacatggtgctgtggtttccttggtcctcgcctgctacacctccgccccacccatggggctgggaagagggacactctagtacattctagcaaatggggatggacatggaggggcactttcacacaatcctggctgatctctctgtttcctgctgcagggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggtaagcttggagaacaggatcccctgccccgggaagcagggagtcatcccttaggcctagcagcaagggaggagatgccccctagtacagggcagagctgggcctggaagtttccgccagagggttcctctcttatttcacagcagagaagctgcagccctggcccctgtcctgccatggctacctggccgaggtgacctcagggtggactccatccaccagctgggcactgcttctgctctctttgcatgtgttcttccttagggctggacttagctcatgcagatctccctgcccctgcatcctcccaggtccccctcctttcaggccacatgtgaacctcatcccttgtccctgtaggcctctctgtctctttcagtcaggcctgggtctctcaagcttttgtgtctgtgcctgtctgagcccccatgggtgctgcctcttccccctgcaggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatgtgagtacctgggtgccctagatgatgagcagagatggctcctcaaactctttcttttctttctccctggaagcttttagcaccttccccatattttcctccagttttctgttgggcttgagaggagggaaagaggaggaaaagtattttttccccacgtggaggtgggaaaagaggtcctctgagcttgctccactcctggaagcaaaaatgtccaactagctccctgctgccccagtacccttgaggtccttgaaccatgaactcttggcagcccctacagcccctggtcccattgaatgccagctcccaggcctcacactgccgctctctgccccaacagttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacggtgagtggggctgccagagagaagagctgcctgtgcccaaaccgcctggagcagggctgagggttggcccgcggcagctgtcaggtcctaaagtgacaggatcatcagaggcatgagtttgagggtcatgtagagaagataggctgagtgacaggtgagagagaggcacatatcattccatcttctccattcccctggctcaggggaacaaaaccctacctggaacccagtgactactgtagaagtgttctcgcaatgtgtacagggtgaagaagcggtcacaggttgggagctcactgtggggagtggggaaggaggggaagggcagggtggagaagggccctgccgctaaggataggagttgaagtggagaggcctttggcaagccaagaagaggtctcaggagccccctcagtgtggttcaaccttgtgggctctgatgctcgccagtttgttcagttttgggcttctgggcagctggaactgggtagcaaggcatctactgaacagagcctcctccttttttctcccctagaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 37906 - DNA, 206268 bp, Homo sapiens
aaggcgctggcggccggcggctgccccagttctccgccgaggcggtgaggcgcctggccgggctgctccgcagggcactgatccgcgtggcccgcgaggcgcagcgcctgagcgtgctgcacgccaagtgcacccgctttgaggtgcagagcgccgtgcgcctggtgcacagctgggcgctggccgagagctgcgcgctggcagccgtcaaggcgctgtccctgtacagcatgagcgccggcgacgggctgcgccggggcaagtccgcgcgctgcggcctcaccttctcagtgggtcgctttttccgctggatggtggacacccgaatctccgtgcgcatccacgagtacgcagccatctccctcaccgcctgcatggagaacctggtggaggagatccgggccagggtgatggccagccacagccctgatggcggaggggccggaggcggggaggtgtctgctgaggccctggagatggtcatcaacaacgacgccgagctctggggcgtcttgcagccctatgagcatctcatctgcggcaagaacgccaatggtaagcgcgcgggcctcggactggcagactgggtaggcaagaaatcccgccctgggctactgggggagtgaatttcctgagacaaagctggtggctgtgccagttctttgggagaaaacgtttggtctgaggatagggttcattacatggcacttgccagagattgttctaagggtgtctgacttttggagggtaaacttgtgaatgatctccatcctgttctgcgtggcattgttactatctgcgggctgttcattgattgggtgagattgaatctcttgaccaagccattcctgaacctctcttgaaatgaaacttactgccccgtggctctttaccgtgattgactaggtctctagctgctgtctttccccaacagctggttagattgactgattctgccccctagttttccccagctcaatagcagcaaccaaagggtcccaacttaaagacctgaaccttggataagtaagatgggcggagggaagtgggaagcccaagatctggtgctgcgccttgtgctttgctgggctgaaggatgctgtcaggcgctctcttgggggatggaggggtagtggttcgctcttacctatatgtgcccaggaatgatgaaacctggggaccccgactccccttcccagaaaagtaaccacagattgtctcctgagacctgatttttccaagctgtcaccaaccaagtgagccattggttaaaaccttgcattgtattaaatgttctttcctgaaaagagtggtggcccatcaaggggaagagataggtaaccgcatggggtcaagtctgggaaaggaaccattgggtggttgcacttccctgaagatagcatggatttggtgcaaaggatggaaacaaagcacatgaccttttccctgacaatgttagggggtgtgacattgcattcaactgcaaactacctacaagacttcagtttgagaagtcagcaccataaactgttcagaatggtattatggttaaacagccttacgatctgattggaaggccatttggggggcagctttcagtggcaaataagcaggcagtggaagaggtcaggtggggactggaaagggataaaagaagtcaaaacatggtttaacataatcataatagctgaaatgcaaaataacccttaatgtgtcgtcattattctcagcactttgtatttaactcaagtactcctagcaagcctattaggtaggtacttactgcatagtatgatgcccattttacagataaggaaaccaaggtacccagcagttaaataatctgcccaacattacatagatgttaaatggcaaaactggaatttgaatccagtttgaatccaggtaggcccctttaaggttctagatgctggtggagaagaaacagctttgtttttctggtttgttgttgttgtttgtttgtttgtttttcttactggactatagctctcagatcttatgctttgttttttgattagcccagttttcgagaacagttgacatgttaggcccattttgaagacactctgtaccaagcatggcttactttgacattattggttttgtttttaaattctggcactgccaaaggagatgctgggaattgaagagcatctgctgcttaattttcttcctcttaggtcagagctaaggtcagtcctgaatctcagttgatgatgtcacagctgcttgttgtgcctcaccctccaggtttgtggcatcaacactgggaacagcagctccagggcaggaagtggagggccaggggatttccatctccagtggtcataattgagggaaagagttctgtacttttggctgagaggaggcccaaactgaactcaaagaagtaaaggcaggctcctaggagaaaagactgaagacctaaccctataagccaaacaagaataagggtggaactgtaaatgcaaaacaaaacaaaaacatatattcatgcagaacaggtgcccagcacattgagaagcttctcccagcttttctaactgcaaattgaaataaggaagaccaactccctgcccaggacaccctgaagatgcgaagtggccagaagctgctagaaaacagatgtcttctgctaaagggcttccaaccaaagaactatttcttatctagggtcagcattccttgggatttcctttataagttggtcttttggcaccacctacccccccacccccaccccccagctccaccaccaccttttgtttttttaaatagagacagggttttgctatgttgcccaggctggtttcaaactcctgggctccagcagtcctcctgcctcggcctctcaaaatgttgggattacaggcgacaggcgtgagccaccacactcagccacgaccccatgttttaacctcctccttgccccccctttccaaacaatcctccttaatcctgggtagtcaagagagcaggattctctgtggcagacaacaaagctccccggatgctcagagtcaaagtgtctccctctgtaccttctcgggtctccagggaactctcttgcaggcgaggtgaccattcacttccacttagcaactggatgctcattttttatacatgaaaaccagggggtggccacattaaacaataaccaggctgatttattaagtccctttagacaaagtgaaatgaatgtttagtagaggggcaatgaattacttatgtctgaaagctggcttcagagggaagcatacactgcttaggaacaaaatggagtggtccaaacctttgttatattaaaattaccccaaggccagcaaggtaacggtttacacagctgaagaccaactggggaatgactgcgtatgggaaggagagtgctggttagaattcttgtcctgctggtcttccctttaaattataaatttattgttgatatgcctgctaattatacagcatgggcacatgcatttgactcagctatatagggcttttaaacttaatgtcttccaaccaagaatttaagggccgtaatccatctattcctgtccattactcagaatgcaggacaaatatggttttgctcagcacaagatggataataaaagttctgcagtgtttacaaaacatgatcccagctccgtagagcagcaggagttatatattgttgctcatttggtattgatgtccccaatcccatggcaaggccattaaatgatgatatcttcatgacttccttacgggaggtagagaaaccaatttaatagagcagtatttataaacaggtagtttgcacaaaatagaaacttttcgcatccactcatatccctccctactctcctctctcctctctctccctcctctcccccatcacttcccataggtgagtttgatgctgagcatcactactaggtttcttcttggtcattcttcttactaagcttttgtgagtgtctgtggcattttagaaaatcttcctcaatttctagattcttgattaagtgataggatattggtgagaatattcttgctccaaagaagtatccagggtgtacaaaaggattgctctatcctagtggtaacatgcacaagactttggattcaccatgagagtttgaagcctacctttgccatttattttgttttattttgttatttgtttattttgagacagagtcttgctgtatcacccaggctggagtgcagtggtaaaatcgtagttcactgcaaccttgaactcctgggttctaagggttcctcctgcctcagcctcccaagtggctgggactgcaggcatatgccaccacacccagctaatttttaaaattttatttttgtagagacagggtcttgctatgttgcccaggctggccttaaactcctgggctcaagggattctcccgcttcagcctcccagagtgctgggattacaggcatgacccatcatgcctggccatacacaactttgccatttacatgagtggcctggtgcaattttcttaaccattctaaccttcaattttgtcatctgcaaaatgggacatagtaagagcacctagcttatatgggtggtatgagaattaaatgagactatagattgaaagatcttagcacatagtaaatgctcaataaatagtaaattcattcaacaattattgagcactgaccctgtacccaccactgttaaaagtgctgtggactaagtgatgaacaaggggaaaagccctcctctcatgaagtttataatccagtggaggaaatgagaaaaagtaaataagcaaggattttctcttggtaatgagtgttgtttaaaatattttttttaaagggcagggtaatgggatggtgtgacggggctaatttaaatgacagtcaaggaatgcttctctgaaggtttattagtaatagccagtaatatcaatactactaaggacctttaggccaaaaatagtgactgaggacttttctgaatgattcagttattcaccagctgagagaagtctcaacatctcacttagagctgagaaagaaaagggctgcatgtagagcagggacgaaacctcttctggttgtgggatttatttagtgatgagattgtaggatgaatttctactgagagaagcaactgaagcagcaagggttgattgagcttgtcaggtggtgtttaatcagtttccacacctgggtagtctgaaggatgagggctgcttcctatctctttaaccattttattaaagccaagagagttggtaaaactgaaacagagcaagctttggaaatgaaaaatttttttttctcgcacgcctgagaaaggcaaccctagccttaagtagtaagaggaacaaggtagagttgttccacttcctcctactgaaagctctacctgactcccccagctggaagagccacccctttgtgatgtttcctcagcacccaggacatattcttaaatcatttcctgcttgtgtgtgtctctcccataaaactgtgcacttcataggcattgctgtcttccctgtacctctcatggtgtctacaatatgtgctctataaatgatgggcaaatgatagatcccgccatacaggtttaaaatttgtatttgaattcctttgatatatcagaaccgtccccatttctaccaaggcagaaaatttccaagttgttctcaatgaatagagtcagcattttggggctacatccaacctttgggtaccctgctttctagcagggttcccaagtctggctttgatgtgcaagatgtgagttgggggaattttcagtttaggagaatgtcttcagtgtacaatacccaagaggaagggcttcacaacagacgtctggtacagcaggccacagaaaagtcaacaggaggattgagttgaaggtttccttaagaatggaaataccaaccgcccccttgccaacagagctgccccagaggacaatttatgttgatgactattgctcagaagagtttacatctgtgtcccactccatctgcctccagtctgaggactgaaccaaggtaatcaattgccaagacattcctgggttggcatcccaagaatgggaagttctgaaacaaaccagagacacttggttgcacatcctcagctttgtccttatcccacctcaccatcagtattcatcctttgtccgacaggtcagtgggtagatgcttcgcctctatttctactcttatgcagctgtagtaataggtctgacttttccacaacacctcaagcttattctcatctgtgagctttctaggtccccatgagaatcctgtgaatgtgtgtcctttcactgagaggtctccatgagtccagaattcacagctcaataataactaagctcaataatgactaagtcccattttgctcaagccccaggcctgtgcttttcctataaagaattacagaatccaaggtagcaaatacaggtcagtacttggccccattcagatggcagctagggtcaaactcatagcaagaacaacacttgttataggtcttgtttgttaatggcctatggtgtccagacactttacatttgttaggccagtgagtgttcacgaccacagtgaaagagcaggcactgacacccaggggtgtatcttcctccaaaggttgctgttactctgtttaaatgctgcttgctggctctccccaccctagaggtgccactgattttaaagagccattattgctgctcctggggatggaagaagagggcacagagagctctgctgcccagggagggcctttataagtgtcacctgctggtgaccaataagctcagctgaatagagaagccgcagagtacactgcgatgctcttctaaaggatgggcgggtcagctcagcaaaggctaatacatgaaggagagaaggcaccaagagggatttgagtctaggtcactggtcttggggagcttggtgcacctgtcctggagttggcagaagagcctgtatgaagggggctttgatttcctccgagtcccccatggtgtccggctgctgactccatctcggtgtttagagcacagggagagaatgagtcagcgatgtagcaaagcagtgaagggcccagactttggagtctgaattgagtcccagattgatttgcctcttactgacctaggccttcaagcaagtcacactatgtttctatttcctctactgtaaaatgagaggcttgtacacatgcggttgtgccttatgcatactcagtgccctgggatgtgagagatgcagccaggcttactggtgagagcacagcacggggtggggctgcctggctgtaattcctcataacttcacttgggagctgtgtgaccctgggcaagttgtttcacttccgtgccttagtttcttccttgatcacagggcaccattgacattttggactggttaatgttttgtcatgaggttgtcttgggcattgtaggatgcttcatagccaccaccagttgagaccatcaaaaatgtctccagacttttccagatgttccctggggagcaaattcacccttggctgtgaaacacagctctataagataggactgaaaatagtacccaactcataggatggttgtgagaatttcataagagtccctgtgagggactttgtgttatgcctgacacataagatattctaattgtttttaacaaacttgtgttggatccactgattgtgttcatttttgccaaagtctctggtgcaaggagggtcacgacccaaatctcagggagatgggtattactcgcaaggctttccttggtggctaacagtttgtttgtggaggtaggaggaagttatggaatctggaaaagcacccttgcaccttgctcagttatggctcgattacccccaacaacaagtggtctggcagtgggcagagagattagatctcaccctctgagctcaagcccatctctgccaggatgacagcaagagtgcacattcaaagctccaggcccccagagagcaattctcctgtggatattggaccctgcttgtggcagccgccaaatcctcagccacagatcatagcaggtgttttgtgttttgctggcctgtcatgtaaacacactttgtggtcttcctgcttgttttaaaaaaggcctaagtgcttttgcagctttggttgtgtgcttggagctgcatgcaggattgggaggagatacataaggaacacagcccaagtactcctgaggaatgccatgccggcatcattaatcaactgctcactgagtgccagctacatccaaggcaatggagacagattagcaagggacaagaatcttgactgttttgagtttagaagtgtttagaatctagtagggaaagcaaagcatatatacagatagttacaaagaagtttatagtgaccaccttcaaacaaagaggggagcaatggcgatagactccactgtctagtcttcattgctggttccccattgcgggtgcttttcaggagctgtttcatttaatcctcccagctcctctggaaggtagatataacttccatcccatagttggggaccttaaagcttctggtgattagaaagcttaaagggaagagatgactcctggctgtctgggtggaaggaagtcagggtttctttgtggaggatgtggcaggtgtgccagtgatttgggcaggtagagctgcgactgcggagatgggaggggatgcagagcccccagaggcttccaggcagagggaacagtgtgagcaaagacctggaagccaacgcatatgtgttggagaacagcaagttctcctgtttgggtggaaggttcagatacatgacaagcaggaacagtggagataacacaggaaaaaggaaagctttcccacatcttttatccagatgttaagaagcctgccagagtacaggatgagagttttccaaaacttattttcataattcagaaattgagtgtgtcttctccctagctcatcttaaccatggccccagacctccaattactcctcttggtgattgaaagcttgacctcaaaaatgcacccgtctgctgtcctagcagtaaaagcattaaaagaagaccttaactgagcaaacttgggttgtgaggggttgaagaacaaggcttctatcaacccttcttttcttgttgaatttggctctgactttgcatttcttccgtggccctgaatgtagcattacaggccaaagcaatcccagtacagaatgaaggtcaagactggcaaatgtgttaaacgaggccattggatcgactcttgccaaagcaggattcttaatcgtggagcataaaacagggtgagagaagatggtcccagaacttttttttttcggtgttaagtccgactgatgtatacgatattcgacttccagtttagggtttattattttggacaataaaagctcaattctcagagatgctgacattttaattcttagttaatgtgtttccagagcattgataataaagatttcaagcatattaaatgcttaatattgtggaaccaccttatagctaattgtcttctgaattggagtccctaaggtgcagctgaattctgctgataataataaaatgtgataggtcatcaatggcttagctaataactcaggtgtcggtctttttccggactccagtgttatgaagggaaggaattttcttgtcacttgacaaagataaacttcatgaacatattgcaaaaatacatacacagtcatttgtagttagtgacttgaggcccacagtttcctttctttctttatttttattattatttttttgacacaaagtctcactctgtcacccaggttggagtgcagtgctgcgatctcagctcactgcagcctcctccttccaggttcaagcaattcttctgcctcagcctctcagttagctgagattataggcaggcaccaccacacctggctaattttcatatttttagtagagacagggtttcaccatgttggccaggctggtctcgaactcctgacctcaagcgatctgcccgccgtggcctcccaaagtgctgggattacaggcatgagccaccatgcccggcccatggtttgctttctaaaagtaagctgaggagagtcaggcccatgatggaaaaattaaacaagaaaactaaacttggaagcctggacatacaaggttagagttgaggagacattaaactggacctcaaagaggttgaaatgggcctctcagtgcacgaaaaccctccctacagttgaggccaagcttttattgaaacctttacaactttttttagtctgtacattttaaaatatgaaaattagtatttgctgtgaggagagctattaataaacacaagcctgaggctcacacaccaagtgggtgtacgtgcacaagcatccggaacaatccagtacagagctatgaggatttggatccagaaaattctggggtggagcttgccccgtctgtgacctggcatgaatcattccatctcttggatctctgtttccttatctgtggtgtggagaggtcagactagattccccaagggcttttctgtctctgatagtgtttctagaccccacatggacactgtgcagtcattttcctaaggtcgagcgctgtaattagtatccttgggaaagaaacacccaggatggtgctggacgagctctttgaagacctggcttggtaatagggctggacactgtctttttaatattaagattaattgtgattactgtactcagggttttcctgtgcccctttccccagaaagatgagtgctacatgcttttggccgacctcatgcttcagtgcttgacagctgcatccaggtcctggcaggccggcactgtggtgagatccagctccgaggtgacttcatatagcatgtgcttgaagcccgcctacccagacttggatatttatagcaggggagcagctagaaaaaaaaaattaaatatgctacacccttctttatacgatgtgggacagagacaggcattgtgaggaatttcaaaggcagagctgtataatccagcaggatatttttaaatgctgtttgttgccattggcagggccggtgtttcaaagaggagggaaaatgagagtaactgaggatgacaggctgccaggaatgctgaaggccgagacatggagctccatgctccgaggtatacaggctctgaaccctgatgtacttcacagtcacatagcttgaatagggcttgggcaggtcagtatgagaggctggggaaatggggtggcttgcctgtttctcttccccaaccggcccatctacccgtcaaatcccaagttgaaaattgatgaaatcttctggagaggcagaacatatggcaaaaaaagagttgcttttgtgaaagccagggacctggttgtttcttcttcagcccatctcagcagccgggtaattaaagttgtacatggggacacaatttggaagcaagttgcttgcagctgttcttctggacttaatccacttgagtaccagctgggcaggccaggactatgctgggacccaattcagtagcaggtgagaaggcctcaggggtagggctgcctctgagaaggcatcgcaatgtcccccacctgtccagtgggtgcttgtaaagtattctaagtagtgttttctaccacactggtctttgaggagacaaatgatgatggcgggggtggggagtctgaggactgtgtaggggagaggccaggagttctgtttgggttacatccgtttgttcacccaacaaatatttattgaggactgtgtgctgggcactgttccaggagctggtgatgcaacaaatgaataaaaggggcctgaaggagggcagggtgcaggccctgtggataatgaggcagagtgaggggaatcacctgaggccagcctggctggagaagacagctctaggcagagggaatagcaagcattcctggtgggttcaaggagccaccaaggagaagctccttccgtgcggctggggcgagtgtagcaggagatgtggttggagaggaaatggtggggtggttagtggggtaggccattgggtaataattcattggcttttagttctgagtaagctgaaaagcattggagggactcaagcacagagtgacttgatctgatttgtatttccacaaggtcactctctctattgtgttggaaattgactttagtatcaagtgtggacgcagcgggaccagccactggcacttgccaacagcttggatgtgtgaggtatgagagaggaatcaaggatgacaccaagttgctatggtctgagccctggaaggagggagtggccattgactgaagtggggaaagctgtgtatggaagaagcaggactgcaccaaagatcctagtgcggttttagttgtctgtctcaaatcacatacagatatcaaataggttgggccgggcacagtgactcacacctgtaatcctagcaccttaggaggctgaggcaggtggatggcttgagtccaggagttcgagatcagaccgggcaacacggtgaaaccccgtttctacaaaaaaatacaaaaactagccaggtataatggtgcacatctgtggccccagctacttgggaggctgaggtgagaggattgcttgagcccaggaggcagaggttgcagtaagccggtatcacaccactgcatgcactccagcctgggcaacagagtgagaccctgtctccgaaaaacaaataggaagttggctgggagacaggccaccttgaacttcattagtcatatgatggattgaaatattgcccttctttgcccttccagagggtgggctcagtatagcagggctgcatagagactcagacaatagagatttaattttcagtcttacgatctttggctgatggccataaaagcccctgaattttgctttccagcttctttgtaggcagccagcagcctttaataaagatcatcaactctgttgtttcctgtcattaaaatgggggctgtttaattagtccaattgttctgtggatcattgtgactttgcgtctgtgtccttcaattctgggaaagcaagactccatttttcaggcagctttggattcctggaggtcaagtgtgggtctgaaatttggccggaaaaagaacgctcttaggtggcttgagaaggcatggggcctggagtggtgtccgaatggtttgggagtatccaaccgcctgttggatgctttgacctcggctgctcaggaggggcagggtgcaaagcctggctaagagatggggtctgaaggagttgtcactgtctgattgccagctagatagctgaggtctctgccctcagttttcctcttctgttaaatggggttgccatagttcctagctgatagggttgttgtttcagtggttttcaatcctagattcacgttagtattatctggatagcttaaaaataaaagtgtcagccaggcatggtggctcaagcctgtaatcccaacgctttgggaggccaaggcaggcagatcacctgaggccaggagttcgagaccagcctggccaacttggtgaaaccctgtctctactaaaaatacagaaatgaggcggtgtggtggcaggcgcctgtaatcccagctactcgggagactgagacaggagaactacctgaccctgggaggcagaggttgcagtgagcgcagatcacaccaccacactccagcctgagcaacagagcgagactctgtctcaaaagaaaaaaagtgtgtgtatgtgtgtgtgtgtctgtctgtctgtcttaaggccctacctccagatattctgaaataaatggtctggcatggggcccagaccatgtgggtagcattcctgggagagcctggtatgtagtgaggatgcagacattaactattattagtggtaaaagcatccttgttctggagtatgtcttttcgccccacctaggatggtgactttccttcatttcacagccacagcagctttggctaactcatctagagggatcaccaaagaacactcaagagaagcttgaactgttaggtttacatggaaagggcatggctagatctaaaatgggagcaacatattagcccagagtgctggcgcacacctgtaatcccagctactcgggaggctgaggcagcaggattgcttgaactcaggatgcggaggttgcagtgagccaagatcgcaccactgccctccagcctgggtgacagagtgagactccatctcaaaaaatgaatgaatgaatgaacgaataaataaataaataaataaataaataaataaataaataaatgaaatgggagtgacaccataagatgttatttgccccactggtaaatgaagtgaatactgtgattcccatctttaagatgaagaaacaaagtcacagagaggtttggtagcttgctcacggtcatgcaggtaataagtggtggtccaggcagtcttacccctgattctctactcttcaaccatgtgtgttccctccccagccagagaagccaagagactgaattctcaactctgatacccagcacagacctaccgtgggtcaaacttttacgaagcaccagaccccggcccatgtgcttcacatgtattatatcatgtgattcttaccatcatatatactcttactcccattttgctgctgaaaaacaagctcagagaagttcaggtgacatagctagtcaatgacacagccgggctctttgagctctgaagtcctcatttgccctgtggcctcctgtcctcaggagtggcctgggtggggacgaagcacatgcagtgatttcctgagcaaagaaatgaatgggttggcccaagaggacaagaggaactgaagcaaggccaaagcatccctcactgcatctcaacaactgagccactgggggcctgaaaatagtaacattgcccagtagggtggccagccagctgcgcctgagaactgtggggtaggtatttgtttctctgcgtgtttaaagataataccgtatgaagcacattgtttctcttctgttagtgtgaatgaaattgcctctgaaaggttgtgtgtattggttgcttaaaatagctcaagaggaagaatgtttggaagctgttagctccttgagtctatttccttgatttatgataccttggagagtgtgggacctcttcttgtttacccttctggctttttctttctaccgtgtttgagtccttgtgtcatcataagccaaaggcatttgtcaccagaaaatgtggcaacctttcctaagtaatttaatgggggaccctttacacgtttaatctttttccttaaagggaggaaaatggggagaggtcatttgttttggaaatggccatttctctcttccagctgaaaacgttccaagatcagagcaatggcatttgcttgggagtaagaaaaatttgttttatttttccgttcacactgaggcctggcctgggaactcatgagtttttgtagaacttccatcttgtggtgcccaggagacctgacaagctgtgagtgagaggagccacagagctgctctgttcaatacggcagccacttgccacaggtgtatatttaaatgtattcaaattcgataaggttaaaaaaaaccatttcctcagtcatgcaagtcacatttcttgtgctccctcgtcatatgtggctagtggctaccatattggacaatgcagatatagaacatttccatcatcgcagacagttctgtgcaacaatacagccattagagtgggtcagtggtgggtcgcttggggccagctttctgggttttcacaggtctaaaaatttcaaccattccccagcttctcagaagccctctgtttgcagaaacaagaagattcatggaaatggagattaaggccattggttcttgtggctctaacctctggacccttgacacaaggtcgggttttatcatttccaagctgcgtggcctcaggcaagtcacttagcccctctcaagttgtttcctcctcagcaaaatggtgttttaaaaaatacctcccagggatgatgtgactatttaaacaaaataacaaaatgtatataaaacagttagcataaggcttggcacacagtaagaacttagatgtgttacaatgttttacctgcattttcttctttgagccacacagtatcccgcagaggtagatactgttgctgatttcaagatgatggaaggggctttagggagtgctattgctaccatcactgccactgttcctactgttgatattcctaggcttgggttctgctttttcctctaaggctcatctttcctactgagcttgttgactggcttcttgtcataaatcagaggatgtttgtttgtttgaactaggaggtcttctgagctttcattcagggactgtttcttccaccatgggaggtgagctctttcagaggtgtttgcctaaagctggcctattggtatctacctggagagccgccacctggacagctactgccaggatctggggctccttggaacttgaggttaaagtttttagtgcttcacatgacctgtggtcctttggctgagtctaacagaggcttcactgagatcttagctgagggtggctttgggaggagtatctctgagaagagtaggaccaaaagagtcctctcttgagctgtagaaaggatccttctgaaaagatatttggtcacacctgggtcctgggttggttcgcaccttgactcccccagtcacttggctagatcatatagctaattatttaactttgcaatacctcaatcttctcatctgcgaaatggcgattatactaaaactacctggcaggctggttgtgcgaattaaatgggatgatgctaagtaaagcatttagcccagcacatggcaggtagcagccaccaggtatgagctactgttgccatcttcattattgttgcttcccagcaatggcatttggtgcactattttttcacgtattgttcgcattttctccttgagaatgtcttatctgtctagtcagaaaaagcgacccagaaggggtttagtgtgtaaagtgagtgtctaagttaaacttgcatattatggactctgtgtggtcttttattcttccttcttcccttcccttccttcctgtccttttttctttttttgtttttgtttgtttgtttgtttgtttggaggatggtggggctaagaagcatactgtgcagttatcataaagcatgactgtgcagttgtcattctggtaccccacatggtgaccagcctgcctccttcctgctggttccagctgtataacaagctaacaagcaccacccagtcaaacagtgtaatcagagctggattatttctataggattaatttgtggtgtgaagtgctcatgtatttatgcaattgccactcgtttgccaacatccagaatgtgctaaatctgccactagtgatgaaatccaaataacttggaatcatatgtagggaatccagtaattttcatcaccattgttacaagagaggagtttaaactgggggaatccaaatggcaccgagaaatgatgatatccctgctttccagggatgattctactcagggaagcaccaatctcaaagagaaaacaggaaggacacaaggccaggatattgcatgattgtgttgccattggtgtaactgggtcctcactgagggccctcccaggcgaccacaccatcgtcttttgtgaggcttctctggcactgacagatcactcatagttaatgggtaactcagactcttcttgccaaatagttgctttgtttgttatctgtgctgtggtcgccttcattgtccccacagcccctcaggcctcagaaggatgtggtgtggagtggggtgtggtgacctctagcatgagcccacacacttcttcccctttcccttaagtcactcattgccggagctggctggttgcagaaacatcttgaagcactttaaaaattgatgttctagactgggtgcaggttctcacacctgtaatcctagcactttgggaggcctaggtgggaggatcacttgtggccaggcgttggagaccagcctggtcaagatgacgagaaatggtgttttaaaaaatacctcccagggatgatgtgactaaacaaaatagcaaaatgtatataaaacagttaacataaggcttggcacacagtaagaacttagatgtgttacaatgttttacctgcattttctcctttgagccacacagtatcctgcagaggtagatactgttgctgatttcaagacgatggaaggggctttagggagtgctcttgctaccatcactgccactgttgctactgttgatattcctaggcttaggttctgcttttttcctccaaggctgatgagaccctgtctctatataaaagtaatagtaataaataagttttgaaaataacattagtattctggaacccaccctgaatctattaagtgaaaacctgtaaaagtggggctaagacatctgtttttttgttttgttttgagaggaagtctccctctgtcatccaggctggagtatagtggtgtgatctcagctcactgcaagccttgccccggttcaagtgattctgccacctcagcctcccaagtagctgggactgcaggtgcaccccaccacgcccggctaattttttttttttttgtacttttagtagagatggggtttcaccatgttggccaggctggtctcaaactcttaacctcaagtgatctacccacctcgacctcccaaagtgccaggattacaggtgtgagccgccattcccgaccagaacatctgtattttttttttcttttcttttttgagaagtggtctcactctgtcacccagactggagtgcagtggtgcagtctcagctcattgcaacctccatctcctgagttcaagcaattctcctccctcagcctcctaagtagctgggattacaggcatgcgccaccacacccagctaatttctgtacttttcatggagacagggtttcaccatgttggccaggctggtcttgaactcctgatctcaggtgatccaccctccttggcctcccaaagtgctggaattacaggtgtgagccactgtgcctggccgacatctgtatttttaaagcaactcttgcggcgattctagataaacgggcaggtttgtgaattccatctacatcactgggggtggattttattctgcgctcctctcacagtatgtatggggcaaaggaccctcttgaggatgtacagtttgggaaaggccagtctttgagggtcttctctgtgggtggtaagatggagatcatggttagggtgatttgagtagggggaggtggggagaggtgttagaaagataaccaatgtttattggatgctatctcgtttaatttttccaaccaaatgtgatgagtcggtggtgataaaaatataggttgttatttgccgaatgcctactatgaggtgagcaggacactagtgatttgcatgcagtatcttgtggaatcctcactacagcctgtgagctgtaggtcacattatttatcctcattttacaaatgaggaaactgaggccttgagatagttgaaatgacttgctcgaggtcacccatacacacaagtagcagagccagcgtttgagattagtactgtcagacttcaaagcccacgttttccatgctgaaagttttaatcaaaagcattaggctattgggtcaaataagaatcctgcattataagtacagtgtcagaattttttgagaaagctgcttgtgccatctttcctcaaggtacggccctttggcctttccagtcctggctttgagaaccttgttatttccctaggctgagaccagcagccagtcagctgtgcccgtcctaaggctgtctgtgttgtggtctgctgttcctcctcctcaacccctgcctccttccctacacagcccctgcatgcaactcttctccccagacaggcgcagaatcggggccttcctcaacaaataagccaggttccggaagtgctgcagtttccacccaggtgcaagcccagcacaggcctcctcttagccagcactcatccgaatccactcacttgcactcaggtggttgtcctcctcagtaaactgagaagcagtagggccttgtgattgacggtgtgggtatgaagctggactgcctgcattcaaatcttggctccacttcttcttggacaaattacttcatatctcggtgcctcagtttacttgtctgtaagatagggataatcctgtttccctcatatgatagttgtggacaagattaaatgaactacacctcgtaaaatgcttggaacaggacctggtgtgtgagtctcccgtatgttagtcatgatgatggtgatgatgattaccagtttgggggttatctttggccacccttcctttggcatggggagggagcccacccatatgcaagcattaaccctgagtcttacagtagggaaataagggctttggaaacaaacccgggtctaactgcaggtaagctgcttttttttgtttgtttgtttgttttgtttttttttgagacagggcctccctctgtcacctaggctggagtgtagtggtacgatcatggctcatgacaacctcaaactcctgggctcaagtgatctttccacctgatccttccaaacagctgggactacaggcacaagtcaccacacccagataattttttaaaattttttatagagataagatctcactatgttggccaggctagtctcaaacttgtggcctcaagcaatcctcctgcctcagcctcccagaatgctgtgcctggcctggctgcttttttaatgtggtgctaggcaagtacctcaacctatttgttttttaatctataaacttggaatgatagtagtacctgccttatggtgttgtaaatgtgaaatgcaaaagtgtaaacaatgcttctcagaaggtgcatgggctcagctgacattgaatgaataggaggaaaaattagttgaataagctttagtagtaagtgaaaaaaataagctcaaaagattatattacagcacaatacaatgtagagaaattaaaaacaaatattggatggcaggaacgtcaggttctgggacagctggagacagtggtggtgactggaataactttaccaaaggaaagctatttagtgaactgtcccctccagtagagttggccaatgtgctttgtaacagagccagactgttttcctatctcccaggattttactctttagttaaaacgttggcaatcccaaagccttttcaaccgcaggattgtcaggtttaggtgtctcatgtggccgctctacctccagatatatgctctcaaaaggtgtggcctgatgaaactatgggaccgtttggacctcaagatcagaggttcaagcttcctgggatcataggttttgattgtcacctcaatgggactgcttcacagaagaaaagcctgctttataaaactttgcctgatgttctagcagaaactttatcaagtgaaagacacaagtttgtgatgacacaatatgtgaatgaatttcagggtaatgatgcacctgttgaacaagaaattaacagtgcagaaacttaactttgaaagtgccagagtggagtgtgcaatacaaacgtgtccagaattgtggcgaaaagattttgaatcactgtttccagaagtagctaatagcaaattaatcattctgactgtaacacagaaaactaagaataatatgactgtttagagtgaagaagtagaaactgaaagagaagtgctcttagaaaagttcatcaatgttgctaaggaaatttgctgtactctttgtgctgagggatattgggctgactttactgacccatcatctggtttggcatttttttggaccatatacaaacaacaatctttttgaaactgatgaatgctaccgacatttaggattctctgttgatgaccttcgatgcttaaagtgattcgtcatagtctctggggtacccgtgtagttgtaggaagcatcttcactaatgcaacaccagacagccatattatgaagaaattaagtggaaattagcggaaatgtccattcatttgctgtattatttgtatgtaatatttgggttgatctataaacactgtcagactaaagtttttaaaatatacttatttctatttatttcagcatttatgaatttacaacattggtaagtgatatgggattttaaaattgcaaatgttcattattcatatcattgaatacatgttgagcacacccacattgtataggttgtggtaattagcttgtaactagggtattatctgttattgttatttctcccctttattggaaaaaggcctcagttttaattactttcttccaaaaataaatcacacatttggttacgaaaaaaaaaaaaaacccaaatattaagatgtgctgaaggagtacattacaggcacagtaaataccatgtaagagagaaagtgaggggatgggaaacacggttgatggttatgcctcatgggaagagggaaagggaaggattaggggagggagggtcatatggtttagatgcatgtagatggttgccaaggctctagcttttgtttgggagttgagttcacattatagctaattaaaaatggtcatgaaccaaggattatgataaatccaatttgtgcacctgaggttaaaaaattagtgggttctcaataggtggtagctatttattatcccatgaaccacctgaaccatgccacaggccaccattcataccctttctgattgcctctcatctgtgcaaaatgctctgagaagtgagttttctcttccagccacagtggctttcacatggagaacacagaacagtagggatatttaagttgcctggattcttaggttggggcaggtcttaggcatgagctcccgtatgtgtctaaaacagttgaacaaagacagggttgtttttgtccttgctgtgccagatgtaaaggctttcattagagtcaccttaggagcattcatgttagccaggagattttccttccaagagaaggaaacgtttgggttggatctgatagtgtttgccttggtgtgattttagacctttctgtttccatcgtcaccactcagcatcatgacttttgcctgtggcttttttttttttttttcacctgtggctcccttcccttagtggaaaggggaagcaccaagatgtttgagacacatcagtcatgtgcttgcagatcccagcatctgggtataacgtatcctcatgtcctgcctctgaatcttgaatttgacagagtaaaggagacaagaacataggttttggaattagggagacctgggttcaattttgggatcttcactgtgtgatttgagctggaggcattacctgtttttcctttattttattatattttattttttgagacagtctcactcttgtcatccaggctggagtgcagtgacacaatctcagctcactgcaacctctgcctcccgggttcaagcaattttcctgcctcagcctcccgagtagctgggattacaggtgagcaccacgatgcccagctaatttgtttattttaagtagagacagggttttgccatgttggccaggctggtcttgaactcttaacctcaagtgatctgcccaccttggcctcccaaagtgctggaattacaggcttgagccaccatacccagcctgtttttcctttatttttagtttttgggaattttgtttgtttgtttgtttttcttatttatttgttttgttttgtttctcctttagtatagattgggatgcataaagaccagagtcttaaatgcacagcttgatgaatttttacccagacatgccgctatgtaacttacccaggtcaagatcaagatttaaaacactcctgcctaggagacaccctcatggccattccttgttagtgtctaccccacataactattattctgactcctgccaccttcaattacttttacctgttcttgaacttctgggggtaggtaaattattaaacctttctgagcctcagtttattttttaaagtgatagtacttgtgctatagggttggattaggagaatcaactgagacaacacatgtaaaatcattcgagaaatatttgtaaaacccttgatgcttaataagttaaagctgtttgtttatgaatggccattgttgacctcaaagtctttgcctgtttctcacccagacgaagcaggcatttccccagtgctcaccataattcatgttcctgtgccctccatttccttccatgtcctgtgactccctgaacgcacttcagagactgttccatcagtggctttcaggatttttttttttttttaactgaaaccagttcttcttgcttaataaggcagaggaaatgggcaggaaagcagagttctcctgcctttgcctctttttcaaagagggtctgtttgctctattagcaaaatcaacagaggcattgctggacagcgggctaggctggaccaactcccctgggctcggggggtggtccctggatgctgggtttgctgagggccaggagtgggtcactgtgtgctttcaaaagcagctggaggagccagtttttctagctcctcctcaaaaaacccaaccaaaatatctacccctgtgattggctaaaattatccaattataatttaattcccttaggtcaagggtggatgggtgcataataccctgagtgtgagtgtgggggttacattttcggagggaataattttgcgtgtaggattccatttgaccttagtctgaatgattactagcgtagcctttccttaaggtaggtcttcatggaggagaagggagaactgtgcagtgggtaggtggcagtgaagatgcaggaggctgggacaggttagagggtgaatgctccaaatttgtgatgtgatctagagctaggtctgcctacagccacatcacatgcatttacagatgcctcctttacgttaagtgctgcatcagaatagaggcgaaaagttacagtcctgcccttcaggagctctgggtccgaaagcaagaatcaaacaggcagttgtaatacaggctattgcatactatactgggaagaccatggctacaaaatcagattgggggcatggagttgtcatagtcccagaggtggtcatttgtgttgagatctgaaagataaatagaagttagccctcaggcttgtaaaacctgtgactcatgtcaccatatccttgggactctcaccaggaaatacatttccaaggataacttctgctcactccataaatgaggtttggcttttactgaactacttaacacttttgctagcagcaaagctggggtttttaatttttctttttcccgcagtcttgcaacccttctaccccgtgcaatgtaaacttgaatacatagatcttctggctctgcaaaagattatcacttcttctgggtgagtgaaagaggctggatgggaagattcatttatcaactgaagactttattagtaagagtttatgagtaagagagtaacctcattacagagccagaagagagagatgtttgttatggaagagatacccacttggcatccctcacgtggccagtcatggtgtttggggccagcatgccaaattgctccagttaccatgggacccagacttagacaggaaatcatggtaggatgggaaggagtccaaaatacacatggctggtatataggctacagttagaaaagagagtaagagaacagtgtatctattttcctgaaggagtattgcaacctcagatggggttgtttttccacaactccttactccttgcgttttatggtcctgatttttcaagctttaattttttccgcgttaagcaatacttacatgagttgaagtgaccctttatatgcttgtggtaagcacttcttaggcttgtcatgtatgctttttaaaatgcctccaaactaaaaagaagccaaagtcccttcaatcaggaggactttattcttcaacacgtggaaggaatatctttttggttttaccacagctgtctctttcctgcaagcagcccatttgaaacccagaactccctcgttttatgggatgtgctggtggaacataggagggggtccactggaaggctggatttcttggaaatctctgctgccaagctcagcaactgaaatttctcattcataaagaggcagatttgcatcctgcccatgaagttgttaaaagaagttggagaatcaggaaggggatcttacctgtacttttgcagatgtagctctggaaaagttccaaagggatctgactgcatgcacatagcttgggaacagttccaggcctccagaggaacatttaacaggtcactattgatagcattttccatgaaccaccctaacatatttcttgggagtgtgctaaactgttgatgaaatgacagttatagcatggggtttgcacccctatgcctcattgacaactatctctctgctggattgggtataatttatcaattgaatttatttcataagtttattgcctttaccccacactatgatgttataaccatggccattttaggaatgagaggtgatgacaataatccctaatacaggtacagtttctcatggtttttacaaagcactttcacattctttctcatttgatctcacagctattatagctaccatttattgtgtctttctatatatcagacaccttactaaacactttataaactttaccttatttaattcttaaaataactctgtgcaacaatactctgatttgttcccattttacaaagaaggaaactgagggtcagagagattgggcctcttgacccaaatcctaatcttggatctagggtagactagggatttgaacctagatctacccaactcaaagcccaaaataccaggcagtactggctcctattctccctgtgttagaggcagagggctttgttttcctttagaagaaaatgaagtgcagaagggtttacttgaggtcccatggccaaggagtgacccagcagggaccagaagtcaggagtcctgagatcagtgctttgtcgttacccaagacctgtttatctaagcagtattccccaagtgaagtccctggcacttcccagccagcaaccacttggtcagaaatagccagtcctggactcatacttgggcacagagatgggacggagttctgggaatccagtgcatcattctcatttcctaagtaatttaaagctaagaaaccataaagtagcttctaagtacacttctgtttaccatttcagtgtcaggactctgcaggctacagacacagttgaatttactggcttgtttaaaagtcccaaagtaggattggcttcaggtacactttgactcagaggttcactggtacctttgggaccctgtttcttttgcttactcttgcttctggattctgctcctgggttggctccattatctggcagcctttctcctgtggttgcaaactagctgcagcagcctcagctttgaagctgagtaggaaaggggaccagttggcttcttgtgatagctcaaagattctggacttgagtctcgttggctctgatgggcctggcctaggtcatgtgccccatcattgaaccagtcattgtagtccataaccacatgctccaccccatgctgagagggaaggttgggagccctcatggcctgagaactgtaggtcagctgtggatagaagaggaagattggatgctgtggagagaagatgctgggtgatctgggcaggggggtggagtgggaagtgggatggaagatggatctggaaggaagtggagtggaaaaaccagtcttctagagaaacacatcaccacattaagtagggcaagggtaactttatttgaagagtttcaacagaccattaatgagagtatcttttggttgctgctgttagagcaattatttgttatattcactgacttcagtgtttatttgttctaatgaaacctttcctctctgaaagagaagcacttctttagagggtgtcttaaatattcagattacaggtttgaaggagtgagccatttaggtgctgaatagcttgcaggctgggtttatttctgtcttaatgggatcttaaattgtgccagatgaatttaaatgttacttctcttctagtctatctctgacccagtgctaccttgacatacttgaagttttagttcaactgtttggtctaaactgagtgttgacaattattattgaaaagttcatctcgtagatttttgcttttaatcagctgtagatgcaaatagaaggtgtgaccatatgagaggccacgtgttttcaggattctggatggctaagtggccaatttgctttccatttcagaactaaaccagacaaggaggggtgttataaaatgttccttttgaagtacctacaactaactagatccagatagtgtgaatgttgagagccaataagggttccttgaatgcctgcccggtggccggcatctctagaggcatcatggagaacaaaaaggtggtttctgctctggaggaatgaatgatcctgttgcagtaataacagaaactgtttattcagcagttactagctcaggtacagtgctaagaattttgcatacgttgtctcatttaatcctcatcacaccagtagaagggcagatactgttctcctcaattttcagaggaagcagcagaggcttggggaggttaggcagcctgccccaagtcaccaagcaagtgagcatcaaagccagcctcacaccaggctccctccagctgcaaagcctgcgtccctcactccgatgctgtggatagagactgtcattgcaggatttctcacagtcaaaaaagcaagtactcccttgataacagatttcatcactcttgaaactggaagcctgggaagaaggaagattgcctgaatgctgaagccagtgtctttccagaaggggggatactgagtgggcctccttccaacctgtctgacccacgtgatctctccatctgtctgactttgactgccaatccagcctggacagcaggaccagtccaagcacaaaccaaatctttattctggagttggacagagtcagagttgcttagggctgatgaggccaccttaatctcaatattttcacacactgtgctagatgacacatttcagagtacaggcagaatgagggttggaaatgttaaacagccagcgaggagttgggtctgggagtgagacagcagacaaagtgcattctaaccatgtacacgcagctgccgggggattgtttaaaccagattctgccaaggtcatagcagcagaaaacataatccagaactctttctcccaggcaggatcatttggtttctaaagtttttttctctgtaagtttctcttgggagaaacgtatctgggagagggggaagagtggaaatacgggaattttattttaaatccttaacaacatgcatatagagtcccacttataggatgatgctatagagttgacattttacccccaaggaaggagtatgtaatcctgggctgaggatgactttttccaacaaggtccctgactcctgtcacttttggggttgctttccttcaaaagctaattgagagtggaaaggaactggggtgagtgaagataaccaaatgtgcctgaggcctgagagtgagagccaggccacgtttcccctgctactgggccctcaagtggctaggggggtggattcctagggtgggacacagaggatcttcctgaattgctcccactcctttcccctagaaatatcatcttctttgatgctttatataaaaactaggattgcaatgtccctctttatccttagtaatcttctttgctgtgaagtctactttatctgatattagagccactccagctttcttttgatacgtttgcgtaatgtttttccatacatttaattttaactagcctatatcgtattccaagtgagtttcttgtatacagcaaatagtcatgttttgttgtttatctgttctcataatccattatctcctaactggtatgtttttttcttattttatttttgagacggagtctcgctctgttgcccaggctatagtgtagtggcgcaatcttggctcactgcaacctccacctcccgggtttaagcgattctcctgtcagcctcctgggtagctgggattacaggaacccaccaccacgcccaaatacaaaataatttttgcatttttagtagagacaggctttcaccatgttgcctaggctgatcttgaactcctgacctcaaatgatctgcctgcctcagcctcccaaagtgctgggattataggcatgagacaacgcacccagccctaactgatatgtttagaacatttacatttaatctaattgtttatgtatttggatctagtttctgttattttattatttgtttctgtttgttctgtttttggctactccctttctcctttcctgcctttagattatttaaacttttttttttttttttgagacagggtctccctctgacacccaggctggaatgcagtagcatgatctcggctcactgcaacctctgcctcccagattcaagtgattttcatacatcagcctcccaggtagctgggactacaggcatgtgccaccacacctaactaatttttgtattaatatttttagtagagatgggggtctcaccacgttgggcaggctggtcttgaactcttggcctcaagtgatccaactgccttggccccccaaagtgttgggattacaaatgtgagccactgtacctggctagaacatttttcagtattctgttttaatgtatctattatgtgttttgactatatctctgtggtttttttggtgggtggtctaaggattaaaaactacatacttaattttccattgtcaacttagaatcggtattttcctagatgtttaagtggaatgtatagaaagctcaccactatccctttaccctttgtataaaatctaacattgtaggagactgctagcctattagagtacagagagagaagaaagacctggaaggaattaagagttggttttacctcactcattcattcatttagtaaacatttatccagctttttctttattttattttattttattttattttattttattttattttattttattttattttattttattttttgagactgtctcactctgtcgcccaggctggagtgcagtgttgcaatctcagcttactgcaacctccacctcccgagttcaagtgactctcctgcctcagccttccaagtagctgggattacgggcatgtgccaccacacctggctaatttttgtatttgcagtagagatgaggttttgctgttttggccaggctggtctcgaactcctggcctcaagtgatctgcctgcctcaatctcccaaagtgctgggattgcaggcgtgagtcactgcacccggcctatccagcatttgaccaggcagcagaatcccctctcctgggctggataatctatagatcaatacagtagtaagagtagtaatagtaatagctaacttcattaagcacttactatgtgccatgcacttttctaggttcttacaggtagtatattgctatttcaataatgctatgatgttggtgctatgattatctgcaccttataagtgaggaaactagggaacggagagcttaacttgcctaaggtcacgtcggcagcagatagcagaactttgggcccactgatttttaatcctgcattatcacagaacctccatggggaaagaacacatactggaaggtatagcactggttctgtcttggagagcatttattctccaccacattcagaccttcctctgatagtggccactgatggaccactaaagaggctcttttttcccaaactagttatttttcctatcctcctgtaaatattcataggatatcttctttgtgtcagggattatgcacataatatcagagctctgagaactttgactttgaatctgaagttaaaactgggaagtgtccaggtatggtggctcatacctgtaatcccagcactttgagggggccaaggcaagaggattacttgaagccaggagtttgagaccagcccaggcaacctcaacaacaaaaaagaacaaaccaaaaaaagaactggaaagcactctaactgtgaccgaatcagtgcacttttcagatgtggactctgaggtggagggaggtgatacagtctgccacgggcactccagtagaggctgagcctgccgggacataggcctctgactcctgctttggtgtctttgtgcgtctttgtgctttcttggcagaaaggtaggggaagctaaaaagtagcagagctggaaattctgatctgtaactgaacagggacagccagcggtccccaaaggggagcctctacttgcatgccaagcctcagaaggctttggcagctgggctgtgctatttaataacctcctggaggctgatccagtggtctggcagcattactgaccaatgctgaggtttatttgtaggcttgggttttgcatttcctgaagaggcaggagtggaccctaggaagaagtgttggaggggtagctcagtctaactggcacctgtttttttaacagcatgacttactgtgggaatgacaagtagatatcacctcatggaccaagcctgatcaatcatcactgtctggagcactgtggtgaattcaggctcagaagaaagaattcagaaatccattgatgatgcctatcatgggcccaggaataggggctggaaacttgtctggcagatatttaccactagtgtgagggttaaagtaagcctgggattttaattatagcacaataatatctgtcctcataggactgttgtgaggactaactaagaatttatgtaaagtagctgggcatggtggctcatgcctgtaatcccagcactttgggaggctgaggcaggcagatcacttgaggtcaggagttcaagaccagcctggccaacatggtgaaaccccgtctctactaaaaatacaaaaactaactgggtatggtggcaggcacctgtaatcccagctacttaggaggctgatgcagcattgtttgaaaccaggaggcagagattgcagtgaaccaagatcataccatggcactccagcctgggcaacagagtgacactccatctcaaaaaaaaaaaaaaaaaaaaaaaaagagggaatttacgttgatgtaaagtgctcattagcttagtcatttgttttgctttgtgttggtaagggcttttcaaaagaaagaaagttcagtttattcattcaaatatttgagtgccctccatacacctggtgctaatttggccctggagaaagattgtgcaagctatactaggtcactcttctcatggagattgttctacatggaagaaatagacaataattagtaaataaacaagtaggatgacttcacatagtgataactgtattgaagaacaacaaaaattaggctaatacgagacagaaggactatgaagggggaggaaacccctgtgacagggtgacatttgaacagagaacgagccgatagtgcaaagatcttggagagagaagaaaaaatgtgaaagactcaaggagaaacagccttaaggcatagtgaacttacagaaggcaggccagagacaccatgccctagttgctaaatgctttcattataaaaatttaaaaacattaaaaaagtatacaggcttacgtaataacctctgtatatccatcacatagattgaactgttagctctgttttgactcttgctatctgcacctcccttttttggctgtacttggttaaagcaaatcccagacatcatgacattttatccctaaatacttcagtatgtatcccttaaaaaataagcatttgcggccaggcgcagtgactcacgcctgtaattccagcactttgggaggctgaggcaggcggatcacttgaggtcaggagttcgagaccagcctggccaacatggtgaaaccccgtctctactaaaaatacaaaaattagccgggcatggtggcaggtgcctgtaatcccagctactcgagctaaggtacaagaattgcttgaacccaggaggcagaggttgcagtgagccgagatcgtgccactgcactccagcctgggcgatagagcgagactcaatctcataaataaataaataagcaagcaagcatttgttcccacctaggcaacatggtaaaaccccatctctacaaaaaaatacaaaaattagctgggtgggtggtacgcacctctggtcccagctactgggagggtggggggctgaagttggaggatcacttgagcccaggaagcagaggatgctgtgagccaagattgcaccactgcattagagcctgggtgacagagagaaaaaagcgtttccttacatcctaatgtagtttcttgcatttaattctcacaatgccattgtcatgattaataatttattctttttctcttattattttatttatatatttatttatttatttatttgagatggagtctcactgtgtcacctaggctggagtgcagtggtgcaatctcagttcactgcaacttccaccacccaggttcaagtgattgtcctgcctcagccttcctagtagctgggattacaggtgcatgccaccatgcccagctaatttttgtattttattagacgtggggtttcaccatcttggccagactggtctcgaactcctgacctcaagtgatccaccctcctcaacctcccaaagtgcgattaacaatctcttaatacaacctagtacttagtctatacccaaattttcctgcttgcctcaaaaatataaattagtttgaatcagattctaaacaaggtctgtgtattgcatctagttattaaccagatcatgtgtttcatgatgaaaaggtatttgacgtcagacctaccttatctggatgggttttgcgtgcctttctggccagatatgtagcttagatcgttagaagccctgaagggctgtgaacccctgccaatactgtcaggttatttcccagagggatattcagaaatcctctgcccttccttcattgttgctaacaaaactgtggctctttcggtgtcagaagcaatgggggtatgagtttgggctttctctgctgacccagaggtgagtcccgactgtcctgaaggctgtcacgattctagtcccattgagagtgattggtttcagaacaggcatgtgacccagttcaagccatcaaggcctgagggaaggatgctaggtggagcttctctggaagggtttcttttcccttggtttggggtcttgagacttgaatggtatatgcgaacatcatgtctagagctgcggcagctgccatctcatgactgcagggaaaatcaggcaaaacccaacatcttgatgcaggccaaggtgggagaaaggacataacttgggtccttgatgacactgttgagtcacagaaccaaccaaccctgaaactaccctacccagctcttcttacaggagacaataacgccctggctgtttaagccacttttagttgttggctttgcatccgggtgcatcccaatgatacatcacaggcatctttctggataaagcaatattgtctctaataggtttttatttactttgagacagaaaagaagtaacctttaaagtctatccttattctcttgcttaaaccactgtttttattttttccaattggttggtgaatatttctcctttttcctgttgaacttcaattgaatatggcacactctcatgagttgtctataaacatttaagaagctttggcttctgtggaataagaaatacgcagctgttcattctcccttgcaatgacttgacccaaagtaaaacatctttttttgtttgtttgtttgtttttgagatggagttttgctcttgttgcccaggctggagtgcaatggtgagatctcagctcactgcaacctccgcctcctgggttcaagcgattctcccacctcagcctcccgagtagctgggattacaggcatgcgccaccatgcccagctaattttgtatttttagtagagacagggtttctccatgttggtcaggctggtcttgaactcccgacctcaggtgatccacccacctcagcctcccaaagtgctgggattacaggcgtgagccaccgcacttggccagtaaaacatctttaaatggcgcaaagtaaaactttgtggaagattttggtgcacattggctgaaagacagatacaaatggtattggggaagattggcaagcttgaatgtgctgcttgctaaccagaagtaaggcattctcagtagtgagctgggattgcccaggggagataaagttagtctggtatgttctagagagttccacggacgtctaatgtggacacacgacacccatatgcctgcctgtggggtaagtccttcgtgaaggttaggtgagagaattcaagaggcagccagcccacccaatggcaccttgagctttcaagttctactttgctttggagaagaaattctactgtggtgaggtatatccatccaagtgacttttatcataaatctctgtacacctgtggaggcattgaaatggtctacagctgaaatggccttttcagctcagatcatccagggataaggttttaatcatcaaccagactgcttcggccactgagtacatttttaggaccctgccttctgacttcaattcccccaggaaatacaaagcattcaaatgttagcccaagggtaacatccttaagaaataaaatctgctcttttctcaaaacctgagtgccttccaaagccagaattaaatttctatttgggtcatctgtgcacatattttggggagacataaatcatatgcagctctgttagagatctcagggagtgagctgtgtgttaagaataaaaataaaattaagtaacgtgtgctaatagattagtatgtttcaagtactgaactaaatgctttatactcactagctcattttaatacacctgctctctaaaaagtggccaggcacggtggtcacgcctgtaatcccaggactttggaaggccaaggtgggtggatcacctgaggtcaggagttcgaggccaggcacagtgtctcacacctgtaatcctagccctttgggaggccgaggtgggtggatcacctaaggtcaggagttcgagaccagcctggccaacatggtgaaacccatctctattaaaaatacaaaaattagctgggcgtggtggtgcatgcctgtagtccaacctacttgggaggctgaggcaggagaatcacttgaacctgggaggcagaggttgcagtgagcagagatcacgccactgaactctagcctgggtgccaaagtgagacttcatataaaataaaataaatataaaataaaatagtcctggtgtctcattttccagctgataaaacagaggctgggaggggttaaataacttaccacacagtgtgaagagtgacagtgggaagctcacgctcaggtctggctgactccacagcccgccttggtaatgacttcagaggtgacagacagcactgcatatacttggtgtatgttggctgttccctttttgtcccaaacctgtccttggcttggagctatcccacacctaggtttctcctcccctgctgcctagatactggccagtgcaggcatcagctggtcctggtgggacctgcccctttatgataaagccaaaagagatcccagtaagctttggggtctcttctgactttatcacaaagggggaggtctctgtgaccttcttcacctggctgtataatgaccatctgaagtcggtggggttgtggggaagaaggcctgagccaaggcttcttgtgtgtcagatccaggaagcattttatttcatttcattgcctttccctgggtcatctgttgtagagtctgaggtggtgtctactccagcgctgttcctattactctgtggggctgacaagatgttatcccccagctccaggggccttggccatcatccttgctaagacagtgccagtctctggctccaggatttcagtctggaaagaggtgcctttgacattacagctgactcaggctaataactgggcagttcctttgaaaggcatgcaagcttccttccttagccctgagatgacacttcttggtatttctccatcaaaacatcttgtttctccaaacaggggggtttatagattacttagactagtggttaagctgcccaaggatgacctgagagcaacatgctggatccttatcacattatgggtcacctcccaactcagaacattgagttctgactccccagctggcattaaatggaaaataatcctctggactcttggactctgtacttactggctgattcacagtctagtaaaaccaccttctttcaactgcctagaaatctaagttggaatttttattatgacgtcattgtgtatttagtagctgagactcaggtccatcctggccctgccacgagccaactgagtgtccttagaccagtcccttggtccctcagaccccaagcttcctccttgggaaagtgttgagaatgacttttctagatggtctctgggttgcctttaaaataagtcattccttggaatcatgtcttttgcagtaacatgggtggagctggaggccattatcctaactgaactcagaagcagaaaatcaaatatcacatgttctcataaatgggagctaaacaatgggtatgcatggacataaagatggaaaaaatagacactaggaaccaaaaaacgtggagccaggcacagtgactcatgcctataaatcccagcactttgggagtctgaggcagatggatcacctgaggtcaggagtttgagactggcctggccaatgtggcgaaagcttgtctctactaaaaatgcaaaaaaattagctgggcatggtggcacatgcgtgtagtcccagctacttgggaggctgaggcaggagaattacttgaacccaggagctggaggttgcagtgagccaagattgtgccactgtacttcatccagcctgggtgacagagcgaggctatgtctcaaaaaagaggtaggggagggggacgtggggaggggaggagtgggggtgagggttgaaaaattacatattaggtaaagtgttcaatatttgaatgataggtatgctagaagcccaatccccaccattatgtgtgtaatacccatgcaacaaacatgcacatgtatccccaaatctgaaatttttttaaaaagccgttattaattttttttttttttttttgagacaggattttgctctgttgcctgggctggaatgtggtgacaacatcttggtgcactgcaacctccgcctcccaggctcaagtgatcctcccacctcatcctctcaagtagctgggactacaggcacctgactaatttttgtatttttttgtggagatggagtcttgtcatgttacctaggctggtcttgaactcctatactgaagcgatcctcctgcttcagcctcccagactgctgggattataggtgtaagacaccatgcctggcccattcttaatttcgttgaccaagtgtttctcttactgttttcgcactctcattgccagtgcccccttattgagcagtctgtgggcagagcgcaatcaagggaaaaatacaagatgcgggagaggagacaaacccccaactcccttgcccaggaagattatagtctccagggtagaaagcctgtaaacactgtactaatgattgtgatggagatctgaacagagggcagtggaatcagagggcaagattgcctaagccaggctcatcaggcatatctagaatataaacagatggcacaggtgacatgtttaacttacacaagagaggtcatgtctttgttaaacatccaaaaacctatggcatgaagtaccaagggttcttgcatgtgtctctggttggaattgttctagttctgttggttttgtagtcagttgcctatgagcagagcagaatcaaacaggctttgtgcctctaccgccctgagtacctcaggcacagtagttttgaagcagacactgatggggctggagtgtttcgtccagatctttctgttctttcccatgtgcctcccgggcttccccagtgaggtcattagtgtgtccagggtaagaactgtatcacaagcttcccacatatcttctgtgctaccactgtcttggtcacacacaggtcctttgtatacccttaatgtagtcaattaggacaggctcagccaagctttatttattcttggaaactctgtgtgtgcagttgttattggtgcggtttttatcacattcaagtacacactgtatttttttttaaaaacatattctggggctcatggattatcttaaagctgggcttcagcagcaccagtggcaacagcaacttggccttggtattttcactgctcagccttgtagttgatgatgaaatatttgcgacaaacacgtttgccactcggtcactgacaagcctgtgggttttggggtagcaaaagagcagagtgcaggaaatgatccagtgagtatcttttacctcccagaggagcagaaggctcagcccatccactgtgattatagtcagagctgggctggatctgaagttgagtttaaaatgaaatcattgctgaaaggcgagtgctaacctactgtgaggagttcttgtctatccagagagccccagtttgctgatggttgaaagaaaggatgaaagggagccatttgcgacttttgcagtgtccgtatgatccgtgccactgtgatggccagaatctgggactgaccacaaaacacagcctcacgttgggtgctgtcagtgagggctgtctcccctcctccttgcccagggacggggtgtctggaatgttagtttccttgctgcagtgtgagtgaagcagaggaacatcggcatttttagccttgttctagcaaccctggccacttgatcccaaagttagttcttgtcaagtgttggataaaacaaagcaacatattttttcttttgttcttaacattttaactgcaaacatttaatcagcagtttgacgatgactggttagaaattgccgcataagctcgccttgaagaagttatgctaagccacctcaggtttctccactgtgaggggtagatgcctggcacctggctggcacaggtgttgggaattctgtgtgtcagaagcactgagagcctgccatgaaaggcagctggaaacctggggggtggctgctcgtgtcatttctgataggaaaagggaaattgaatttaaggagacctgcgcatttcagaactatacttaccacagtaaagcctccgggctacggccagccagaatgtgcccttctctccctgcccatgtctgctcagcgccgagggtgagctatgattggggcaggggaggagggatggaggagacaggcactggatgccaggagaggagaatgggaacccagaacacatccctggaatcaatctaattgtttccattcctcctcatgaatgattggggcctgtattccccagagctttttagctgcccaatacagctttcctttgtctcaaaaacctcccaaagatgggcttctaaacctcggaaagccaagccccagaccctcagagccccatgtcaggatggccccggacacaggttatttcaaatagactcatttctccccatcagctgaaaccagtcagcctgaactgggcgtgtttattcagtgaaacccaggaacctcagtgccctggttttaatcaggagacttgctctgtggtaatttggggctcctcgaccaagggtctggtcccagttagtttccaaatgccaggcgtgcttgtttccacagacagtgtctgcgctcacgtggcctcatgcaaatgcactgtccagaaggcaggctcgcgcgagtgcaggcctctttttaatatggaattttgagcccttctggcgaggacttttccagtctttgttttttgaaaagagggtaagataatctgcagcggcctttctggggaagtcatttggagtgttgggttggagcttggcaacatggaaaccattagggccatcacaggggctgactgtaccttgtaagtgcggcatcaccctcagcctctcagaacagggttagcctcatggactctcagcctgtgctgtcacacagggccccccactcagaagggctccacacttggcttaatgatcagctatcactgccttgaaattcttaatttttgaacaaggagcctcccattttcattttgatctggaccctgaaaattatctagccagtccttctaagaggatccaggcaccagcatcggataccagggggaggttgagctctgccactcaccagtcatgagcccttggtctgaggggacactgacctcctagcctcagtgtcctcctctcaaaagagagccatcagcacctctcccttgcagctgtgtgcagagaagaaaagatcatgcccctgtggcacctagcacaggtgtgtcacatggtaggtccttaaaacacacacatctatttgacttttctagtcattcctttcttcatgcaacaaatactattgaacatggactatgtgccaagcgctggctcagccttggagtacagataccctagtaagaaaaacagacctggtcccgccctcatcgaggttagagtctaatctctgacccacttagtgaacaggttgcagaagcctcttctctgtttcagcatatccgagaagaacagcctcaagtctggtgagaccagctgctctggaagatctcttgggcatgcgacatggccatctatccagccttccacatgaccctcgagggttttggggtgctggatatcagggaattaaagccacctgcatgggagtatctcaggtagtagtttccctcatcactctgtgaccagcattagcccctctcctttgctgttgtaaatttggggacctccagccccctcggtttccagagcatgtttatccattcaccacataacaggcagcacccacaccctaggaccgtgtgggagccaggttgtgccctccaacctgccccaccttgaaggagaactcggccttaacgtcagcagtgctggggcaagtcccttgctgaggacggtggggagggcttttacacagagaatctatgattataagggtggtaagaaatactagtaataatagttggacatagtgagtgtgtgttcatcatcaggcactgagtgctttacacagatccacttgtttctccgtagagttgcaaagtcctatcataacctctattttacagatgaagaaactgaggcaggtgcgccctcccagtggcatctctcccactttcgtggcatggctgatatcaccgtctacatgaaatgtgtattgtaacaactccatctctcagggcgtttgagatattctccgcacatcctccttgtccaatggtctgggttacaatgactgggctgtgtatgaggccaaaagagcttctgcttctccggggagcctgggccccaaggggcaggaggtggcactctctggggggcctgatggtggtgcaggttgctgctggggttgctggcttgccttctcagccaggtggcttgtaaggagctaccatacacttcaaagaatgtggtcagaccacatcctacccaggagacagctgaggtgctcgggagccggcccaatgggacactccgtctgtccgggagccagcctttcagagccagcaccagaagcggttggggtgtctggtcattctgttactcctctttccactgctagctgctctccagctgctgacctaattccagggaaggttccagaaacccttgagcaagaaaatgcacatgggctcctgtataaattgttccactgacagtgagctattgttaactctttcagttcctggaccatttctaaatcatgaatatagatttaattttagtgcaggtagtttcacttgctaagaaattgggtcttttctattctttcttttttctttttttcttctaagaacatggattttagaatcatttaggcctgtgtttcaggccccagctctgccacttgctagctttgtaacctaacacaagttaccccttctgaggcgatttctcctataaaatgagaatagtagcccagcatagtggcacacgcctgtaatcccagcacttcggaaggctgaggtgagaggcttgcctgagcccaggaggtcaaggctgcagtgagccatgattgcacccctgccctccaaactgggtgacagagtgggaccctgtctccaaaaagagaatagtagaacccaatacacagcattgttcagaggagtgggcttattttctcttagaccagctgagagatgaaagaacaaatgggaactctgaggattgcaaaccaatctgaccctggatacagtttagagaataaactttttgattcagaaataataaagcgctgaatgctctcctgggcacaaaagccagaaactgggttccgaagctgcgtatccctgtcaagccctgcggaatggccagcaatgtgctttcatcttgtttatcccttataatcctcaaggtgaccccctacagcagtcaccacccccggtttatagtgcagaaaactcgcccaatttgagcctgaatcttctggccctaagtccaacatcacttgcctcgtagagaccctctgaaatgaatgaacaaggtgtgttttcctgggattccagtgtttaattaaaaagggaccatttaggggtatctggagatgctgtgtcaggttgaagatgcctttccaggcagaaccacctgcttgttccattggctttctctttttctttttctttttctttttttttttttttgagatggagtcttgctctgtcgcccaggctggagtgcaatggcacaaactcagcccactgcaacctccacctcctgggttcaagcaattctcctgccttagcctcctgagtagcttggattacaggcgtgcgccaccatgacctgcaaatttttgtatttttagtagacacggggtttcaccatgttggccaggctggtctccaactcctgacctcaggtgctccgcccaccttggcctcccaaagtgctgggattacaggtgtgagccaccatgcccggcccccattggctttctctgaatgaacgggtcattagaagtcctgctccagcagagtagtagttgattgctcacttgtagcacctgttccatcctttactgtagggtttatctcaaaagagaaaagtgtaataattaccctaggaaagaatactagtaactggggctgggcttaaataagtgcctcccagtataaatggacaccttcttttcaaaaaagattttatactcggcctggagaacaacctcagcttatctctgaaagtattatgtgttctctctctccctctctctcaaaatattagcagcggcttcagaatttctatttacgtgaggcgctctgccttaatctggttccgagagtggccgagggacttgtttgaagcaccctttgcactgcaagatgagatgtttttagagtgagcttatttggattggtttggagctgagggtaatgatgaggacagctgaggcctatcccagccactctggtgttctcaggactaaatatcaccttcagtatttttagatttcttgccagcagataaatttagaagcacttgcaatgtgcttttctgggtctgcagcatggaagtgttaagttcctgtccagcttcacctcacaggtggcagctcttaggaggtcagacagcccttccggggcctgacaagccagggtgtgcatgaggtctgtcagggtcccctggaacgagatgcagcatcctggagccagtgaaagctagagctctgaggagccgcctcttctcccaaggccaagaaggtcagaaactgaaggcagtggaaggggtcaggctgtgcatacagcccctttgacatggagaaacggcatctctctgtggtttcctcaggaccagcacaagtctgactggtatcctccatcaggaccttggctgaagagagggaccaccggggaaattgcttcccttccaaaaacagcacaaatgcacacatttgctctcacagctgtttttgagtgtgtcgtgtggggagctgtgcaagggactaaggatatgagatgcaggtgaccatcagtggattaatgaaggagacgcacattaaagagcataacctccatgcagtccacccacggaggagagccatgttccttcttaaacaggggtccgtgacccagttgggtaggaggacttgactagcagagggagggtgctggggggtgagggaggtgcaaggaaagggaacagcatgtgtgaggggccctgaggctgaaaagaacaggaacttaaaggctggagggatgcagcggaggttgatgtggtcagaactgtgctctgaaaggagggcttgctctggctggagggataggtgtgtgaggaggaaacccacaagggcaccatggagtacttcaggggagaggcaaggcaagcttggggacgtgagggtggcggtagagagaagcagcagtgacagatttggaagttgattcgaaactcagagggttgcagggaggggtaggtgaatcgggactcacatttctggcactcacagcagggtagatgctggagctttaattgagagagggagagacacaggacaggggccaagtttagggtatctgtggaataataaagtggtaaagtgaaaatgggataatggatctgaagataaggatttgaaagtcatctgcatatggatgagggattacttctcgagcccttcctgggctctcagtgctttcctccctgagctcctgtcattgatgagcaggagacatacatactgtgctcctcccccttttagatgcagggcgattgctcaatgtaatagaagttactatcactgttactcaatgtcaaggtcaagcccaagtgatcgctaggccgctgtcaggagtgatccgggtttcctgacacctgaagttaatacagttaaggaaaagaatccaaaattacaaatgcacaatgagatataaaagtgaatatttatttaaaatgagaaaaatttgttaaagctgacacacatatcacaaatcaataactttaactgcctgacacaccttgacaatactgtttttccccatctttttttttttgactctgatcacctcttcctatgacaatgattctgtactgttttctaaaggaacaattgagacttccctttaaaatagttaaccaaaagtttgtttttcttttctccaatggttttgaaaatttttttttttaacttcataactcattattggtgatgtcaagtattaggattgttgtcaaatttggggaaatcgtggccacgtttctttcatttctgagcagtgagatttggaagaactttccacaagcctagcttctgactctgtccgtcatgagtttcgtttctcctctgctcccagcactgcctctggtgttgagcacggtaatgcccgttcatatcttgatataacctctgacctgcacccttgtgtcataacacattttgcaataggagtccttctggaagtcattggcataagggattgttagtgatgtattaactctaagtggatgtgactgctaaccactgaacccagctgactgtatccccaactcaatttccttcaacaaggtccccaaaatgcccacccaatgcatgggaacatgtggtcagttgcagtggaaagagacaatggtatcaactgacagtggctaatcttactttggcaaaaaaacacacgtccatgtgaacacattgccaggccccctccagaagttttggaagcaacctgtataagtagaggctgcctgaagtttacgcttctttggcttcgtagtaaatctgcctctgctgaaatctcagcctatcagaccatagaggcattcaggattgcagcacattcatgccttgtaagtgccaaaacattgtcattgcaataaaattttaattcttcgagaccaaagcatttgaaaagcatttcacacagtttcctgttttctttgcttttctttctttctcttttctttttttttttttttttttgagacagtttcctctcattgcccaagctggagtgcaatggcatgatctcagctcactgcaacttccacctcttgggttcaagcaattctcctgccttaacctcctgagtagctgggaatacaggcgcctgccacccacgcccagctaatttttgtatttttagtgcagacagggtttcaccatgttggccaggctggtcttgaactcctgacctcaggtgatccacccgcctcggcttctcaaagtactgggattacaggtgtgagccattgcacctggccagtttcctgttttcttaaacagtgagtgagctgcatagatgtgactatgttcttgatgactcaagatccatgagtattcttacagtgcttgtgccctcagggagtgaccccaagatgtgatcgaatgttggtcccaatattaaatggccccacactgcagtcttaagtttttatgcctgctttttgtgttgtaaatgtttaagcccttctaatgctgttagctgtcatttcttgctgctttaaacaagctgtggcctgagaaataaaatcagccatcttctttcagtcagtaggctgttttgaggacttgttatgtgtcaggtgatgggctggaaatttacatatagtagcaatgactaataatcacaaacatccattgcatgcttgccctgtatcctgtattccaagctcatcacatgtgtccacacatgtaatcctcacagtaacctaggaggtcggagctactgttgttatccccgttttgcagatgaggaggcccagacacagagaagtgaagtaacttgcccaaagggtcctgattccaaaaaatccaccttttgattccatcatgctgtgacttagagagtcatctagctgggtgcagtggctcacgcctgtaatcccagcactttgggaggccaaggcaggcagtcacgaggtcaggagttcgagaccagcctgaccaacatggtgaaaccctgtctctactaaaaatacaaaaattagctgggcatggtggcgcgtgcctgtgatcccagctatgtgggaggctgaggcaggagaatcgcttaaacccgggagacggaggttgcggtgagccgagatcgcaccactgcactccagcctgggcgacagagcgagactccgtctcaaaaaaaaaaaaaaacagagagtcacctaactatgaggccagactcaaaccattaacataagaatcagaccaagagagcacaatctgtgtccccagggaaattacactttggaaaatgtgtgaaaggaaagaatttgtagtgccctctctcggagagccatgaacagggtctatggcgtttctgttgactgctcaaactctttccttcatttcctgctcattggctgcattctggatggtggagactgctgaagagctcagtgctgggggtgtgagctgttctccaagcattttaggatgtagtggtaatacaggttatgcatatgaggaggtgggggaagatgtagggataaacatgtgatctcgttgagagaatgtggctggtcacttctcagttctgatctcacaggtgttttagagaagtgacctaattgtgctggactcctcctttttgtgacctagcaacctgttaccttcagggagcactaggagcattggttgctgttgaacagttctcacaataccaggatggagggctctcacccacagaagcacaggcctgcaggagcctaggtgacttgggttgtccttatgacttaggataccaggatctaacagacgaattcattcagggagacatgcagggaagtgtaccctacacgcagtggccctttactgagtcttcttaaagttcgtctgctttttttctttcttttttttttttttttttttttaagtttcctgacatggtgctagctgtcattgcttgctatggctggaaaactagtaagcaagcttcacttcagtccagaggcgtctttaagtacctgctatgtgctgaactcatcagaactttcacacagcagaatttcccaaataacttctttgaagaattctataaagtaatatttgtctataaaaaggaaaagataactaaagaaagtggtgtaccttccaatctttcttttctcggttttacttattttttttttagagacagggtctcactgtgtcacccaggctggagtgcagtggtgcagtcatggctcactgcagcctcacactcctgggctcaagccatcctcccacctcagcctcctcagtagctgggactacaggcacacaccaccacatccagcttggaatgtctttttaaaaaacagctttccagtctgggcgcagtggctcacgcctgtaatcatagcactttgggagcttgaggcaggcagatcagctgaggtcaggagttcgagaccatcctggccaacatggtgaaaccccacctctactaaaaatacaaaaattaaccaggtgtggtggtgcacgcctgtaatcccagttactcaggaggctgaggcaggagaatccctggaacctgggaagcagaggttgcagtgagccgagattgtgccactgcactccagcctagatgacagagaagactccgtctcaaaaaaaaaaaaaaaaaaaaaaaaaaaaatcaaactttccaggcagctagtgggagccatttgcttcaagctttgtcctcccctgttgggtctacaatgttgtataaggagaaaattagtttagagtcatggtgctgagacctgtaaatacctaactgtattcttagagaatgtgactgttaacttcctgttcttagagaatagactttggtatgttttagaattatttttttatacgaacaaatgaatccaaattgtatcattttatttagttgaggttttgctgactcttaatattaagagtgaatataatgatgtggattgatattagataacattactgtgtcagtattaactttcttgagaatggcaatgtgatatagaagaatgtcttttgtcttaggtgatacatgttgaaatagtgatagaggaagccatgtgtttgcaactttcaaattgttcagaaaataaaagatgttaacaattggtgagtctaggtaaagggtatatgagtatttattgcactatcctttctatttctctaagtttgaacatgttcagaatgaaggtttagagggaggaaaaagtaaaattctactcccttgtcctctcctgtctctctgaaggtggaaatcatcatgaatgaaatatattaagatatcagatcttttgcctctggttcccttactccacacatttcctgtcaagctccaaagccaccagtggaatgtttatacaacgtgcaagatgattttctgctaggaaggcgaaacctcaataatcgccccgttgactggctatttcagtttgttgggaggcccatgtggtgttactgcccctctggtgatgcttcatgcatagtgaatgtttcaaactgcaagattttcctctttgaggagagaagtgtgccaggtatcagagcgaatgtgtgcatgcgggagcaagcctgtcctgtaaaaccatcgctgtttacacacttaggaaactaacactgccaagaatgagcatatggcatgcacaaggtctctcaggcatgtgttggtggtttagtgtggagacctagcttaatgttttgatttaaacctggggatgcaagagcctcttctagatcaagtgtacttatgtggggtcttcattcagagcccatgttttctttagcctgagatgtgtgccctgatgtggaagctgcttgtccacatagaagcagacactgctctgaggagtattaccttgcttaggtattaggcttggatgtcagcacaaattgcatgtggccaaaataactcctgaaaacactttgagtggtccatgaattacactgacaggcacctgggaactgagactggcagaggaaacacacattcactctgggtctatgcccttggaagagagtggcagccaaaactcctacaccatgtcagccagggcctctgtggcttttgggtggtgaagagccctctgcagtggactgcccgagtttgaatcctggccccaccactcttacctatatgtccatggacaaactatttgactcctcttagtctctttccctcccctcccttcccctccatttccctcctctccttctcctagtcttctctttcttttctcatgtggtttgtctccccatattgcccaggctggtctcaaactcctgggctcaagtgatccacctatcttggcttcctgaagtgttggattacaggcgtgagcccctatgcctagcctctgtgtctgttttcatctgtgaaatgtgaatgatacttacctcatgggttattaggaagattaaatccattcatttgtaggaagcacttgtgacagtattggcacataattactttaatacaataactgccaggtgcaatggcttacacctgtaatcccagcccttagggaggcagaggccggagaatagcttgagctcaggagttcaaggcctgcctgggcaatatagtgagatcctgttctccataaaaagaaaaaataaagacaaaaagaatacaataatcttttatccacagagcatatgttggacctctgatggatgcctgaaactgcgataggactgagctctagatataccatgttttttcctatacaccaatgggcagatagcatatacagcatggaccagctggacaaagggatgattccgtcctcagcaccacagagccggactgggcaatatttcatcatgctactcagagcggcactcgatttaaaacttaggaattgtttatttctgtatatttcccatttaatatttccagaccatagttgacctcaggtaactgaaaccagagaaagtacccatagctgaggccaggcgtggtggcttacacctgtaatcccagcatttttggaggccgagacgggtggattacctgaggtcagaagttcgagaccagcctggccaacatggtgaaatcccgtctctactaaaaatacaaaaattagctgggcgaggaggcacacatctgtaatcccaactactcgggaagctgaggcaggaaaattgcttgatcccaggagacagaggctgcagtgagctgagatcacgccactgcactccagcctggcctacagagcgagactctgtctcaaaaaaaaaaaaaaaaaaaaaaaagcacccatagttctttgtagatagggggacagctgtataagcatttattactattttttttcatttaagttaaatgcattcaaagtgtggctaacctataaagggtaaaaagtgtgcattagaattggcagttaaagaaagaaaaattggatttcttcctcctgtgggtggaaacctctacgtgatgctgctcttgtattccttgcaattgattaagagtgccttagatgtgggaaagctgtttctgatcctcttatcagagtgtaaagtaaaacatgcttgactggttaataaaaacggaagacagttagaaaacatttgtaggctgtgcgatggagtggtccagaattgcagccagtagttggtgggctggcctgtggctgctctaggaagtgctcagcacaggaagtgacctttatatttcttcctagccttactgtggctctgtctcttgaccaatgaagtgagctgactactgccatcttcctaagtaccataaatccaacagcaccgtggcaagtgggagatgctaattgtgtggtctatttggttcctacctgagaaagtgttctgtggcctctgcctaaaatcaaaggcctgaagacaggaatgttgagaaggaaagccatcaggaatcaatctgccagagccaggaaattgggctggaggtgtcttatcaggtccttatcttaacgctgccctcccagtgaagcaccaactaccctagatagaggttcccatttataactggggactttgcagccccagactcctgagtagctcccaatcccctggtgaatctgggtaatgaactaaactgctaggaatgccccagcttcccttctgactgggcctttgattatgtcacctaagcctactacccctcgcaagcgctaaagaggttgtggtctggagggagtgaggctccttagccttagctgatcacaggaacatctttttttgcttgctgcccttgaggtattttttaaagccacaaacactgactcattcaagggccacagcctcaatgaccaacaaactgttgagagaaatagcaggcccaggtcaacccttgatttcaggtcttggcagtgtttctggctgcagcctgagcccctctgtggtctggggaatgagcaggccttctcataccagaggctcagggcaagaattcctgctctcaagtttcccaagtagagtattccttgatgaatttgaatctgaccagtcatggatttcagataggaagaggtaagagtttaattttagtagcaatgctagggaaagattaaaatcctgtctacatatcatctgagaatggttaaataaatcatagcacttggatatggtgaaatgtatgcagccctcattaaacattacatctttgaaggaaatgtaatagcataggaaaatactcatgaaatatccagttgtggtggggaagagggtggagacaagaaactgtagctgtactgtggtccagttctgtaaaagcatacacatacgtgaggtgtagaaatacaccaaagtgttacctagtgattatcttgggggtgtacacacacgtgatttttatcttctatgtattttctaatatttgccaaatgtcataccctgacatgtattatgtttgtgatgtttattttttttgacacagggtctcactctgttgcccaggctagagtgcagtggcaccatcttggcctcactgcagcctaaacctctgggcacaagcgatccttttgctttaggctggaaagtagctaggaccacaggcatacaccaccacacccagctaatttttgtattttctgtagagatgtagtttcatccaataattgcccaggctggtctcaaactcttgggctcaagccatcctcccgccttggcatcctaaggtgttgggattacaggcatgagctgctgcgtctggcctatattatgtttaaatgttttattatgttaagcctcccgtagcaagaggaaactgaagttttgaatactcaaaggtggatccatctctgggtcacaggcagagggaaatgctaaaatgtgttattcagagaacaaaattcaacagcatttatctattctcttctttcagtgttgaggctaggccttcatgctttgttggtggatctgattgccccaatttatgtaagctcattgtttatgctagctttttgtttggcaggaaaattacatattcatcgatttagatttttttaaaatcttgtttatagtcaagtgatcattcgaaatatctagttcaagtacacagggccttatctgctatcccaggacctgaaaacacaatttttttttaaattcatttaatggcaagatgatgttctttgaaaaacactaactacgggaaagaaggaagcactgtttagaagcatgtgggcagctcccttctctgacttccttcctaactgcaagtgacccaggtggaccaagatgctgtcagaggccttcaaggctgaaattccattttctctaacagctttggggctggaaggctaaccagccacagaaatatctggcaatcggacagagagacatgagaccacaaagatgttgataaagcttcttatcctctgcttcccccagcctcctcattaatggcaaagattaaagacaattatatctacccacgggaactagatggatcctcctctgccctccacaccagccccccagtaaattgggtggatggatgtataagtaaggttaacccaactggaaagtagtttatgattcactttcatttcatgaaaaacaaatccaaaatgcagagcaaaggaaggaaaacaaaaggggaagcatttacagtccttagtgggttgctccaacctaaaaccccttctcattggttatctttattgcgtaccaagacttcgagcacctcccccaccccccagttttctttttttaaaagaacagaagatgaaaacgctatgagatgtatgagctctgattatgcccaattacatttggcaagcctaagacaaaaattaatgggaccagattattcttctgtgtgagatgtagtattgcccagcctaactattttagctcttgccatgctgtagatcgtcaaacaaattaataacatgctaatgggtgcctttcaggcttctcgtttatattaatgagttccactccatccgataaccagtgatttatagcactggaacttgcagcctggctctatagattgtcttttgtcactctttctggggtggagcagccagcctaacaagctaaatggtagggttttgtaattgaattctaaaatgtgaaacgcctgatgcaagaacatttcattctgatcatggctttggaaattgaaaggccttcagtacgtctcccactacccaacgctgaatgcagtctgatttgggtttccacaacttgtgaagcaagggtgtgacaagattcttaatggagggtattcatgctgagctagcatggcagttagattcagcgggctgtaaaatagctcctctaaagaaaacaatatattcttaagagccataaaagagaacccttcctcaccttgaaggtattcccacccctcatcttccccccaccaagcgtaggaggcagagagctctgactctgtgccaggcactgtgctaactactttattcttgactcattcagtcctctgtgtgcctttatgaaggaggcagcagtgttattcccattttacggagatgaaactggagcacaaagaggtgaagtagctgacccattctgagagctgctaagtggtggagcaaggctgccagcccaggcaacactctgctcctttccggctcacccgctgcttctggctttgtagccctcttatttctaatgtaagaggagtgcagattgggagccccagatgagcaaactccaaatgccttggctatgagggccccgagagtagttgctgtcagttgagcctgggaaaagaaaagccagttagcaaatgaaaaaatccgtcctcctgaaggtttcagtgagggttcatgtgctggtttaaaatgtcccatcaggagtggtgggctggcaggctcctaatggagcaggatgggccgagctgccacctccagcagcctgcagcctccttgggctttgcaaacaactgccttcattgttttctgggaggagtatactaccgtggctttccaaacacgcagctcctccaaataagggaacctgatacccttggagatcttggcttaaacatcagaggaacgtcttgcttaaatgattatttttttaaaaaaaaccatcaatttggatttcattttctttggtccatgaccatcgtgtatagccgtgtcctagaaatgatccgaagacagcttatttttcataagcaacagtctggaaatttaattgatatgccattcctgccccccagtccaaacccctgcccagtctatcctttttacctactttgactttgattcttttagttcttcctattttacaatcaccagccattccagaaaaacatctgctaaaaagatccgttccctgtagtgggaattaagtacatattttaacttcagacaattttacttaatgttttctacattgcatggagcagaggattaatgcagacgtccctgaaaagctcctatgcaaccttaagctgtgtcttcaatcattcaaactgttcaagggctggaatttgaaagagggtgaggaagtaccaagaatgaaattagataagggatctttattaatttaaacatctatgcaggcccagttgttcataggaaacactgaactcttttgcttttgtgtccccaagcccaccagttttttatgagaagatcacaaataaaatgacttttaaaagtaatgggtttaggctgggtgctgttgctcacacctataatcctagcactttgggaggccgaggcaggcagatcactcgaggccgggagtttgagaccagcctggccaacatggcaaaaccccatctctaccaaaatacaaaaattagccgggcatggtgttctgcgcctgtagttccagctactgggaaggctgaggcacaagaatcgtttgaacccaagaggtggagcttgtagtgagccgagatcatgccactgcacaccagcctgggcaacagagcgagactctgtcccaaaataattttttttttaatttttttaaatttaaaagaaaaaaagtaattggtttaaaaaaaaaaaaagaaacaagatcattcctcacccctaccccaggtttctttctataacttttttgcattttgaaattagaaattaaggccttagttttatgctaaggctatgccatgaatgattgagtctggttggtaattggcaatgaaatgtggatatgtattctgtggtgtgtattggagtagttgatagccaagagtcctgggtctggttccatttcatactcaccaagtgagatcttgggcaagtcagtttggtttctctgagtgtcttagtctgtttatgctgttataacaaaacacctgagactgggtaatttatttaaaaaaaaaaaaaaacagacatttatttctcacatttcaggaggctaggaagtccaggatcaaggtgccagcttgttcagttgtcaagtgaggtctgcaccctccagaagggaattacagtgtttgtatatggtagaaggcagaaagtcaggatagcccaatgtccctgggaagcctcttttataagggccttaatccccttcacaagagaggagctttcatggcgtaatcacctcttaaaaggccccaccttttaataccatcacgtcggcaacacctgaattttgtttttttctttttctttcctttatttttattttttttttttttttttgagatggagtttcactcttgttgcccaggctggagtgcaatggcgtgatctcagctcactgcaacctccacctcccaggttcaagcaattcttctgcctcagcctcctgagtagctgggattacaggcatgcgccactacgcccagctaattttgtatttttagtagagacagggtcaaactcctaacctcaggtgatccacccacctcagcctcccaaagtgctgggattacaggtgtgagtcaccacgcccagccaacacctgaattttggaggggatacattaaaaccatagcactgagtctgagcaagatgataaaaattgggtagattgtctggttatatccagcttggaaattctccagtaggggtatgtttttgtttccggatattctatgcgaaagcaccttagaaacagttcaccagaatttggctggcattctttaagttaacctcttaaaaaatatgtagttgagaagactggagagagagagagcaagctctaggtacaaagactaaagagaagcaggggacctttaaggaaaagcaaatcattcataaatccgtggaacacctactgtgtgccgggtaccaggctaggaagtggggatataaaatgaatacgtacagaaagtgccaagactaaatctagatttccttgtgaaatacttttaaaatgtgttttctttgcatggtaagtccttttctggctacactgtatgtataaataaaagcctcacttgttgaaagtcatcttaaaactcatgaataggataggtggtaaatttctctaggtctttgagcaagtcacaggtcagagctgtgcagaagttgggcctttttaaaccaaaacattttcttcttcatcctgccataactgaagcctggaggacatcactgtccctacagccttctccaactgtggcgatttatttctgcaatgtctagatatgagtcaggatcctccttattgccatttccagaccatttctctgtttactcctttaaaagaaatagtttttttgaagcgtacagcatttcagattatgccacctgctgtctctccttatttcagtggtgtgcagttctgagattcctgtctctgccccttcctggaagatgctggcctctgcctcactgccttgctttgcacaactcccacctcattcttggcaatgtcaacatccacagggcacactggccttgtgattccttgacctactcacttccaatggtcctgtcctttatctgacttcagctacctgccctcagggttataccttgggccttatgaccagtaactgcatcatctctgaaattatcttattaaacttccttttctctgactaccattcccatctttccagcttaattttcttggtcctaacactctagtaggatcttccactgtccatgaactctcccaccctcctccttgtctccctcccctccttagattttatgccccatcacactgccttgcctttcatcctctttcaccctttctggaaaatcctaaccctggttaaacccaactctgccctctccctgctggcatcaagggagctcaatgtggttgaagaatacgcacacaccatgctgattggattcactttatttttatttacttctttagagacaaggtattgctctgtcacccaggctggagtacagtggcatgatcatagcttcctgctgccttgatcttctgggttccagcaatactcccgccttagcctcctaagtagctgggactacaggtgcacatcaccatgcccaactatgaattcactttcagtttttagcctgttatggactgaatgcttatatcacccccaatgtgatggtgtttggagataggacctttggaagtgattaggtcatgagggtggagctcttatgaatgggattagtgcccttataaaagggaccccaggtagctctttagctctctttctgccatgtgaggacacagtgagatgttggcagtctgcaacccagaagagggccctcaccagaacccagccatgctggcaccctgatctcagactttcagcctccagagtggtgagaaataaacttctgttgtttataaactctccagtctgggacactggttatagcagcctgggctgactaaggcatggtcatggtcacagtcacataagagagctttctgcttagcctgaccatcccattcattccctagccagctcactctattttcccacacctctcctctctgaaaccttaaaagcctgccatcccttcacattcaactactgactttgttttacatatcactgaaaatatattacagaagcaatcagaagaatttccttatattacctttcccaaacagagcactcttcctgcatctgtctccatataccctgtcagccctccagcagggactcgttcctcctcctgcctgtggccaacccccaacttgtacgttagggtcccacgacctctagcctgtgtaagatcattgctcctgtacttctcccctctctgctggatcattctcatcagcaacaaatatgctatcttatataacaatatttttatttttaatttttaaggataggatcttgctctgttgcccagacgaaagtgcagtgatgcaatcataattcactacagcctcaaactcctgggctcaagtgattctcccatctcagcctcccaagtagctgggactacaggcttgcacctccatgcctggctaatgtttaaattgtttttgtagaggcccggcgtggtggctcatgcctgtaatcccaacactttgggagggtgaggtgggtggatcacgaggtcaggagtttgagaccagcctggccaacatggtgaaaccctgtctctactaaaaattaaaaaaaaatagccgggcatggtttgggcacctgtaatcccagctgctcaggaggctgaggcaggagaatcacttgaacccgggaggtggaggttacatgagctgagatcgcaccactgcattccagcctgggtgatagaatgagactcggtctcaaaaaaaaaaaaaaattgtttttgtagagacacgagggctcactatgttgcccaggctggtctcaaactggcctcaagggatcgtcctgctttagcctcccaaagtgctgaggttacaggcatgaaccaccacacctggcaagaaccatcttcaaaagtcttttcacctggcctcatgcacattgtctttcaatttccgtcttctaactcatagcgatactcctgggaagcattggccgtagtcagcaccatcattttcccactgattctctcccatcagcaacaatcaaggtctcatctccactgctcctttgaaatcactcttcatatggtatcaacaagttgtgtattgtcagactcaaaggcccattgtcacttctttcttgatctctctcttttctttttgacagcgtctcgctctgttgcccaagctggagtgcagtggcacaatcactgttcactgcagcctcaatgaccccaggctcaagccaccatcccacctcagcctcctgagtgggtgggactatggccctccaccactcctggctaactttttaaattttttgtagagatgaggttttgccatattacccaggctgatctctaactcctgggctcaagggatctgcctgcctttgcctcacttaaagccttgagccactgtaccctaccattttgttcttttaacatttattttgacataattttcagatgtatagaatgttgcaagactagaacaaagaattttcatacttcatttacccagattcccaagtgttaacattttaccgaccagcctggccaacatagtgaaaccctgtctctattaaaaatacaaaaaattagccaggcatggtggcatgcacctgtagtcccagctacttgggaggctgaggcaggagaatcgcttgaacccaggaggcagaggttgcagtgagctgagattgtgccattgcactccagcctgggcgacagaggaagactccatcttgaggaaaaaaaaaaaatttaccttgttttccttacccttacccttaccccagtctctctcacaggtgcgtgtgggtccacatgtgcaaatttttttctgcaccttggaagggtatctcagcagcatttgacacagctgggcacttattccttcccggaacagttcctgcacttggcgcctggggcatgacacccttgattctcatctttcctcaatggcttctccttctcagccccttttgagaattattccttctcctgagggttgagagagctctctaggcccacccttgggcctctccaccctggggcctcttcttcatctgctccagttccctaggtgaccccatctggctctgagagtcacttcgcaagtactaccagccaggacgctgccctcagccaggacgctgccctcagccccaactctcctccagcctcctcgtgtcccatcaggtgtcccctgcccagaactgcagtcctagtctcacctcccctgcttctctccctgggccccccctcgacatcagtaaatggcatgatttatagttactctgctgaaaacctagcagctatcctcgattcttctttctcacacaccatacccagtctgtgagccagcctgtcaactctgccctcaaaaaacactgtttccactgctgttgctctagtctgaggcacagccctcactcttccactgcatccatgacctcctaacctgtctccttgaccccactcttgctcctcaaaaccagagccaggttttaaaagttcaactcttaccatgccactggtttgttaaacttagaataaaatccaaggcccttccacagtggaccaagtcatttgtgatttggcccctaccttcctcagtgactcctttattaccaccctctgggggtttgtacctgctgttaccttcacccagtggccccatcacaggctccctgacttagtgcaagtctctgcttcattgccacctcctccaggcagccctccctgacctccctatgagggagctccactcccctgtccctctccgttcgctttcctggcttgacttttcttcctatcaacaactgctatctgccatacctgtattttcttattgtccatcttccacccactagaatataaggtccttaaggcaggactttggtctgtttcatatcaactaagtaccttgccacataagaagtatttcataagtatttgttacatggacaaaccagtaggcaaaggtaagatgactgactggattcggaccacagtagagaccagtggtcctggccagccttcacatggtctgtgaaggctgccatcttcacagaccatgactaaaagaacccgaggaaaactagctgttttcaggccaaggccaacatcttaacactttgcaaagtaggaaagatcatctttgtgccataaggcatgtagcttctgcagctgttttagaagtttccaagtgagtctttgctaaatcactcccagtcctctcagagaacactgcggcttttccttccctcattactggggagggagcagggtataggatgaacagaaggaatttagccttggatccaggggacttaggccagtgtctcaagcagaatgaaatacactatatgcttgacttaaggtctatttagatttgctcctcccttccctaatttggtagatttcaaaaatatatgggctagggtcgcaacttggcaaattagtatatatggcttatgttttaaatgtgtaaatcagttgcattcaggttcctagtgccttcgtttaaatgatacctttgtattattggtgtaagtcactctaaaagccaaaaaaaaaaacctcttattagctacaagcaaggatgtttctttacagaccactttgcccaaccaaaagcagcccatatatgttaaataattttttaaaaattaaaaaaataaacatatcaggccgggcgtggtggctcacgcctgtaatcccaacactttgggaggctgaggtgggtggatcacttgaggtcaggagtttgagaccagcctggccaacatggtgaaaccccgactctactaaaactacaaaaattagcagggcatggtggcagacgcctgtaatccaagttactcgggaggctgaggcaggagaattgcttgaacccgggaggcagaagttgcagtgagccaagactgcaccattgcactccagcctgggcaacaagagcaaaactccatctaaaaaataaaaataaaaataaacttatcagttagaaggatagttttcagtcctgtgccccacgccgaagaacactgtgccatctctgttctactctgtgatcttggaaactagaattgccagttttacagcccatgtgttctgctgatggaggggtcttcagctttccctcctccacattgggaatgtgcttacagaccccttcatcccagtgggagaggctggctgggaagcaaaaactggtccacttgggatgaagacatcaaagctgattctgatccaattagaaaaagagactattgtcctcttaattcccaaagttatcaggctgttatgaatacttagccagtttccttggggattgctgtggcattgacttagatctgaagctcattgatattcacacataatgacaaaccccattcccccatatgtgcagggagcctgggaaggctgggagccacttgctctgtttccactggcagatgaaggctttcagatttgcacagtggctgtaaaatgctgtttttcgtcagttggtcttaaatgaatgttagtctcttgtgtctcagaaagaagaatgtgaacactttattgggaaaaaaatttataactgtttccatttatagcacttcagagaatgaacatgagaaatagtttaagctggtaattttagctattaggcctgtctgtggaattcctggagacacttatccatccgtgttcaagacaaaatgattctctcctctgcagcacacactcttcttttgttccatggtgtttctgcctctggtttttctttctttctttctttgtttttcttttttcattttttatagagacgaggatcttgctatattgcccaggctggtcttgaactcctggcctcaggcaatcctcccacctcagcttcctgaagtgctgggatttacaggtgtgagccacagcacttggcactctggtttttcttgaaggcatcctgcccttgatgtctagatgattttcatatctgccatatgtggttaatgagcttcttaaacaatctgctatcttcgattactatcacctattacagagaagaaccacacatttaaagtttaccaagtattttcctggggttactgggattggcatggactgctgaggtcagggaggaattagatacaatcttggcaaaagaaacttttggccttctctgctccgtggccacaatgtaaaccttaagtccaggtacagtcttgaaaatgcaaattattcatgggatcgtgcaagggaagatagctactttgatacaaatgtaatctagaaagacacttgctgtagttctgtttcttctgtacttcaccatttgattatttcggtttcatctcatgatttttttccacatccaaaatccatcctaaggccaatagaactgatttgctgcaatttaggaatccctttcaaatgtcttcagggactaggtcatttatctatgttaatttgttttaaagaagctgttggaggtgaaataattggaaattgtagaagacaactggggagagtgaggactatagttagttacaggccttgcctaaaagttactcaaatataaaccttaaaaaggctgtgtgggtcaaccaacacacatctgattagtcccaggagctggttgtttctgggatactggttgcctagagggtgtgtttttatcatctctcaggatttggttacctgtccccaggcctcctttgttctggtctgagggtcttgtgctgagggcaagacccactctgtccagcctgcctcggagggtgtctcatgcattgcctctgaactccagaagaagccatttggatgggaaggaagacttggggtcagggtagcttcaagttatggcctgagcagagtgggtttgtgggctcatgagaaatgccattagtttcctccttacggtcctggagtcaggcatgggtaaattccaactctgctgcttacaagtagtatagctttaggaggcaaattgcttggcctctctaagcctcattttctacctttgagaatgggataatgataattgagttttcatgagataaaataaaacaatgtaggtcaagcacttagcacagtgcccagtgcatagtaagcacgacattagcattaaccatggctgttgggacttagagactttctagatgtgccatggcgaactcctgaaattaattgcaaaatgctgtgttgatgtgtactttgttttttcctgctctattacccttcatcagattctaaatatggaccaagatagaataggaactttgatgttaagggaagctgagtaagttgttacagaactcagatgtttgagaattgacaatcaagtcctcctggacctagaagcataagaattctgttagattagctcttgccacccctgtcagaacttaactgttcatagatttatgttattgacccactttcttcaagagcagaggcagtttttcaggcagtgctgacgccagaattggaaaagcagattctcatttaacaaacatgacctcagtaaaaacagccatgttgttggtctccatttgaaggcagaggtagggattgggagtatgtgattaataaacccagagggactatgaaggtcactgctgatgttatgaccagatgcaggaacgtccagaggaaggctatgcttcgtgtcagggccatagagcagagcgtttccatgtatcttctgtcacagcccctataccttccttgtgcacccaggagaggagtgatttctgcaacaacacagaggcctagcctgcaggagagtgaccttggaaacgtggctgagggtcatccttcactgtcatctcccggtgggcctgtgagctccctaactaccccctcccgcccctaccctcctcctgggccgaaaacaaccaagagactaatgaggcaatggaagaatcacactctgtctgttctgggctctgtctgttctgttacaatttttttcagacctgatttaaagtgctcagaaaacttgcaaggggcacatggcttctaggggacccagctattggaaatctttgattgttcttgcacttaggataactctgaagagtgaccttatcttttgtttgttttctttgtttatgcaatggggtgtttttaggtgattgaatagaaattcgtgaagaaaaagtaagatggataaaaggatggatagaagaacagatctagctaagtaggtgataagacaagtatagcaaaatgtaaatgataggctgtagtctaaatagtggttataaaggtgttcactgtaaaaaagctttcaacttactggcttttttctggagtatgtgaaaagaaatgctttcaactttcctatatgtctgaaatttttaataataaaatattgggggaaatgagttgaaatatctggaaaaataaaatttagataatggctagagaaaattttcatggatttgggattcaacataccacccccagcctcattattatccccattgtgttcaagctctctcttcctcgtggcttattcattcggtcttgatcatctctggccatcatgttctaagtgatgtggatacgatggtgggacaaggtggctctctgactgtggaacatgcatcctttcacttttctgggggagtggagacagacaagcaatagtgagatgttctataaaaaagaaaaaaaataccacggaaacagagtgaggagagggttcagctgccttacggagagggctcaggaaaggcctctccaaggtaaaatagaaggggaccctcgaagtcaagtaatacctggggaagccctagcttgtgcggagagcctctgtatgttgtgcagaaaactgtcttcaaaaattggaagatttctgaagaagtaggtctatttggtgactggaaccaactgctcattcatagttgcagaattgccccagccatataaagaggagatctgtttatttatttatttggcagagtcttgctctgtcacccaggctggtgtgctcttagctcactacagcctccacctcccagattcaagcgattcttccacctcagagtcctgagtagctgggactacaggcgcacatcattaatttttgtatttttagtagagacagggttttgccatgttggccgggctggtctcaggctggtctcaaactcctggcctctcaaagtgctaggattacaggcatgagccaccacacccagccaagagatctcttcttttgctgtgtatattttttaaattatcatacagtaaatttgacttttaagggtgtgtgtacagtcctatgagtcttttttttttttttttcaataaagacaaggtcttactatgttgcccaggctggtcttgaactcctgggctcaagcagtcttcccacctcagcctcccgaagtgctgggattacaggcatgagccatgacagcacccagcccaagtcctatgagttaacacatgtattcatttgtgcaaccaccaccatgatgaggaggcagaacagttccatccctccagagctccctcctgctatgcctgatagtcacacccttccctcccccagccccggcaaccaccaatctgttctccatggtggtagttctgtcttgtgtgaatatcatataaatggagtcatgcagtatataagcttttgaggctggtttcttttactcagcataatgtccgtgaatatgtttctaagcctccaaggggagacatgttgagagtcctagctaaaaggcttttgttttgctgggaatgatgagaagagcagaaacagcatgaaaatggtgatggatggtgagaaccaaaaacaggaatgggagatctagaggtggatgctggaagaagggtgctggcgaaggaacctaggaatggaaagggggatcttttttaaaatattttgaggccgggcatggtggctcatgcctgtaatcccagcactttgggaggccaaggcaggtggatcacttgaggtcaggagttcaagaccagcctggacaacatggtgaaaccccatctctactaaaaatacaaacattagctgggtgtggtggcgggtgcctgtaatcccagctactcaggaggctgaggcgggagaatcgcttgaactggggaggcagaggtcgcagtgagccgagatcgtgccactgaactccagcctgggtaacagagcaagactccgtctcaaataataataaaaataataaagtagggtctcaccgtgatgcccaggctcgtcttgaactcctggctccaaacgatcctcctgcctctgcctcccaaagtgctgggattacaggtgtgagccaccacatccagcctaaaatttttctttactaatttttttttttttgagacagggtctttctatgttgcccaggctggcctcaaactcctgggctcaggcagtcatcctgcctctgcctcccaagtagctgagactacaggcgattataatgttttcttctataaatgtgcaatgtaaatctcttttgttttccccaactatagtattgggtcattgagttgaatttatttgggcaatgtaccaagagactcctttcccaaggtgcaagtaggcccaggacagaggctgcccatcaagtttagaccatcccagttacagacacaagatgcaggaggggaacttttagcttagtaaaagaagaaacaacggagtaaaagaagtgcttgcctctcagtaacctgggcatctcttcccaaaaagcagtcagaagcacccagccaattgagatgtcatagaggcccatgctgggagagtggttggagagcgctacccagctcttaaaaatactgaaatccctgagtgaatctagcattttgtgcacgtgtgacggctccagggtagagcagcaggcccctgtgttcccagccatgctatcttaaggatgaaccctcgcctggcctccctaagattgcacgtatagaatggccttgtaaactacaaaccttttgaggtgtttttgttattactgtccatttctgcacctttgtggttaagaaggcctgcaagataattaaaagaggggaaaaaagggccaccctgttttccgttggcaaggatgcattgccatgttcctctggttaccgccagagcaaagcacgcactaggtcctgctatataatgatgaatccccagggacccccgatagtgatcgatagcacccgcctaactctggggcttgcataatgagctgcgtagccctgccagagtcatcatccagcctcggggaaacctcccctcccccactgtccacttgtacagcaaatgtccccctccccaccggtcccctcggttgggtttccttttgattggcagagaccctgtgatttccgcctggattgcctgacagcccccctccgcctggtctaattatgccagggctgttcttgggccacagcgaccccaggaaggctttatcagattgtccaactgaccgtgaccagatctccagcacctgcctcttttgctgactgaggatggaaggtgtttacacacagcggagctggcagctgattgactggccagggtcctgggctgaggacggccagtctgagtgtcagtgatgaaaaatggggtctgcctctccacccagcctcattaacacccctctggctccaggcggtatcaggtggggtgtgtgcaggcacacagcctgctgccagtgttcagggcctcctgacagatttctggctgcagtgctggacttgggtccatctcttatcattttaatttatttacaaatatttatttattttataaatgttcctatgtgtgtttaagccctccgctttctccacctctctggttacagttacccatcccctgcttcttgttcatccgtcaacaactcaccctaagtatgacctcctcacctctgtcttccactctcacaccttttcttccagcgtcagctttcatggaagccagtcaataattcctgtttgcaggccgatttattagtgtgattaaagttctgtttctgaatagaagctttggtgctgcctgccttttccaggtacccaagggtgattctggttatacaaagaggttctgtaaggcagctcagacattggggccaatccttctggtcactctggcaaatggcccattttgataagaacattaaatcatccaaatcctttagggttacacgggggtcatttgctcattaatcaccagtggcctgagaagctaaaggtttcccaaagctgagccatctctgccctacaggatgatgtgacgtggcccattgtctcagttcagctgagcatccctgggctgagcccagttcttctatctgagacatggattgggccttacagcccagagtgaggtctctgcaccagcagcatcggcattacctgggggctcgttagaaatgcagactctcaaaagccccaccatagacctcctgtatcagagccctgtttggacaagatcccagggattcatgtgcatggcacagtttgagatgctctgcattatcaatccaggtagggaagccctcctttagatttaccaagaagctggagaactcagcaacttacttccataaaactggctagtgaagcattctctcttccttctggctttagaaaggatcttattaggagataagaaagccagttggaagcctggttgctgagagtaaggaaccaaatgtggcccctgggactaagtttcctggcagctgtgtctccttattcttggggaaatattttgcagttgaaagaccacctacaaaaaatagtatcctcaacggtcaccttgtgatgctaccctctatgctggctggcatttagttataatattctgtcctgacccatgctctaatttgcctttgattaaatttggaactttgaagcttagatttatgagatggtattttttctcaatatatactttgatacttgctaaatggatatatgctacttctttaatcaagacttttttacaggctgggtgtggtggctcacacctataatcccagaattctaggaggccaaggtaggcggatcacttgaggtcaggagttcgagatcagcctggccaacatggtgaaaccccatctctactaaaagtacaaaaattagctgagcatggtggcacgtgcctgtaatcccagctactccagaggctgagacatgagaatcacttgaacccaggaggtggaggttgtagtgagctgaggtcgtgccactgcactccagcctgggttacagagcgagattccatctcaaaaaaagaaaaagatggccgggcacggtggcttacgcctgtaatcccagcactttgggaggccgaggcaggcggatcacgaggtcaggagatcgagaatgtcctggctaacactgtgaaaccccatctctactaaaaatacaaaaaaaaaaaaaaaattagctgggcatggtggcgggcgcctgtagtaccagctacttaggaggctgaggctggggaatggcgtgaacccgggatgcggagcttgcagtgagccgagatcgtgccactgcactccagcctgggcgacaaagcgagactccatctcaaaaaaaaaaagaaaaagactttttaaaattttataactaatgcattcaacatagacaaacttaaaaaatatggatcatgaaaagcacattacaaggccaggcacggtggctcatgcttgtagtcccagcattttgggaggccgaggtgggcgaatcacctgagttcaggagtttgagaccagcctggccaacatggtgaaaccccgtctctactaaaaaaaagaaaaaaaaattagccaggtgtggtggtgcatgcctgtaatcccagctacttggaaggctgaggcaggctaattacctgaacctgggaggtggagggtgcagtgagccaagattgcgccactgcactccagcctgggcaacagagtgagactctgtctccaaaaaaaaagaaaagaaaagaaaaaagaaaagtacgttacatcaatctatctcactgcttggagtttgtgtcaagatgttgatgtgcatatagatattttctttacaaaagtgtgatctcacttttaatactattttaaaacctgcttttcactcaatgtattataaatatctttccaaatcaataaatacagctcttctacatgttcattttcaatgccctacaaggtatttcattatatgaaatgttctatattacaatggtcttaatgtttgtgtcccctccccaccccagattcatatgttgatacctaatcaccaatgggattatattaggaagtgagacctttgggaagaggccccagagagctgcttcggctcttccaccgtgtgaggatgcagggagaaagtgccatctatgaaccagaaagcaggccctcattggacacttatctcccttgatcttgtacttcccagtctccagaaccataagagatgaatttctgttgtttctaagtcacctacctacattatggtattttgctagaacagctcaaacgaactaagacatatataatggacttatgtaatccatcgcctattactaggtattttgatttatagtttatttgtcctctgttatatcagcactgctgtgaacttcatctgtaccaaaatatttccatacagtctcaatgacttgtttgggataattttttgaataatatcaaagtgtgacatttgaataagagaagaggcacagtgttccaagagctagaaggtgaaggtaagccttgcttccatcctgcgatgtagcttcgtgtctgtgaatagcaagcaacttcagatgaataagctatcaacatactggaactcggtggtgcagcttccttgtggggatgactcttaggaatcatctggattttctgaagaaaacaaatcatttgggttctggccttcattgccctgcccagcgggagtccccgaagggctgtgctagaatttcagagcatggttggcacagcgttggtgaaggttacaggattgtctagacaaaagggcccaggggaggcacagaggctctgttagtgggtggaagggatgatgctgtgtgtatgtattgagccacaccctggatttcagtaggagccagaataattctgaggcttgggtgtgggcagctgtgctaaacagggaactcagggtggtttcaagccagtacagagctaggacctgggatctaagattggagcagacacacatggagaagcagatagcggaatcaggatcagctgtctgagtgggaaggtcttagagaacccttgctaggtgttcaccaggaagatgcccacacctgtacactggatgggggtgcatgttcctgggccaggagggaccacgctgggtgttctgcttgctgagacagtggtttgggtggaggttcccattcctggaatgcctagaactttgctgcttggcccagtatgttctgggctcccccatttaaggcaactatgaccactttcattgccaccacctcctcctagcttgaaacaacctcccctgctttgctctatctgtgccacaattaaggagcttcccattttcttcattatattgcgggtagttatatgtgtatcttaggaaaagtagtatggtgtgaggaaagcacccaaggactttgagtccactgcctcttcacttaatgttctggctcctccaattgctgcatcacccttgggtaagctaattaacttctctgagcctgagcatccgcatttattaaacagggattagatacttacctcgcagggtggttgtaaggattagaagtaatgacatataaagcacccctcccacaatttagtgtctggccagatggtgggtgttgagattgtccgttattactgaggacttaatgtggtctagtctgtaagggttgacagatcattgtggcagatcccagacatgcttattatgttagcagtaggggccctgaggtcaaaaggcttaggacagctatcctgcctcccagacctgggaggaaaagagagagaaagaggggctccagggcagttgtcagagttaggaaggtgctgagtcgccacaggcatcagaggaggattttctgaatgggtacagtgaggacccagtggtgctctctcctcaaacctacctgttgggaaccagatcagcccagcaggctggtagcagagccatggcctgggaacctgggtcagcctcactgtcttagctccagactcacccactccctttgcaatgctgtgctgtgtagtggtaaagcctgcacacgctaggtcccattcctgcgccattcttcctgcttgtgtgacctcaggcaagccccaaacagccttgtgactcaatgttctcatctgtacaatagggattatggcacctatcgcatagggtccttgtgaggatcaaatgtttatttatgaaaagcatttagagactgggcacggtggctcacgcctgtaatcccagcactttcggaggctgagtcaggtggatcacttgaggttaggagtttaagaccagcctgaccaacattgtgaaaccctgtctctggccaggtgtggtggcacgcacctgtagtcccagctatttgggaggctgagtcaggagaatcacttgaacccgggaggccaaggttgcagtgagccgagatcgcaccattgcactccagcctgggtgacgaaagcaaaactccatctcaaaaaaaaaaaaaaaaaagaagaagaaagaaaagaaaagcatttagaatagtcactggctgtaaaagttattttctctgtgagtgttagcaccttctagagtttagatctttatgtgtcgggccttttgtcttaacatctgatttcttcttgagagtagaatccctgtctggtccatttaacccccactgtacatagtataaagttaaggattcataaataagtgtcagacagataggttggggaagctcaggctatgacgccaaatagatctgagttcagattctggctttgcccctaactctgtctggatctttgacttctctggtctcatttcctcatctgtataatggaataaaatagtaggctctttataggattataatgaggattaaagtaaagaacagaccgggcatggcagctcactcctataatcccaggactttgggaggctgaggcagaaggatgacttgagccaggggttcaagaccagccttggcaacatagcaagaccccatctctatttaaaaagataaatataaatatataaagaacacattgcaaagcatgtggcagtagtgagctttcaggaactggtggtgctaatgaataaatagcaccttagtaatgctcattctatctcactcacaaactggacagttcatgcatttgctggggtttcattttgaagtaagaggatggtttgtttctgcttagttttccccagtgactgagaaccctagcaagaaaacgaaacacctgtgcagacacattatacccatggagctgcatttctgtatgtactttttgcaggccattatcagacattacactgccccagaggttaattgtaatctccagagtccattgcacttccacagtggctgggatctttggccactttcccagcctgtttatggggagcctgacctgaagcacatctcctaagtgttttccaagttggcactgagtctctccgacttggaaatgccagcacacagctttgtgtgtgcaatgatttagctcttatgaaggcgccagtgaaatgcccactcctacccgggtgttggacattttggagacctggaaagaagtaagcagtgttattgacaagcacaggccctgcaggggactgtgggaagttaggcatgattctgtcccttgtgccttaacaaggactggtgaggacactcagccattccctcagtgcatcaaaatggaggccagcacattgtatagccttagtttctctatcagggattagggtgataatgattaaccagaggacttagggtcaactaatccccaaagtggttctcagaatactatgaaaatgtagcacaggaaaaggttccatggccaaatatatttagaaaatgcaatgcactgtctttccttctttgcattttataatatgcaatttgcatattcaaggccctgagaagtcctgcagtaaggaaacaaacttaaccttgttcagtccagcagcacccaaatcaaatttccatgagcatctttttccctttaacatccccagcagctaggaaaaacactgaagaaattctagattatctaattatccccaaagtttatttttatttttttaacttttttttttagtttttttgtattatatcctgctccttctgtagattgcaaaagtttataacaagtgatatgtgaatattaagaaaggagaatctgagccaggcgcagtggctcacgcctgtaatcccagcactttggcagggcgaggcgggcagatcacaaggtcaggagtttgagaccagcctggccaacacagcgaaaccctgtctctactaaaaatacaaaaattagccaggtgtgatggcaggcacctgtaatcccagctacttgggaggctgaggcaggacaatcgcttgaacccgggaagtggaggttgcagtgagctgaggctgtgccattgtactccaggctgggcaacaagagcacgactccatctcaaaaaaaaaaaaaaaaaaaaaagagaatctgttgttttgtttcattttgtttttgagacagagtcttgctctgtcacccaggctggagtgcagtgctcattataagctctgcctcctgggttcaagcgattctcctgcctcagcctcctgagtagctgggattacaggtgtgaccaccacacctggctaatttttgatttttgtagagatggggttcaccatattggccaggctggtctggaactcctgacctcaagtgatccacccaccttggcctcccaaagtgctaggattacaggcatgagccaccgtacccagccaaatctgtttgtttttttttttaaataagacatttaggaaatgaaatgaaaagtatttgataacttcttttgtagccactcactcctagattttatcatgaagaattgcatgacttaccaatccaccaccctcttgaaataccagggtcatgacatgccaaaagctacctccacgggctaagacctgaacttgagtaacaaaggtaaaatttgaaatttcaaagatgttctttatgagaccctagattaactggggttgcatccaaatggtttcatttgaacttttaaatacatacttctggctgggcacggtggcttacgcctgtaatcccagcactttgagaggctgagtcgggtaggtcacctgaggtcaggagttcgagaccagcctggccaacatggtgaaaccctgtttctacaaaaaatacaaaaattagctgtgtggggtggcaggtccctgtaatcccagctactcagaaggctgaggcaggagaatcacttgaacctgggaggtggagattgcagtaagctgggatcacaccattgcactccaacctgggtgagagagcaagactccatctcaaatacgtacatacacacgtacttctcagccaagtgggcacctactgttctgctaagggatggagacatggacctgcaggttcgcattctcctggatctgagaggttattaggtcacgtctgaagcctccatgccagctaaacaaggaacagtggatcagcagcgcaccttgtttattgttgtagtgctccagtcgtccatccctctctccccttgtcttctgtgactggtcaagctaatttgatttgacgtcctggcatttgagatttgtcaagtattgtaaccctaagcagtactaatattgaaacccatacttgaaatttatgtaatccagatgtgcatgccaataaagcagagatgaaatggcaggcccggatgggggagagccaggctgggtggggactgtgtgtggggaagaattctgtggccctatattttttccacatggtatatacagccaagtaggattttaggaattaatattttcccttaagagtagtaactggattatgaagtatagcttcaagtaagtaccagtattggttttatttgtagccaagaataactgattaagttttgaggagaaggaaggcaatctattttgagtgctttttaaaacttttaaattggttaggacccttcaacagtgtggtcttgggacttattagtcacatcgaatcagaacttttttttttttttttaaccaaacaagcagcactggtgaaccaggatttgtgacatggctctctgatgttgaattttttctatttgagcatatcattagaagtcccccctaagaaacaaagactgtgacccctgagttgtcaattcaaagccctcccacactggtaatacccaaatgccatttctattttctgagagctcaatgagtaggtggattaaatgtgaaaaggtttctgttcaggtatttgacagtggccttgattggagcctctctaccgtctagcaatggccctgttgtgtgacttccaggacgacagctgtcttctcgggccatgacctcttccacctgtgggatcacaggactgtgtccagctgacccaatgagaatggtataagtgctttatctcatagggagttctgagtcaaaaattttggtgttcttgacatgaaagattggcagagtgtattattattccttagtgttctgtgcataattaacaaccacccttaactagacctggtagcccagggaaactggtcagaccagctagtgaaagcaggtggaaaatgatctcgagggaagcacggagtcgggatccacattgagtggaggtgacttgtagtggattagggtgctcataaaaaccgtggttgcagttggtaccagtgtcatctgtggatatttctaggcaggatatcaagggtcagcttgctactttagccccctcttaaggcaggatacaaaaaaaaaagagagccctgtattcaggggaggcatgtgacatgccatggtcccccatttcccctgccctaaacatctctggagaaagtcaagtgtgtgtggcttctacagcagggctggatgtttttccctggggtaggaggggcatttacctgcttttcttcagccattattaatagggctcattccaggaggggaggagaatggtgcctgtaactcagactccccagcacagcctcggcctgcaggcttcagccctgttggagtcagggcttgcgtaaggaatgctgtcatggatccaagccagatagattacaaatgatggaatctgatgtttcctgttgggtttggggaagggattcaatgtggtgtgggcttaggtccccacagtttacctcagaaatagtcaagatgcagggagctgaatgaggactctcgaggcagctttgccagcctggagcccaggtgagtcactaccacctcagaaacatccttcagaggccaggattcaggccccaggcgggagtcggagcatccaggctgctggtccggttctctccactgacgtcatcacccccgcttagtctggaatggctggcaacctctgcctgaggatgagagctggctggaagtggaaaagcaggaaatgtttccagattggaaactcaaggcacgtttgcgcaatactgcactcggccaagactgtgtggctgacctgcatgcctaatgggatcccaggtctgaaacagggttctgcagaaccattggtctgacctcatacctcccacctagacacaatgatatcttcttggccaagaaaaaatgacctgtatttttcttttcttttttaatgttatccagctgaggtgtgcctttaaaaaaaagaaaaaaatatatacatacacacacacgcgtgtgtgtgtgtgtgtgtgtatattccaatccactacttaacgcagggatgcaaagatcatattaaaacggctataaccagaaataagacaactgaaagaatcatagtattaataaagggcaaactgagagtccaggtgagaggaactgcagtctctggtgatggagtgcagcctggtggtttagagctccaaaatggaggcccgtcagcctgggtttgaatcctggctctgtggcttactagctgtgaccttggcttctgtcatcttctgttcttttacttattgtaagaaagggtgatagtgccacatcatgaattagtctaagactcgagtgcacttccacgcaaagtaagtccttagtaactggtagctgttatcatagttaaatatcttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaatatcattatttttgaggcagggtctcacttgttataattattgttattccttccctccagcctgctttagagtgatgcccatgatgcagtcaaaggtgtctgagttcctttcacttttctagatcgttgccccagtactagtgcataaagggatgcaaggttttaggaactttgaccttgaagccagactgtgtagccaccgtcacttctctctgggaggctgttgtcagatcaggccctgttccatccctctcctcggaggtctgccagtgttactcagccatgaagcccatcaaggggccacagttcagatggaggaggagtctttaagcagaagacagaatgcctggggatgctgttgtctggggtcaaatgctggcttcgtccagtggagaagtgagtagaaccagcccactgtatcccttctgcatcccctgccagcttactctctgaagcagcaaacctggagtcggtcgaggttccccaacagagagaccccgggccttgcaagagcaggcctggacagcctggagttttctctcaaaattgtaacatgggtttattccaaaacaaagcaacaaaagtagacccctggtgtatccttggctcacttccataaagcatcacaaccattaaccaaaggaaaagaaggcctgagccctgtggcggaagtcaggccaagattttcctcactcccctccctttctgggacccaggaatagtaaaaatagtaaacataattataacaaaaaatttaaaaaaatttttttaatttaaaaaaagctaaaaatcatggaatgtttgctaaatgtcaggacggtttaagtactttatatatattaagttatttaatcttcctagcctttaagaaacgctattattgttgtttcccttttacagattaggggactagggcacagagcagttatgtaatttgcttaaggtcacacagctagtagtggccatgccaactttagaactcagacagtctggaattagaggctgtacacttaaccacagctctgaactgcgtctcatgatagttatcaagttgttatagaaataaaccatatatacgataaaatgatatcaaactatacatacacaacattattccagtgtgtatggttggttggtttttttttttttttttttttttttgagacggagtcttactctgtcgcccaggctggagtgcagtggtgtggtcttggctcactgcaagctccgcctcccaggttcacgccattctcctgcctcagcctcccgagtagctgggactacaggtgcccgccaccacatctggctagttttttgtatttttagtagagacggggtttcactgtgttagccaggatggtctcaatctcctgacctcgtgatccacctgccttggcctcccaaagtgctgggatcacaggcgtgagccaccacgcttggcctgccaatgtgtatggttttttagttttgctattatactctaattgtgtgagatttaaccatctggggaaagtgagcaaagaatacacaggacctttctgtattctttttttttttttttttttgcagcttcctgtgactctataattatttccaaataagaggtcagaacaaaagcaaaccacaatcaacagtgtattgaattcttattgtatgccaagcactgtgataaacatttaacatttattattttatttactcctaacagcaacccaataagatgtgggtactatcattatctttagttacagatgaggaaactgagggttggcaaggttaataagttggataccatcaataagaagtagtatgaccactgggtagtacccacctagatttattataaacatcaaatcagaaaaagcacctggtatatggatgttctgtaaatgttgatttccatgtgtttgcttggcaagcacagagccctgctaggtgccatacacagtctagcattagccagtccaagcctctgctggtttggctcacaggatgctagggatataaggacaagtacaacatgtttccaccatcaaggagcatatagttggggaacagtgacttccatggttccaaaggcaagttgtatgtatgtatgtatgtatgtatgtatgtatgtatgtatgtatgtatttgagatagggtctcactctgtcgcctaagctggagtgcagtggcacaatcacagctcattcagcctcaaccttctgggcccaagcaatcctcctacctcagcctcccaagaagctgggaccacaggtgtgtgccaccatacccagctaattattttttgtagaggtggagtctccctgtgttgcccagggtagtctcaaactcctgagctcaagcaatcctcccatcttggccttccaaagtgctgggattacaggcatgagccaccactcctggcctagttgtatgtatttagcatatgaacccagaggaagtaccctcctacctcagagctccctcccctggagccagagtctggatggttggacccaagccaggcaccttcctgggactcaaggacacagtgagggtttgaaagagggagcattatcaatcaccatgttggatggcatcagtgattattatcttcatttccatcaaaggtgtcttgtgaaagggtgtcatcaagttcaatttagtctgaatcaggacatggcaaggacttattttctatttctgccctgggctggacctgtcttgaataattcagtgttcatcatctacttctaaaagccgagcttcctgcacttccccgccatcacccgtccctatacagctttatccagggtcatgtggctgcttgttactccctgtctcatctccatcaaaaacccacccatccccacctctggctgctagtaaatgagtgttttcaggaaagagaatcaactttaggtatgtagtacaaggtatcagctgcctaaagtcaagaggcagccctcagggcaaaaggcgtcacacagtagcctagggacatctttcaacctagcactctttaaaaaaacgaagaaaacccaaaacttgacgatatgctatcatctaaaacttgggagagtccctgatctggcaacagctggctagagctgaatagcatctgccccctctagataggcaaatgctgttcccaccccccaaactccacttgtttaccttgcatgcctggtccccaagagcatctggttgtcaacctctgaggtggaggaaggaaagccctcaggctgggcacggtggctcacgcctgtaatcccagcactttgggaggctgaggcgggcggatcacctgaggtcaggagttccagaacagcctggccaacatggtgaaaccccatctttactaaaaatacaaaaattggctaggtgtggtggtaggtgcctataatcccagctactcgggaggctgaagcaggagaatagtttgaacccagcaggcggaggttgcagcgagccgagatcgtgacactgcactccagcctgggcaacagaatgagactccatctcaaaaaaaaaaaaaaaaaggaaaaccgtctacagtggtgaacagattagatgttttcaaagatacgtgggctatgtttgatcctgaaaccatgcaggaagctgcccacccacccttctgaggccagtgttacatctagtcctcttggtcggggagctaggattctagaggagaattctcagccctgcatcaacaccctgactgcggcaggatttctgaaagagccattgggggaactacatgctgacttggatcgttgtgcatccgtgcatgaagcatccatgagaaaagggctggtctggagtgtttctggctgatgggtcaccagataaggagccagaagacgtaagtttcagtctggctgtaccacttgctaagtggacatttgacttgtttgattttcttatctgtaaaatggggataatgtccactgtgcctaccaacagggtggatgagaggatcgagtcacgtgattgtatgaaaatgttatgaactgtggagttgtattgaaaaattaggtggtgtgacagctatggtaggctgtggaagcacacacaacctctctgagtgtggaaatcaggagttgacaagctagggccagtgggccaaatcccatccactgcaaatggtttttatattttgaaatggttgaaagataatcaaaagacaaatgatgttccatggcacatggcatttgtgtgaagttcaaatttctctgtccacacatgaaggctcgttgggacacagccttaccatttggttgcaagttgtctgtggctgctcttgctctacaacagacgaggtggggagttgtgagagagaccacatggtccacaaagcataaagtatttgctacctgacccttagagaaagcttaccaagctgtggcctaggtcatggaggggcagaggctgaatcccctcccttcttttcctttgtttcttctgccacccagaagtaggtgctactgcaaatgggtggcccaagcaaggaatatcttcagatctcacagaagcaaatctgctgtgaccacagcaaatctgccctaaacaacagagccaggaatttctcccagtttaattcctatcgagtgcttccatcctctgagctccagcttagaggcacttcccgatgaaaaccacagcattcgtttgtaaaaccaatcccccttttagcaacaaccacaaaaagagaaggggctgttcctgtcacagtgggcatttctccatcgtgttcactaccccaggggcctggtcagtggtgcttcctctccttggccacaaactggcaagaaacacaaagggcaactgctgttctgataaggctgtggggggcatcagcgctgaatcatgtcccccagaagatatgttgaagtcttaacccctaggacctcggaatgtcactttatttggaaataagtaggtgtggatgtagttagctaagatgaggccccactgggtagggtgggtcccccatccaacatgcctggtgtccttagagtaagaggggcatctgaatacagggtgaggcacacgtggaggatgcatgggatgtggagggctgtgtctagcagacgaggaagctgggaggaggcaacggaaaacttaccagggtcccagaggaaacagggccctgccgacaccttgatttcagacttcttgcctccaggagtgtagcagaataaagttctgctgtttaaagcctcccagttcatggtactttgttacagaagccccaggaaactcacgcagtggctggcccaccctgccggtgcagcattccaatacccttccagtacctgtcattatccctgttctacaaataaggcagtaaaggcacggcaagttccaatgactgcctgaggttttggctagtggcagagcaggaatcaaacccaggccctctgattccacgctgctgcagtggatgatctgggaaatgtcagccgtcctgtccccatccctagcatccactaagaggagagagtgggttctcagactgatggcatcttctgcttcgtgttcctcattccaggagctctgaggtagttatttttctactgtgagcatctgaacttatttacttgacttcttaaatatgtacaagaaaaacatcaggccagacacagtggctcaagcctgtaatcccaacactttgataatccaagagaacccaagacaggtggatcactttgagcccaagagttcaagaccagcctgggcaacatggagaaaacctgtttctccaaaaaaaattaaaaagttagccgagcatggtggctggcgcctatagtcccagctactcaggaggctgaggctggagaatcacttcagcccgggaagcagaggttgtagtgagccgagatcaagccactgcactccagcctgggcaacagagccagaccctgtctaaaaaagaaatcttaaaatagggagcatgttttacatacatttgtgcattatttataataaaaattgaagaggagtgaactctcattttcttagcatttacagtgtatctgaagaatgtgcttaagagatccttggggaggtaccccaaaaaacccccgtgtgcaaggcaatttaataagggaagtctccaatgtcctcctggaaagcataagaacactgatacttccttctcagatagcacctggttggccaagtccttgtgtaacaaacataaacgaaatccacaccaaaaactggagatgatgcactttcccccactagggtgattccttttcaaaccttcaactcacccactggagaagaaactcaggttgcaagtgaaatcttaccattcaaagtctaggattttttttgtttcaaatattgccttttctctgtgttacaagtattttcaaacatgcagacatgtattcagggcccaggtttagggtttctcaactacggggatggaaatgtgggatgggggcagggagtgatgccgtcaggatggggaagaggccagggttggggtccaggaaagagaatgccagggaccttcagaaagtcagcaagactgagccccagtggggtgttcctggccagttgagtctgtccctgtctgccgtggtgacccaggtttctccatggaattccaccagcattggcttgctcttctgagggctgccgcctctcgagcacccagaatttgaatgcctggcctcagctacagagtacttggccgtcgtgacacatggctggcagcatccgacgtgcacgtctgctgctgccaataaagagaattgtttctttctctgaacagagtccatttacattgagagaattttcctctcctacctccaccagcacttcctccccgccccgcccctccctcccctaccaccccacaaaaaggaaaaagcttttggggaatttgtttttagtgggctcactcaaaaggagctttatgtttattttctgagtggcctctggactgttgtgtccatttatcatacctcccccgcctctccctcccctcccacccactggcccccatctctcctctactctgaaaacctaaacttcatcaaactgttcctaacgactaccacatgtctacagagggcacagggggtgggggagggggatctgggaaatgaagaaaccctccaaggagcacagtagcgtattaaaattcaatggcttagtcatcagagttttcagcccaagcaccgaagaaaaataaatgaatgttctgtaacagtcttgtggatctcggaggaagggggtggcaggggagggagaggagaggagatgttgtggtttttagatagaggagttcatgctgtagagaacaattaaggcctttgctcagaaataacaagacacactactgttttcctgcttgctggaggagtgcatagtgtcagggctggcagggattggtctgatcggccagctctgctcacggatgaggaaactaaggcccaggccagggatgtgacttctttagagtcatataagtagaggccaggtgcagtggcttatgcctgtaatcccagcacttcgggaggctgaggcaggaagattgcttgagcccaggagttcaaggccagactgggcaatatagtgagaccccatacttccgaaaaaaatgtaacaatttgctaggcatggtggcatgtgcctggagtcccagctacttgagaggctgaggtggaaggattgcttgagtgcaggagtttgaggttacgatgagctatgatcgcaccactgcactccagcctgggtgacagagtgagaccctgtctctaaataagtagataaataaataacaaaaatgaattcgtggtagagatggaactggatcccctcaatcattctttcctcccaactcaggcagatctgcttggagtttctgatggtgttttattctgttttttgagatggagttttgctcttttctcccaggctggaatgcagtggcgtgatcttggctcactgcaacctctgcctccagggttcaagcgattctcctgcctcagcctcccgagtagctggggttacaggcacctgccaccatgcccagctaatttttgtatttttagcagagacagggtttcaccatgttggccaggctggtctcgaactcctgacctcagatgatccacccacctcggcctcctaaattgttgggtttacaggcatgagccaccgtgcccggcttttttttttttttttttttttttttcttgagacagagttttgctcttgttgcccaggctggagtgcaatggcatgatctcggctcaccgcaacctccacctcccgggttcaagcgattctcgtctcagcctcccaagtagctgggattacaggcatgtaccgccacgcctggctaattttgtatttttagtagagatgaggtttctccatgttgatcagactggtctgaaactcccagcctcaggtgatttgcccaccttggcctcccaaagtgctgggattacaggcatgagccaccacgcccagccaattctgatgggttttaagagcatcagctcttgggctgagaactgccatggtgtccgcaaggtactcaccccattgagggtagctgcttcagtgacattgcaccaatgctggtgggcctttctccacccatcctctcccccagctaggccggtgaaagggcctgggtgtttgtgagttgtcttatatgctcaggcttcaaggactcaacctgcctctggaacttgttgcttcggttctatttttccttgtatccctgcatcttccttaggaaggatagaccagattgccctttcctttgcttttttcaaatgaagcgactgagtcacgaggaagtgagaggacttggtaaaatcctgagttgatagtgaaagaaatggttctgcaatgcacatctcccctttccctgtcctccatgctgattcagatccctcattttggtgaccaaggacattgaataggagagatattgtgaaatctttgagctcaaagttttagaggagaatgaagccaagcccctgttccgaggatgaggaagtggggtcgggatgaggaggggtctggccagggccagcaggcattacaggctcgggccagcagaaatgtggcattcaccctggactagctgtgggacacgcttcgaacagtttaatgtcccaggagggattgaagtgtggccagtccatgccacccaccactggtcccagaacagggagagcattgtagttgactattatattggctttgagtctccgtttgggcttctttgatcagcttgggagaaaactgaaagaaaaaggtagacaaagtaaccacccaactcagctaaattgctggcagcaaaaagtcaaagaaaatcagattttctgagcaagtttgaaaggtctccctcgagtagctgggcaaattcccatggatctgggccatgaagcaacatttccaaaggcattggtctgctcttgcttcctctgtgttatggcagaaacactggctgtatccagacctctgaccgttcttcctgtccacagcacagagacacatcgccatgtgcctgatgtgctgccattgaatcctagggatggtgtgaattgaagagcccatctcacagaggaagaaactgaggccgagagagctagggaaaccctgctttgaactctcggcctcgagactgctcactatactccctattcagggcttccctccaagctgcttctagaagatcagatgtgtttggagactctcctgatggccctaaaactctcgccctttttctcctgctggagaagcctagtaagaaggcctgtgttacttcccttagagaaaacattgggaaacttaccctggaagaccactgatctcacagagcaaagccagccaaacgtcagactccataaagacgtcagcatgttaaggagaaccgtctgggcctgcagtactcacacacaccagccttgttagcagatgggtttatgttctccctcccgtgccacaaattgcaacctccatggcagataccagtgggggactggggtcgggcctgaggacagtgtcttgcgcatgcctgatgtgtgtcgtgtgtcactttgtgggctaggagatagggctcctgggggtaggtcagcccattcatccttgtttccctactgtgcctagaattgagctctgtccccagagggtgcctacaacatgcctagggaatgagtccctgggctggtaatggaaactcttaacccactgctgcacctggctggcttcccagcctctgcaagaatgagtcagccacctgcaggagagcctcagggaagagcctagcacttccaatccagataagctttggctacctgggcctgtgacaagtgacaataaaaggaaagcctgagcagacctgtgtttataagcatgagggaggggtctgcactcaggtgtgctaattaaaagctgagaacctgcaaaagaacttatgtttaaaccacacctcctctctccatccaccctgccttatcctgctggttgcttttgttgcaataaaaagccgattttatttcccccacagagcctttgttaatgaatttctaaccagaacctaaagttagggaatgtgaagggggagtgtggccctcatgcaagcgcatgcacacatatggactctcacacgtaagaccaaacactccatggctcctctctgtgtccccccaacccccaccaaaagcagcatttcttgagagatggacccttaacctcagtgtatccaaggcccaaaggacctaatgaaaaccagagctaccaccaaagcatttctgatgctaaaccggcctccggagtcctttagcatcagggccctgggctgtgagtgagctcagttcaaaacaaatctggggcccattatctccctggcctgatttcgtctcctgtggctgccctattagacctttcctggcatgatgacatgttttgccgggtccttctcctttgtccaatttccagggcagtgtttaggcagctcaaagtagagcgcagtgctgggtactgacctcctgggcacctgagggtttgcaggtgacaatcgcccacaagaggtggcaggaagtaggatggtgttgacctggcaagctctggtggaagcccttgagaaaacagtattgcattattgtcactgttaataatggccctttatttgagctttgctaggacaatgctctaaacaaagctgagaggaagaaacagtccctgctgtggggccttgtaatttatcaaggctaatggaggaagaaaaatccactggggaaagattgtgggggtgggctggcgatagatttgattgttgctggaggtgtaattggacgatacccacagcctagctatgcatccctatttgctttgttgcaacaggactgtgtttctagcccctcctttgtcttgtctagttccgctggatctgagtcccttgaaggcagattgaggtctaagtcctggatctgatgtagcagcatgacctcaagcgggttcctttacatctgagccttaggtttcctcgtctgcaggggaggtacccagattggaaatcatgagagtccaagccccttaaattgctaaaggaatactagctgccaaaaacagatgacaaaagtattgaggaaagaggacttgctagaagtgtctttgcatttcttagaggatccaaatcccaaggttggacctaactgaggccaccatttactgagagtgcaagcatcaaacctgttgcatctctggacatcatttatttctctatcaaagaactgttgcaagaatggttgcctcccaccttttccacacaaggatgtgagtcggtgttgttttcttgttgggtgctggactcactgtaccaggggtatggtggcatttcagggctggaaggcctctatgaaaaccagcaccccaccctgccaagttggaggtcctgctgtcctccagaaatgctggcagccacaagctgcagctgtgttgcaacaagtctgatttaatttggggggtggtacagagatagcactgtgatgttttttaaaagccagaagaatacagcttattcaccaaactgtgaaactggctatgccttgggtgggggaagccagaggaaaatgtgtgatagcgttttttaaaagagtaaaaatggtgataattataaatttactataatgcccattattgcatgagatctaagtggattaactcattatagctaagtcagcatcaggttttcttaaggcctcttcccttctggggtttataattctgttcttatctttctattaatttataaggtgggaagccaatcattgtcttttgtaatccttgttatcacccccttgtttcctcagaagtaaaaatcaggcaaaaaaaaaaaaagtacttttttatataatgcaattggagtaaacctgaaaatgttggtaaataggaggatttctataagttaaattttctttcaaatgtatgaaaaaaacagactaccttgtagaatcccattgtaaatagttttgtcaagcaaggatgtgtccatatatttgtctttgtggtaagcctggatctttcctgtccacagctgtgacactgtgtactcaagctgatacatcagtcactctagcagcatttctgttttttatattaacttatatcctttctctataaaattttctaggttattaaacctaggtgagcgtgattgagagagatgtgaaagtgccttacaaagtgtctttttttggggggggcaggcggggagatggagtcttgctctgttgcctaggctggagtgcagtggtacaatctctgctcactacaacctctgcctcccaagttcaagcgattcttccacctcagcttcccaggtagctgggattacaggcacccaccagcacacccagctaattctttgtacttttagtagagacaaggtttcaccatgttggccatgctggcctcaggtgagccaccacacccagccttagaaagtgtcatttagatgggagaaagctatacaccccacaggacaaggacgtgtggctgtacagtagggtggaagaaagcctggaatggaaatggagtctcagtttgccctcagctctgccctcaccttttgcatgaccctgggcaggacacttagtctccatgggcttccatattcacatctgtaaaatgaggggtaccgattggatgctttaagaaaacctgtgagataagcgtttcagaattcttccaatggtgctatcccagaccaaatgtccatttaagaaaaactattaatcccttatcaatacaatttatcctttgaaggaggtagctgtgtgtttctagacaacatcccgaggagtaactctatctggggattccgctgccttttcagagccctgcactgcagtgtgtgctgacatgtcctcttcagagacccctcattgaattacaccgtgatcagcggttgggaccttctgtgtttattattcaggaggcagtacacagccctccgccctgcagagtgcaggtactttatcagctaggatcagatgggttattgaattcagaaaatcttcattttgtattcagcttgcttctccctgttccacttgatcacgttcctcattgactctcagggcccttggggatttcatggcgagaagcctccaagcgctgaacggtgggtacacttctgtcctctttgtacttaggcagggcacccaggaaagcaattattccagagccttactttacatttagcagagattttctttttcatttaggccaggcgtaatggctcatgcctataatcctggcactttgagaggccgaggcaggcagattgcttgagcccaggagtttgagaccagcctgagcaacatggcaaaaccccacctctagaaaaaatacaataaaaaattagccaagtgtggtggtgtgcacctgtgatctcagctcctcgggaggctaaggtaggaggattgctggagcccaggaggtcgaggctgcaatgagctgtgattatgccactacgcttcatcctgggtaacagagaccctgtctcaaataataataataataaagtttatttaggggaaggtctctgggatttgttgactagtcctagttttctaggggtgctaagcatttgaggacagctatgaatgtgatccagccagttttgaaacgccattgataggttatatttctgattaatgtaaccggtcacctttctttaaggctgcaggccagatcccagctgctgaaagggagagaaagagacagtgataccccacagatctgaaagtcaaggaaaggctgaacttctatatcacccagaggagaatacctgactatttctgagaaggaggggagctgagtaggggagaatttccatagagttctgcatttcctcttcattctccacaaaacaaaaatctgttcatcgtttgcaagtttctgtggtggttcttacctattccccaaactacttttaagagcttagggttgctgggtacatttcctcccttatcttccctgctttattcctgctataaaatcaccacacttaattcaaaccagagttgtttgatctgccctgccaggcctcgttcagacttggtggtgctgactagcaaaagcccaggccagacacatgagcttatgacctcactgtggaggacaggcagagagcagagggcggactagggtggagagacatacctgggctattagaccaaaatgctaacaagcctgaccccaagaacaattgcaacagtaacagtaacaacagcaagaattaacaatagcagcaaacatacattgaacacttagacttcaccaagcaaataaatgttcaatcctcacacatagcataatgtgagcagaacagcaggtgaaaaacaaccaggtatataaatataaagtgatatgccccaccactaccacacgcatatgtactacacttccctaacaagagcaggcacttctggctgggcacagtggctcacgcctttaatcccagcactttgggaggccgaggcaggtagatcacctgaggtcaggagtttgagaccagcctggccaacatggtgaaaccccgtctctactaaaaatacaaaaattagctgggcatggtggcaggtgccttactcaggaggctgaggcaggagaactgcttgagcccaggaggtggaggttgaattcagctgagatcgccctgctgcactccagcctaggcaacaagagcaagactccgtctcaaaaaaaaaaaaaaaaaaaaaaagagcaggcacttctgtagtgctcactaggcacagttctaaggactgtgcatattttaactcacaactctaagaggcaattcctactgctgtttccatttgatagatggcaccaaaacactgagaagttaaataagttgcctagagcaacactggattgtcttcagtctactattgtgtcattaattccatctctgtaaatctttgacaggggtatttctcatctgtaagacaggtgtgatggtacctcctcttacctctctctcactgtgaggattaaagggaaaaaaaaatgaagtgggatagatatttgtaaattgtcattccatattcaaatgacctgtggggaaaacctgtgagggatacacagtaatagtggagaactgttgggatcagtgacacaaagtttataggccaacatcacaatccataaagtatgccctgggacccttaatcctgagatttctatggggacaacacagattggagttattgaggcgggtcctgacagtggagttgcaggggtcattagagaactgcctgaaggctctgctgcccctgcctgggccttgcctccttgagggactctgggctggggactcagggagactggggtagcatggcctgtgactgattgggatgtgctttggagggattaggtgggtccatgtgattattaacaacccctaggtagagaatatctcctcaaggccaggtgcagtggctcacgcctgtaatccctatactttgggagggtgaggtaggtggattgcttgagcccaggagtttgagaccattcagaccattctgggcaacatagcaagaccctatctttacagaaaataaaaataaattagccagatgtggtggtgtacgcctgtagccccagctactcaggaggctgacataggacaatgcctgagtccaggaggtcgaagctgcagtgagccatgtttgcaccactgcactccagcctgggcaacagagcgaaatcctgtctcaaaaaaaaagaagtcactcctcagtcgtattagctgcatttcaaatgctcgatgattgtgtgggttagtgactactgtgttggacagcacagatacagagcactgtcaccattacagaaagttctagaggctacctgattcatctgagtatatgatggcaagccttctctttccttggctgggttctgtgcccgtttctagtgtaaaaactctcctccaccttcacctcttagaggcctcctggagatgtggcgctctgggttgcttttgataagtaccaattctaaatgctgcagtcgctttttcttccttctctgctgccatagagccacatcttcctgagccacgtgtggctcttgggttcattttcttttcattttttccaccatggtgttctgaatggacaagtcagaattcagaggttggtattaagacctatcttcataacaagcccacttcatcggaccataggccacctgctatttgtactaacacttggggtcatttcatgtgtgaggaataatgaagttgcactgtatattcagaactttaatatttcttaaataagtttgtgttttaccagctaagctgctcagaaggcatttgactactatgagtggctctgtgtgtagatgagccctggttgggtagcagttcagagcaactcaagaaatctggccagagacaggacaaactctgtctcatccttgcagctgcacagccatgacagtccacaaaacggagaatttgccagcaagattttttaggttgtaattttcctcttggttagcctgtggctctccgtccgtcccctccggagtgaaagagcgtgagtgttgagataagagactgggaaaatagacttcatgaaccatttttcacttgggaaacaaaaaagtcattggtgattttgccttgagtgtttggaacctgacaccaacctcgtcctccaccaagcccccaaatgtcacactgtacaggttgccgacaccatgtctcattagcgacttgattctcccccaaccctggcttcttttcccaaacaaaccccctacaactggaaggtcagaaccccggacagctttttacacagccaccatatggtgtttgctttagcacggatccacaaatgatgtgttatttcagtggaggtgcagaaaattatatgacaaaaccgggtttgtttctctgctagaaacccaaggctgaaatactgcagtattccttcaagactgactcagaagacgaaagggagcctttcccagaattagggggcattcaccagggaccagaagggaggggggagaaagacaacattgcactggtcactagtggctgggccagtggtttattttctgtctgtgttttattaagtttatgttttccatctgactgttcctcgtgtgatttatttgtctctaggtgccccccgccccaccccccacaagtagatgataaaaccgacggcagtgtggacaacacagttgctgagactctttggttggattttacgcaggaacagaaataggtgttgggctagtgccagggtgttttgtgaggacttaatctccacctagtgggttctgcaccattttggactgaatgctgatgtcctgaaaactgggctgggtagtgatgcccgaaaggaaatgatcaggagttgggttttacttaagaagacatttggaatgtccttgaggccattgtgggatcacatttctccccctctatttttatggctcctcggataagaccggtagaggaggggaaaaaaaatgtatttaatttctgggcgggcctggtggctcacgcctgtaatcccagcactttgggaggccgaggcgtgcggatcacttgagctcagcagttcaagaccagcctgggcaacatggtgaaaccctgtctctacaaaaatataaaaattagccaagtgtggtggcacgtacctgtagtcccagctacttgggaggctgagacacaagaattgcttgaagttgaagttgaacttgagttgaagttgaaatcgcttgaggttgcagtgaactgagattgtgccactacactccagcctgcgcaacagagcgagactgtgtctcaaaaaaaaaaaaagaagtttttaatttctgactcacttttctaatttttagaaatataacttagaaccatggagcagcttaaaggattttgaatcctgagcaccttgtcctttttgatctgaggagatccctgccatgggctgtctgtaccgttctctgctgggtgcattccttccttttacttcccagagttgaggggaaaggtgagaaagtgatgtggatcctgatagggctcctgggcaggacaattactctaggcccttaggctagaggtcaagtttaggagaagatcacacaatggaaatagtttaggagtttagagagtgaagtgcttaatccgattcagcttgagccagatctctgaatttcagttttctcatctgtaaatggcataaatgtgctctgtttgcttgttgtgaacattgaatgatatggtatggatggaagtaatttgtgcaaaatttggctttatgcctttgttgtccggtatagtacccactaaccatatgtggctatttacatttaaattaattaaaataaaatcagggctgggcatggtagctcgcacctgtaatctcagaggtgtgaggctggcagatcacttgaggtcaggagtttgagaccagcctggccaacatggtggaaacactgtctctattaaaaatacaaaaattagccaggtgtggtggcaagtgcctataattccagctactcgggaggctgaggcaggagaatcgcttgaacctgggaggtagaggttgcagtgagccgagatcataccactgcactccagcctgggcgatagagcaagactctgtctcaaaaaaaaaaaaaaaaaaagtttctaatattcactggccttattttaagtgcccaaaaaccacatgtggctagtggctaccatattcagcagtaccaccatacatgaatgtaaggaaacaggttttaataaaagcttccattggccgagcacggtggctctcaaatcccattactttgggaggctgaggtgggaggatcacttgagcccaggatttgagaccggtctgggaaatatgatgaaacttcctctctacaaaaaaagaaaatacaaaaattagccaggtgtggtggcacatgcctgtagtcccagctacttgggaggctgaggtggtaggatcgcttaagcctgggaggttgaggctgcagtgagctgtgatcatgccactgcactccagcctgagtgataaagtgaaagtctgtctcaaaaaaaaatcaaaaagcttccctttatttctcggtgtcagaaagaacacgagtttatgagtttacagtcatggaagagattctgcagtacaaatgggggtaataataccttccttatggtgttgttgtgaggatttaataaaatagtgtctgcaaagcatttgactcagtatctggccttgataagtgctcaagtgacttaagtcgtttaagtcatgacttattaagctgtgggtactgttacactgccactgctgtaccacataggaaactacaaatctacatggccagtgctctcacggtccacctggggagagacccacgaacttcactgagggaggattggagagggggacatggtagttttaagctcaagggccaaacaaggaagttttctcttcagtgccctgcataccagagaaagatcccttccttgggagaatgaagagttttgctcccttccagcaggtaatgaaggaggagaggacactgtgcccaggcaggaaaaagcagcaataactacagacattttgcttcctctgtggctccctggtaggttcccctgaaaaaaaaattttttttttttttttgagacggaatctcgctctattgcgcagactggagtgcagtggcacgttctctgctcactgcaacctccgcctcccggggtcaagggattctcctgcctcagcctcccgagtagctgggattacaagagtgtgccaccatgcctggctaatttttgtatttttagtaaagatgaggtttcactatgctggccaggctggtcttgaactcctgatcttgtgatctgcccgctttggcctcccaaagtgctgggattacaggcatgagccactgtgcccagccttgaaagcaggaatttaattaatttaatgagtggggctggcttctcagagctgtgcaggtctgtctgcaacagggcaggggccacaggagttgccgacatgaacagtgctccctgtcactctgaaggaagaagagagaagaatcccaggcctctagtgtgtcttctggcccaggtgaggcctctgggcctgtggagatggcaagtgacccagggacgggtgtgagatgggagaagggggtggagattctcccagactctcctgtgctttccacctggaggagctggggcttctggtgtggcatagagcagccttgccatcctctgggaggagcattgaggagatcacttggactgagcctttcccaggtggagatggggatttgctggaaaacagaagaggggacctaggggctagcacacgtaggtttctccaccaagggcagctgccaaagcagctcttcctcctgggggtggaggggtggaatcgggccctgagccatgtgcaggccaggtgacagccacctgggttgggcaggagaggcccaggtgtccaagctcccaggaggtcccccagcctcctctggcccagctgggagtccagttggccctggtactaggttagggaggtctctggtggttgcacgttataaaaacatgtttgagtagaaggtggaaaataagacaggagaggattatttgaagtaggggagccccagggcaggagagcttctaagcctcaggaaggtgctggaccaggaccaggaggctgtctcccaatccccctcctggccccacccttccccccattctctctccctgctctcctctctttcaggcaggttggagggttgggggagtggcacaggagatgccctagcacaggttaggaatctagtctttctcttagggtcatgcccagcggtggtggggaggtcatgatgtccagatggcactctccccctgtgactgaggagggctggttaagcagtggtcattatcagctgcctggatgctccaaagacacctattcctaaagggaagtcagccccaagccagggaagagatggggccagtccaaagaaaaggctgataggaagtggggagatgcgatggttcaggaagaggctcgtgcatctggcctcctcgctgtcactcctgccacggctttcccaggcatggagtcgtggggctctggccagctctggtgtgggggctcatgctgtgtcaggtgacttcctttcagctcagcctcatgaacccctggagcatgaactccgaaccaccatccgggccttgctgtgagttttgcagctttcatgaaactctcctcttccctgggattgcaagcccctgggtggaggggatgggagtggggtggggctgactttggcagcttagatccctgagtgccctaaacactgtgactcccaggatgggactgggtgaggaaagtctcctccactggctgcagatttccagtgagcacaagaggaaaacaataccaggaatgatttggatctttttctatcgttcaagctcctgtttttttagtctgcggtgaatcactcctcatgtctctgtagatagcctcacattctgctttagttgtttcctgaggaacagttgtgtcctccactccattttaactttctttactgtaattccttatatctgtgtagtgctctgacttgaagaacatactcacctttttgcattgcacctggtcccagcaaataaaaaaaagttcaggagtcttacacaaatgcacgtcagataatgagagaaagtaaagaaccctccatgtactctcttatagctcagagagtgcgcggcttcccccagcatagctgacatcctgctgggcatggcatggacaccggtcaacagttggcccaggggaaggaggaggacagggtccctttaacagagccagccaccctagcatttcactggtgcctgagacagtgtcgggagctgtgtttctggctgtatttctctgtgtggtccccctttggagatgagccccgcctcttcccctggggctgtcactcagccagagcagaatcagtgtcagcgctgtctgagcaggctccttgcctgtcactaaggcatgattcacagctgagtgatgccctctgaaatcagggtgcagagcccacgcccatgggcagcctcacccgctctattttggtgttggttgtcacagaatatgggaggagccattctccttgcctctgagaggctcctcctacttcccctttacaacagccaggccagcccctattaagaagccagggtagaagatttatctcttagcccaccagcttctacctgccaactccatgggtgtagcctgagagatcagaaggaggagtaaatataggggtaaaaacacatgtttgatggcagacagacctggatgtgagtcttgctttgcctttaactagctgtgcttccttgggcaagttacttaacctctctgaacctcggttttctcatatgtaaaatggcaatgatggtttctacccccctagttattctgaggattaaataggcagaaggtaatttgcaaagtgccttacacacctggtaggatctcagtaatggcaactttagctttattagagggagcagagcatttgtagccgcagaaagaagtttggggttggtgctctctctctcagggagggaaacttagtgaaggcttctgaggattgggaggaattgctctggagactagaatgatgaagcgtctttctgccatgtctgttcactttccacatgcatcgctcctctttcaggatgaagttttatctctgtttctgcagaaagcttatcctagggtttgtttgaaaaattgttgcagttggccacaaccctgccatttgatgtcaataaattccacttgttttctcccatgagaaactaagctatttgggcaaggaaggaagagatttcaagattcacatttatcgtcactttgttgagcaagtatttattgcatatgcactacatgccagacatcttcatgggtgctggggatgattccctggccctacagattgcagtctggttgtactagaggactcttatggccccttaagaagaactggggagtcttcatttgcccctgctcttgcactgaaaccttcaatgtctacttattgccagaagatacaaggtccttaatgcctagataccctcagcctccatctaccttgccagccttccctcctctgtgctcttagaacacccagctctccaagacccctgttctttcagttccaaggcagcttgtgcttttctgccttggctcctccctagaatcccaactcctatcaatctttgcctgagtttcccagctctatcttccaggaccagctcaaggtgtcaccagatccccagggatgcttttatagtcactgagcaccattggggttattctgccagagccatgtagaccactctataccagcaaggtctcatttcacagccaggccacaagctttgtgagaacaggactgtgaactgggcttcttcagccctcctgatgttatagagtgatggatgctgaagaaatatttacttagctaggcatggtggcacatctgtagtcccagccactcagaagctgtggcaggaggatcacttgaacccaggagttcaaggctgcagtaagctgtgattacaccacggcactccagcctcggcaacagagcaagactctaacaacaaagaaaagacatttcatatatttacttaactgggacaaagctccgagttagatgttcaagtggggtagtggggtcaagctcaaatgacctccccctttctggaaggtcatgaaatgacctgccaggaggcctgccctcttgtaaacattctaggccctattgtactagaggatattccccaagtgctttctactatttgagaagccttggtggggatattcttgtcaaagctactttacggctgttgcttttgtagaacctgcagccagctctggatatttttatgtgaagctattatttcaccacttcttgccaactttttcattaatacatatatcgtcctacactgaccacagttgcagttcagggccagattctgaagcttgtccttaaaggcatgagcttcagtcattgattcagtggtggtcccattgaccccagctcccctcaaggctgcgcattcacgagggtgcaagtcatgaccacttgcaaattcatgttgcgagtgtctttcattttgtttgtttgtttgagacagagtttcgctcttgttgcccaggctagagtgcaatggcacgatcccggctcactgcaacctctgcctccctggttcaagcgaatctcttgcctcagcctcctgagtagctgggattacagcatgtgccaccacgcccggctaattttgtatttttagtagaaacagggtttctccattttggtcaggctggtcttgcattccctacctcaggtgatcggcccgccttggcctcccaaagtgctgggattacaggcgtgagccaccgcgcccggctgtggtatgcctttatgcagtgtgtgatagttttcctgtatttactagacatcagattgtgactgctcccatagatttggcagttgaaatacccacaacctcaatgtgtcctgctttgaaaagttgtatgtttgtgttcacttatgaaaaccacacttgtgaactaattaacttgttttacgttcttaaggaagctgaggggagggtgttatgaccacatcaaaggcccaaacagtacctttggttttcctctgaaggcagaatcacccctgaaatggatcaggctgtaatccactttactttctgctttttaaattcctactttcagtaatagccttcctggtttctaggaatgtagaatggaaatgaagtcataattaaaggtagtaaggaagggttttttttgtttgtttgtttgtttgtttaataggaaactggtagttaaccctttaaaaaatgaacagaggccaggtacagtggctcatacctagcacttttggaggctgagatgggaggatcacttgaggccaggagcttgagaccagcctgggctacaaatgagatcccccaccctctacaaaaaaattaaaaatgtgctgggcatgatggtgcaagcctcccctagctactggagaggctaaggtgggaggatcacttgagcccaaaggctgcagtgagctatgattgtgccattgcactccagcctgggtgacagggcaagaccctgttttttttttttttttttttttttttaagaaaaattatagataagtaaattgaatgattgctacctggtgttccctttgggttttcccacagtggatccataagctgagcaaggaccttgcccaccaggtgtagctattctttctccctgtgcttgtgtaatacacagcatatacatgccttcttcctcgagttaagacataaatgcccaacagatatgtgtctttctcctttatgcctctgaaccgatttcctcatgtacaaaatggtgccgataattacttttctcatagagttgtttaaatgttttctcataggaggtttaaatgaaatggtacatgtgaagtgcttagcagagtatctgatttgtagtcaatgcacaatctgtatcagctattgctataattggtggtgtcattggtttgctaagatttcttggcctgcattttggccctggctgggccttgactcctcaatacatgtacagatgctccttgacttaagatggggttatgtccagataagcccattgtaaattgaaaatataaatcaaaatgcacttaatacacctaacctactgaacgtcatagcttagcctagcttaccttaaacatgctcagaacacttacattagcctacaattggacaagatcatctaacccaaaacctatgttataataaagtgttgaatatctcatgtaacttattgattactgaaagtgaaacacagaatggtggtgtgggtacttgaagtactgctgctactgaatgtgtatggctttcccaccactgtaaagtcaaacatcataagtcagggaccagctgtctccagcattcctccttcgcagctttgggagggggtggtgctggcatgagaactaagctgaggaacctgtagcggtggctccaccagccaacaggccaagacagctgcacaccagaggccttggcccagcttaagaaatggaacttctgggggccaggtgcagtggctcacgtctgtaatcccagcactttgggaggctgaggtgggcggatcacctgaggttgggagttcaagaccagcctgaccaacatggagaaaccccgtctctactaaaaatacaaaattagccgggcatgttggtgcatgcctgtaatcccagctacttgggaggctgaggcaggagaattgcttgaacccggaagacagaggttgcggtgagccgagatcatgccattgtactccagcctgggtgataagagttaaactctgtctcaaaaaaaaaaaaaaaaagaaaaaagaaaaaaagaaaagaaatggaacttctggcaaaaagtgatttgttgagcattctgaggctcaatacaaagaaactcatttgtgtaggtatgaactttggaaaaaaccacctaaagaagtatgtgaggttttctgttgtggtagggttcaaagcaagttgaaatggcgaagagtacagatatcaagaaaaaggtccagggagacaagatttgtcttttttttttttttttttttttttttgagatggagtttcactcttattgcccaggctggagtgcaatggtgcgatctcggctcactgcaacctccacctcctgggttcaagcgattctcctgcctaagcctcccaagtagctgggattacaggcatgcaccattacgcccagctaattttgtatttttagtaaagacagagtttctccatgttggtcaggctggtctcgaactcccaacctcagatgatccacctgcctcggcctcccaaagtgctgggattacaggcgtgagccaccacacccagcccaagatttgtcattttaaaaccaaacaaaaaagcccttgtatcgaagtttggataagaacctatccaaccttggccaattttgttgaactctgtgggtttaggaaacccacagaattgcctgaggggattttgttgttacttttttgttcagcagaagagtctccctttgaatagaattgtcttttaggaagagagaaaaggaatgagaggtgtgtctcctggctgatccagcaggccccacgcccctcatatccttataggggcttgtgccaggcattggcctgaacgttttagaagctggcagcaaagccagtccctgagtgacagatatttgtggccccaggatgaggagggcctctctcccctgctggggcccatgtgtttccgtggctgcagcttcaaggcctgggtttattactcagtttaccatttagtctagaacagcacagtggctcctgatactttggggacagctttggattggagctggtgagatgggcttttcacctctactggtgctcagtgtggaagcagcagcccaccaaagagcttccatttcccttcattgtgaaacaccatgctttggaagggaccccagggtacatcagagtgtatgagccccagaagcaggctgtgccgtggtctggaaggtggcagccccgtgagccacccagacaccagctcctgctcatctcatgccttccctcacctcatctggatcagaggagaaaagcaaatccacaaaaatcaacacaactagagatcaattgctatgccagacccagttagtctggtgagtgccgcaggtgtctccacacctcagataattgagaattaggcctcaggacttgcacagccaagcactgcctgagactggtctgcagtcggcttccatagaaagatgccggaagtggatacctggtcctgggtggtttgctgtagggggtgatttcctccatgaggaaaaccaaagaatccaaagccctctgcctgcaaggaaagttcagtggggaggaggctgtgctggtcctcagctctcgccagggtggcagtgtggtggggtaggcatatcacagcagcctggagaggaaacggtgctgaacctgagcccttctgaccttggaagttttggttttaatgtatgtgagacagagatgaggcatgtgtcagtcagaggctgttatcagccattataataatagtagccagcatttatggaggacttgtgttccagatcctaaggcaagtgctttatggagatttattcatttagtgtttaaaacaatctttttctttttttgaaaattttttgagacaggttctcactctgtcatccagactggagtgcactggcgtgatctctgcttaatccagccttgacttcccgggctcaggcgatccatccacttcagcctccagagtagctggaaccacaggcacacactaccaagcctggctaatttttgtatttttggtagagacgtggttttgccatgtaacccaagctggtctcgaactcctgggctcaagtgatccaccctcctcggtctcccaaagtgctgggattacaacaatcttataagggaccctagaatcgcagtttgatagatgaggacattgaggcctaaagcagttaagcaaagtgcccaaagtcaaacagcgagtacattgggggttgggagagtgaatatttagaacaatccaggccaacaactctaagcccagctcttattcaccatggggaagagtaaatgaaattaaatgaaatgatcttcataaaaggcttaatgcaggcagcaagtaagtgctcgttcagttacaatgagatatccctgtttttctgcgtattttattgtcctgcattttgtgctaggggccctgatgtggattattctagtcacatgctaaaaatgtgcagggttttcagtctctttgtattgtggtgaaactgctgctgatctgcttttcccactatcggtcagcctgggcctgcttccattttcactttgagttttcaaaggtcaggggagtcctgatagattgccttcttatctcctaagtgttttagagtggtttattcatttaacaactgaaagtgatttttttttttttaaagaaacaattacctcccttggtcagcagcaacatctccagaggtcagcatccccctcctggggaaggtttggcctgctgagtccaggctggctgctaagggaaccaagtctcttttctatctccagggctagcacagggcctagcttgggacaggcactgaaggaaacagtggtttgtgaatttcagcggggggctgttttgcagttctggacttcagagacaaagcttcaaattcctatcctttctccagacaggtcccctgctcttctagagtactgagggatcttggccacagtcaggtggggctttcccagacaacttttttataagcctgtggaatgccctctgctgagtcaccacgctgatacccagggctggggtgtgtctgcgaagaaccgtgctctagacattcagggcttggtcctgggtctgggtgggtggctgaccttaggtctaaccataggcttcaagcttttatctttcactgagtctgtgccaagcacattccgtaaatgatctcattgactcttcaagaaagttaagagaatcaatattgttgttcccattttcacagatagataataaatctgtaaaatcgcgtaagactaggacatattttctaggattatccttgcggatcaaaggtgatatcaagtgggatgtcaggagcaagggtgcttgcagtgtcagtgatttctgttgttggaggaggggcagggttatggatgaggaatgtggggtttagtagggttaagagatttgccagaggctgggcgtggtggctcacgcctgtaatcccagctactcaagaggctgaggcaggagaatcacttgaacccaggaggcggagttcaagtgagctaagatcatgccactgcactccaggctgggcgacagagcgagactccatctaaaatatatatatatatttgccagaggtcaacaggctagtctctagtccttgtgcagaagcaagatttgaaatgggttgcttgttctcacacgtctctttgctggtcagtgtagagataaagaaccctctccccacctacagtgttcttaagaagccatggttatcttgggtgtgatgatctttggaaggtagaaagttccactggcaggcatttcctcctggagtcctcagcctccttatcaggctcccagattcggactgtcagtgaggtgggcagggctgtggaggggagaggtcctgtcacaagagacacccagcttcctcccagctttggtttacctcaggcccggcctgaggtgaagtcctcattaggttacctcccgcctagctgtgactgggttaagttgttggacttctctaaggttcagctccctgttctggaaaatgaagacaaggactgtgcctgtcctgtagactttgaggattagctgaggcaatgcccgcatgagccacttagcttgatgccacataagtgcccaggagacatcatcctgtggtgattagttagatctgtcatacacccttacaccaggaagaccccacctggtcattcttttccccacaatcctcttctcccctaggataccaatgcctcttcttccctcagagttaatgcagttacaactattctagaactttctgacagcattcctactccttcagccacccccctccatcgccgggcaaaaatgccatggtccagcagccactcagctcagtggggtggtacatacaggggcgcgtgacaaggatgaggtaagtgctggatcaccaacctccctgcccctcctgtggctgcgtgtcagatactgtgtgccaagctcccttcagccactatctcatgtaaagctcagaccccacgatttccggagtcctagagtagtctgggtgtcctcgtggtgggaactggctgtcctcctggccccttgctcccaccctcctgccttcttggttcagtgataaggccttagatcaggagggtgtggctaggtctgactcaggggtgacccagaggcacttcacagatctgcggcagaaggcctcatcacaagcatgaccgaatcttgactttatttataaaaggcaaaagcccactcttctgtgcagttgttgtgggccccagaagtgaggggaactccatagcacagttgaggtgggcagtggccatggagagagatttccaacgcagggcccgagccatctcctcgcagcttctgcattttgcttctttcatttgttgaagcaaacaaggggccaggaggctcaatcaatgtgtggaactttcacagacccttcagaagagtccagctgttcccagcagctcttggggactgtggcctgtttctgacttaaactcagccttagattctaaattcttgatatggttcagtgatgatgaaggggggaaacatttacatgttagaatgaaaaggtaaccaattttacattctatctaaaggtgaatacaagatggggattatcttgttaacttctgaagaaaattgagatgggggtctcgccatcttgcccaggctggtcttgatttcctgggctcaagcgatcctcctgccttggcttcccaaagcgctgtgattacaggcttgagccatcatggccagctagtcttttaataataacaataaattatcagcattggagctctggatgtgggaaatgcaaaacagtcctgctgggtcatcatctcaaacctggactcttgggagagataccctgtggatcattacatcttttcaattccttccactcctgtttcctcaccccatttgtggtactcaggcaacagagatgtcctctggctggaaatccagaggatgaggtgggcacccttggactgtccctggttaaatgtcacctcctctccccaccccctttcctggctctctcaacgcacatggggatgtttaatgacattctccttttcccctcgtttaggccttgggagcagtgatattaactcactcagtccacacaactttccatggagattactgtaatctgttattcccgctgtacagatgaggaaactgagtcaaaataaattatttgcccaaagccacacaggaactgctagagctgagactggaactcaaaccatcaggctctcaaatcctccttttagccaccatgccctaatgcaactcgaaacagaaaaaggacagcttgactaaaaagtctcccatttcctttcccccttgccctaaaaaccctgtgaactcagcctctgaagagttcagcccttctctcaggtgtgagaagtaatttggcaaaagagaaaaaaaattaaaaagaagaaaaataacctaaaaaggggggaaggccaggtacggtggctcacacctgtaatcccagcactttgggaggccaaggcgggcggatcatctgaggtcaggagttcgagaccagcctggccaacatggtgaaacccccctctccactaaaaacttaaaaaattagctgggtgtggtggcggatgcctgtaatctcatctattcaggaggctgaagcaggagaatcacttgaacctgggaggtggaggttgcagtgagccgagatcacaccactgcacttcagcctgggtgacagagtgagaccccatctcaaaaaaaggcggggaggagaatgaagatttcggcccaagtgctcaggagcaggggcctcttgatagaactgggcactggaggtgagcaacccagatgtcaattattaggagatcttctctgcttctggctttcccagtgctgacaggtgggatccttgtcaggcagcagggcagcactgaaggaagcaaagccgtttcttgggggccccactcagtgagtgaagccatagcttgtgcagtggccaggtggatcgctcgagactccctggaattgcagcctccagctttgagctgctcctgctggccgcttggcttcacagtcaccaccagccgatggagacggttcatcaaatggaaaagtttcggtgactgtgggaaggagggcattctttgcgagctctcttggctttacactttaaagagggcagtggggggaatgcacacacaacctttttcttctcatctgttctcagaaacccaggggaaaaaaatgggctataatgagtagcagttgtggttatgatgattttcatatgaattgtcaaatcttctgtgtccattaactatcttttgtggtgaggaaattgattatggaactgaaataagaaactccacctgactattaagtgataattcagtccccagcctcttggctctttatccagtatttaggggggaaatgcctctgtggaaacagatgccttgcttttttgggaagacagtccatttgaatgaactagaatgtcttcctgccaggagtgggtctccagtggatccttgtcaagaggtgggggaggggcagagtgacagctgcagttggccccccaaatgtcagtgttccctgtagattcttgtcaaagggcttacctcgtactgtggtacaagtcagggctacacagaaaggcctgtcttgcagtctgtttgcatagctgtgtcttgcttgcagaaagccccgggtgggggtagaaaaaaggcagagacaggccgggtggtggctcagacctgtaatcccagaactttgggaggctgagatgggaagatcacttgagctcaggagttcgagaccagtctgggcaacatagtgagacctcacctctactaaaaatacaaaaatagctggggcttgggggcgcatgtctgcagtctcagctactcaggaggctgaggtaggaggattgcttgagcccaggagtttgaggtaaaccgtgatcataataccactgcactccagcatggggcaccctgtctccaaaaaaaaataaatttaaaaaaagacagcagcatcaatgaagccttggttggctcagcctcagggtagactgcattatccatccctgacaagctcagaggtgggcgcacaaacccaggcgctacgtaaaggccaagacagtgaatcatccactcagagcccacttcacctcccacccctggtccttatcaggtgttgtcgtcccacagatacttactgggtacctcctgggtcccagacagtcctggctttcatggagcttctaatccagcagggaaaacagatgtcagagattacaaaaagaatgtgggctgggcgtggtggctcatgcctgtaatcccagcactctgggaggccgaagcaggcagattattaggttaggagatcaagaccatcctggctaacatggtgaaaccccgtctctactaaaaatacaaaaattcagccaggtgtggtggcacgcgcctgtagtcccagctactcaggaggcggaagcaggagaatggcatgaacccgggaggccaaggttgcagtgagccgagattgcatcattgcactccagcctcggcgacagagtgagactccgactcaaaagaaaaaaaaagaatgatgattaatgggatcaaacacaaggaaagaatagtcttgggaaagagcgaggcttgaatcccagctcaggctgtgagctcaggccagtcactctgcttccatgtcttagtttcatcatttataaagtggctgttgcaagacttaatggctcatatatgttgagtacttggcacgtggtaggtaccggattggtatttgttcaaatgcacatgaataagtcatggcacatctccattcaacaaatatttattgagtacctactgtatcccaggtactgtgctagatactaagaatatagcaatgaataaaacagacaaaagccctgccctcatggagattacatagtatttgggaagacaggcaataaaataatagaatgaatcatatatttgatggttagttttatggagaagttattgcagagaatctgactagggagagctggaagtgggcaaatacaggtcagagatttgggaaaagccctgaaggtcgtgagggacctagccatgcagatgccaggggaaaggaatacttcaggaaaaggaacagtaagttcaaaggccctgtggctagcatgtttgagaacagcaaggaggcagctagtgtgggtagccagagaggctgggagtatgggagataatatagggctttgaagctaatttaaatattttttaaaatttatttaattttgtgggtatatagcaggtatatatatttatgaggtacatgagatattttgatacatgcatacaatgaataatcacacatcagggcaaatggggtatcaatttaaagacttagtgagagtgtggtccagggtggtggtgggtggcatagcgttttttgtttgtttttgagtggagtttcactcttgttgcccaggctggagtgcaatggtgcgatctcggcccactgcaacttccacttcccacctcccaggttcaagcgattctcctgcctcagcctcccaagtagctgggattataggcgcccaccactatgcccagctaatttttgtatttttagtagagatggggtttcaccatgtcaggctggtctcaaactccagacctcaggtgatctgcccaccttggcctcccaaagtgctgggattacagaagtgagcctggcctttagtgggttcttactgaagccagcctgaactgggaaatgtccagatttatacaaataatgattcagaaaatgagactaccctttaagaagaccatattctgatcataatcataaatctggcaaattcatttatggagataacaggaaaacaatttgaaatcagaatatccaggaaaggccaggcgcagtggctcacgcctgaaatccgagcactttgggaggctgaggcaggagaatcacttgaacctgggaggtggaggttgcagtgagctgagatggcgccactgcccagcctgggcaatagagcgagactcggtctaaaaaaaaaaaaaaaaaaaaaaagaatatccaggaaaatcacgaggacacagccgtggtaatcagtatgaaagcatgaaagcccccagtatggaatgtttactgtgtatctattgcatatttaatcttcataacaacctgatagaggtgggtactgtgggctccattttacagatgagaaaacctcaacacacacagaggggttcggtaacttgtccaagatgatccagaggtacatattctgtccccaaagcccctactcttggccacgactccataaaatacttctaaacagcttgcttcccttgtacagtttaaatgattttgtctttttgcatacattcaactttctcataaacttgaggttcaccaaggagagaattatttcccccacagataatagctgccaaaatagagtccgaatccctgagggttcccagatggctgggcacacccaagctgcagaggctgtctggaatgattagggcagaggaaggtgctaatctatctaggagcgagcagctttgcggctgatgcgatttcgtttatctaccctcctcggttctttgtctctttatcctcctgtctccctcctggcctggctaacaggcctgatgtatcggcatctcaatcacttctgcttccccaggagatcaaggcctggccttgggccctgaggcctcccggagtaaatcagtggattgaggggagggggtgccggggaggcatcaaaagagaatggggtcctctggcttcaagctacctaaaatctgctgcttaaaatgctgctgttagggaaaactggcggcacagagtccttctccagccctagaaataacctctctgaaacctgtcgagtgacccaccccaaattagaaagaattttttgtcttaaaaggcacattaaagagagtcctgtgttttctgccctgtgccttctggaggtagaagacaagtgtgaattctctacccttctacaacaagagcaaaggaagaagaaaatttccatattttctcagctatttcaaaacacatttttttacctttcatatgaagtgactgttccaaatgacctcttctttccagggaaaaaactctattttaatactttttctcccctcctctttctccagccctgtctcttttttctatttttaatctccctctgccaacaagaatatccacggacttcccacctggcctttacccttctcttccttgcaggggtgtacccaccagcctgcacccgatgtccacgatgtctgtccaccccagaacccagcagcatctctccccgtctggcgctcagcctgcttctgagtgtgggcagcagggaagctaggcgctgtgcttgcccagaccacacagctgtctctgtttagggctttgctgcctgaaagtttgtttcaaggaggaacaggctctgctctgccttctcagcttggtctccttacctggggcacaaagagtgttcacttagctagcgctgacctcctgcagctaattaatgcctctagcatggatcagaaaaagctctgcaaagtgcaattagcgatggatcacttgttgctacttcataggagtggtgtcagcagtattcatggcttgtggcttaaaagccagaaggagatccccaatcaggtcctggatggctctgataggcaaatcctcttaggaaggtgggatcacaggcaccaattccttttgacctcccccgctccccttcctgtggggcttattgaacagaggctaattcattcagtattggagatgtagcagtttattgtggggttcaagatccttgtcatctctgaggataacagagagagcccttttattgaactcttgctatgtgtcaggcattgggtttagtgctttatgcgatatgttcataaccactacagagaagaaaccatatccgctttacagatgaagaaactgaggtctagaggttaagtacttaccccgggtcatggtcagatatttggctgatggcattcatttcttttctagaaatgtcttgagcatctatgtggctgacatttttcaggcaatccctgctatgcagagcttgcattttagagggagtaggggcaccagatactgagcaagtaagcaaattaataaacacaataatctcggccgggcacggtggctcacgcctgtaatcccagcactttgggtggctaaggcaggcggatcacaaggtcaggagatcgagaccatcctggctaacacggtgaaaccccatctctactaaaaatacaaaaaaaaaattagccaggcgccgtggcgggcgcctatagtcctagctacttgggaggctgaggcaggagaatggcgtgaacccaggaggcagagcttgcagtgagccaagatagcgccactgcactccagcctgggcgaaggagcgagactctgtctcaaaaataaataaataaataaataaaataaacacaataatctctgtataagtgcttcagggaaactaaaagggccctcttctgtggcagaactgggattcccagtctctgaggttaagcaggagcaggtagcattaccctgtaagctgggagtcgcaataggcaattagttacctgactgtcccagggcttggcactgcctggtagccctgccttttcataaggaaaagattccgcacaaagcactttacctaggttttgtgagaggcggagccagagctggcatccgaggtgttctcacaatgctggactttgaggcacaggagagaattgcatttctcctctgagcagtggaaccagccctggtgcctcccttgcccagcctcaccctgggaccctgggtgtgagtagttagtcttgttatcagtgagagtaacccaggaatctccctgatggggaaatcccaggtaatttactgtgtctctgatattccggttacagcctctgctctagaaaggccagggaggggagaatctaaaagttctccatttctcgcttgagatggcatccccccatgctttccttaggcctccttgagtaaggtgtctgcaaatagcttctcagcatgacttcacccggaagctcatctgagtgactcacagcctgctttaggcacctcctccagggagacgctcttacccttgcccccaccccaacaggggaggggaggggagaagggaaaccccctaactgagccacggagaaggccttgccagagcactgtggaaaatacctgcagcccagcttggccctgcttcaggtgccctgggatgtatggtttctctagtcttctgagagggatcaagctgacaattcaaatttgagggagcgatgaccctggaaactgtgtaggtcttaaaaagaaatatatatccaaacacactgacctgaaaagatgtccacaaaatacaggattcagcattaggtgaaaaataatttcattatgttcctgtttctcaaattcggtttgtgattttaaaaaattgataggttagtacatgtatttgtacatgtactatttgtactaaaagcctatttgaagaaaaattataatatattaataatagttatctctgggaggtagtattaaaagaaactttattcattattcctttctgatttttaaaaaataatcataattacctttataataaaaaaaaaaaaggtgggccaggtacagtggttcatgcctataatcccagcactttgcaaggccaaggcagattgcttgagcccaggatttcaagaccagcctgagcaacatggtgagaccttgtctctacaaaacatttttagaaacttagctgggtgtggtggtgtacccctgtggtcccagctaattgggaggctgaggcaggaggattgcttgagcccaggagtttaacgctgcagtgacctgggaggcggaggctgcagtgagccaaggtcacaccactgcacttcagcctgggcaacaaggaggctctgtctcaaaaaaaaaaaaagctgcagtgagccatgatcatgccatttcccttctgcctgggtaatagagcaagaccctgtctcaaaaagaaagggttgtttttttgttttgctttgtcttcaaaaaaataaaaagaaaaatcctcatgcaccaagcccaggtgtcctaattgtgtcctcattattaaatgcctaacttcccgtggtggactgttagcaggaagcgactgggatggacttaacattcacttagcaaacagctacctccctagccactggaggaccaaaccactatgacagggtgtctcccttcagtggctcccagcatgatggagggggtagtatatgttttgcggggcatttggggttttggggggaggttagggggttttttgagacagagtctccttctgtcacccaggctggagtgcagtggtgtgattatggctcactgcagccctgacctcacaggctcaagagatcctcccacctcagcttcccaagaagctgggaccattacgcctggctaattttatttattattatgtatttttttttaagagacagagtcccactatgttgcccaaactggtctcagtgatcctcccaccttggtctcccaaagttctgagattacaagtgggagccaccatgccccctgaccaaccaccaccctgcacccaaggccaagggctcgataaatactttgcaaacaaatggatatgtaaatgagtagatactaagtggtctgtgagagaaggctacagattgtggtggggcttcagaaggtctcgagaggtcccttgctggggattaggttaggcctcgtgatggtgcttctgggatattccttttctctaggatttaaatgtctcatttaagaacaatttttttttttttttttgagacagagtctccctctattgcccaggctggagtgcagtggcgcgatctcagctcactgcagcctccgcttcccaggttcaagtgcttctcatgcctctgcctcccaagtagctggcgctacaggcgtgcaccactatgccctgctaattttttgtatttttagtagagatggggtttcaccatgttggccaggctggtcttgaactcctgacctcaaatgatccacccacctaggcctccccaagtgctgggattacaggcatgagccaccactcccagcataagaacaattttagatttacatgaaagtcgcaagagtattacagaaagtttccagataccccacaccgtttcccctattaacattattaactaaagttcatacttctttaggatttccttagtttttacctaatgtcctttttctgtctcaggaacccatgccatatttagttgttatatgtccttagattcttcttggctgtgacaagactttctttgttcttggtgagcttgacagtttagaggagagctgatcagatattttacagaatatctttcagtctaaagtttttctcatgactagtgtggggttatagggttttttgcggggaagtccacagaggtaaagtgtcatactcatcatatcaagaatacacactatcggccgggtgcggggctcaccccatctctactaaaaatacaaaaaattagctgggcatggtggcatgcgcctgtaatcccagctacttgggaggctgaggcaggagaatcgcttgaacccaggaggcggagtttgcagtgaactgagattgcgccattgcactccagcctgggcgactgagtgaaacttcgtctcaggagaaaaaaacaagaataagaagaatacacactatcaacatgacttgtcactgatgatgttaaccttgaccacccgataatgtttgtctggtttctctactgtcaagtattattccccactcccgcccctcaggccacgtccactctgtagtctttagagtgaagtcactgtgtgcattccatagctaagggatgggaagttatgctctacctcctgggggagggtggtatctattaatgcatagattaattggaagattgattggtttattctcccctagttattttttcaatcagtaagcatgcatatatgggtatttattttatactttgggtcattatgcaatattgtgttatttattttgttatgcaaattgttccggctttgcccgttgagagcgctttcggttggctcccatctcatcattttaggattctttgagcactcttactttctggtaccacaagatgctccaagctcattttctgttttccatgccctgttcctaaaatcagtcaatttctcgaaggagctctggttccttttattgaagaatgctattagaatctaggatctgctgtgtgcggtggctcatgcctgtaaccccagcactttgggaggccaaggcgggaggattgcctgaagccaggagttcaagaccagcataggcaacaaagtaagaccctgtctctacaaaaaagaaaaagaaaaagagaaaccagaatctgggcactggatatactccttgctactggagtgtctgggacattccttttgaaagaaggttttcggaaactaggtaaagaatttgcagatcatactgagatttcatgatggaaataagaggaaaaggactggaagaggcactgtaagcctcttgtcatatcaacaacttcaggcagacaccatggaaggtcctgtggcatctgtctggtgggagggtattataaacagtcaaataaatgaccacagatgctttaggaaggggccatcagcatttagggactgtaagggggcaactctccccatcgtcaacttaccagagccttccccgtccatgtccttgttccaggtaccatttttgagtccatcctgtgttccaggcactgccctaggttctcactcaaccctcagggctccccgaaagttattttaggtattgttggccccgtcttactgcagaaaggctgaggacttgtctgggtaagtgactaacccctcattcaaacccaggtacaaccctcaaattctccctcactgagctgactgccacttaacgtggtttgggaacttcttagcttcaaaatgcaacactccccctttgatagagatgtggatgttagtgcaggcaaggactatggtgtcaccaaggtcaccggtccccctgctctgatcacagcagtcatcacagggaactgtaaagaggtagggtgtgtttgcgcatgcatatgcgagtgctgagtgcgtgtgccacctcccacctacaggcttcccaggagcttcaacagagaacccttgcccattgcctggcaggtagctgtatccgactaggggccctgctgttgagaactgaacaacagtgagcttcagaagagaggaacgtgaacatatctagaaaagccataggaaagtggctggcaaaactgaaaccagtggcaagaactgggtagacatttaaaggcccgttccaaagatagctaatgccataagaaaatgctgtttggtgtaataagtgaaatgaaacaacactgtaggtttaaaaatatatgaacaatatttaacaagtatcaatacttctctctaagtgatgggattatgggtgatttttattttctaccttgcatttgactgtattttttatatttttctgtagaaaacatgcattaattattcttatagtgctaaagtaatttaatatgaaactagtgagagagctttattcttaagggtcatcctaactttgtgttcaatgtgcttccattttatgtgcctcttccgtggcctttgtggttgcacttgttttaaggaaacccattctagcacagaagtcactgccgatttggtagcaaagaataaataattttctttcttttttttttttttttgagatggagtctcactctgtcacccaggctggagtgcagtggtgcgatctctgctcactgcaagctccacctcccgggttcacgccattctcctgccttagcctcccgagtagctgggactacaggcgcccgccaccacacctggctaattttttgtatttttggtagagacgggtttcatcgtgttagccaggatggtcttgatctcctgactttgtgatccgcccacctcggcctcccaaagtgctgcgattacaggcgtgagccaccgcacccggccagaataaataattctgttaaagaatcatcactaaatgagataccactttctttttcttttttctcttttttttttttttccaagacggagtcttgctctgtctcccaggctggagtgcagtggcgcgatcttggctcactgcaacctccgcacccccagatttaagcaattctcctgcctcagcctcccgagtagctgggattacaggtgcctgcccccacacccagctaatttttgtattttagtagagatgctgtttcaccatgttggccaggctggtctcgaactcctgacctaaagtgatctgtccaccttggcctcccaaactcctggaattacaggcatgagccactgcacctggcccctgagataccactttcttaggactataaccaaacagacagataataagtgttggtgaggatgtggagaaattggagccttcatacaccactggtaggaacgtaaaatggtgaagtcactgtggaaaacaagcatggtggttcctcaaaaaatcaaacataggctgggtgcggtggcacatgctgtaatctcagcattttgggaggctgaggcaggcgatcacctgaggtcggatgtcgagactagcctggccaacatggtgaaatctctactaaaaatataaaaattatctaggtatggtggcgggcgcctgtaattccagctactctggaggctgaggcaggagaattacttgaacccaggaggcagaggttgcagtgagccaagatcatgctactgagccaagactacaccactgcactccagcctgggcaacaaagtgagaccttatctcaaaaagaaaacaaacaaaaaagtaggccaagtgtggtggctcacgcctgtaatcccagcactttgggaggccgaggcgggcggatcacctgaggtcaggagtttgaaaccagcctggccaacattgcgaaaccctgtccctacttaaaatacaaaaattagccaggtgtggtggcacgtgcctgtaatcccagatactcaggtggctgaggcaggagaattgcttgaacctgggatgcagaggttgcagtgagccaagatcatgctactgagccaagattacaccactgcactccagcctgggcaacaaagtgagaccttatctcaaaaagaaaacaaacaaaaaagtaggccaagtgtggtggctcacgcctgtaatcccagcactttgggaggccgaggcgggcggatcacctgaggtcaggagtttgaaaccagcctggccaacattgcgaaaccctgtccctacttaaaatacaaaaattagccaggtgtggtggcacgtgcctgtaatcccagatactcaggtggctgaggcaggagaattgcttgaacccgggatgcagaggttgcagtgagccaagatcatgccattgcactccagcctgggtgacagaagcaaaactccgtctcagaaaataaaaaaaaagaagaaaaaaaaagttacaattaccacacaacccagcagttccactcatatataccaagataaatgaaaatgtatgttcacacaaaaacttgtacatgactagcagcattgtttgtaatagccaaaaggtagaaacaatccaaatattcatcaataattgaatagataaacaaaatgtggtatatccatgcaatggaatatcattcgcccacaaaaagtatagtactgatacatgctacaacatggatggaccttaaaaacattatgccacataaaagaagccagacacaaaaagccacatcttgtgggattccatttatgtgaaatgtccaggaaaggcaaattcgtagagacagaaaatagcttagtgctttctaagaacagagggaaatggataatggggagagactgatgacttccaatgggtacagattcttttttttttttttcttttttttttttgagatggagtctcactctgtcacccacactggagtgcagtggtgcaatctgggctcactgcaacctacgcctcctgggttcaagtgattctcctgcctcaatctcctgagtagctgggattacaggtgtgcgccaccatatctgactaatttttgtgtttttagtacagacgggatttcgccatgttggccaggctgatcttgaactcctttttattttggagacagagtctttttcaggctggagggcagtggtgccatctcagctcactgcaacttccgcctcctgggttcaagcaattctcctgcctcaggagagtagctgggactacaggcgtacactgccacaccatgctaatttttgtatttttagtagagatggggttttgccatgttggccagcctggtcaccaactcctgacctgaagtgatccacctgcctcggcctcccaaagtgctgggattacaggtgtgagctaccatacccataccataccaaacgttttctttttggggtgatgaaaatgttctgaaattaaatagtggttatggtttcatactctgatatactaaaaacagcgaatgaaatgttttaaaagggtaaattttatagcatgtgaattatatctcattttgaaaaaacagcctacttggactcatgaacgctgagcccagtttctctatactggagttgtgaggagcatggtcctactctgtggccttgggcaagtagcttaacttctcaggttattgtccgtgttttatgttaaagccatatgtgataccatcatgtcacagagtccttaggcagtttgtactgaccctgcctgtagtctgcacttgttcattgctccttaaggaggcagcttcctcatttgtgtgaggggatcttggttttgctttctattcccataggagagctcctcttttaaaacatcccttccaggagactgggctctggatcaaggaagggcagtggtggcccatcctgccaagctattcccaatgtttatttgaggcaataaaactcaaataggtagtggcttctttttttttttttttttttttttaatggactctcagctcagtctttcacccaggctggagagtagtggtgcaatctcagctcactgcaatctctgcctcccaggctcaagtgatcctcccacctcagcctcccaagtatctgggactacaggcgcacgcaacactcggctaattttttgtatttttggtagagacggggtttcaccatgttgcccaggctgctctcaaactcctgagctcaggcaatccacccgcctcggcttcccaaagtgctgggattacaggcgtgagccaccgcacctggcttgatagcggcttctaaaacctatagttacttggaatgtccagggacttctaagctcaaagcactcatgtaacacaggttcttatttttcagatactttcttctttctccttttctctgcccaccccaccagccctttctttttattttatttatttatttatttttgaggtggagtttcactcttgttacccaggctagagtgcaatggcgcgatctcggttcaccgcaacctctgcctccctggttcaagcaattctcctgcctcagcctcccgagtagctggaatcacaggcatgtgccaccacaccgggctaattttgtatttttagtagagacggggtttctccatgttggtcaggctgatctcgaactcctgacctcagttgatctgcccacctcggcctcccaaagtgctgggattacaggcatgagccaccgcgcctggctagctctttctttttaagggaagggaagaggaaagctagagcccaagagggtgggctctgcagtctacaagccctgtgtggagtctgagctattgtttacagctggcgacttcagccataacagtggcggggtcttgcagcatgacagtttaattctttgctccccaggccggcttttggcccaggaccagggccagagctggagaccaggctgacaagcccactctttccccttctgctctaacgcgtcagagcagtcagcctctgccctctgccctccctgacggccacctcctcattagctgagcaattggaggagacgggtgtcatgaatacattgcttttcctttaacttgtaatgccatcggaagtcagaactattattctagtttaatattcagaatatctcagtatctcagttttgactgcatacctcaagtttagatttaaagctaaaataaatccacattctctgaacatggatttttttatacttattaagcacctaccatgttcttggaactgtgtgaactgcagagatgacagcaagaaggaagtgtgaagaaaaatatagtttttgcccttccttagccaaaagcctcgttaaaaaagattaccactatctcaaatcattcctacctcaagcctgagaaccagaggagaggggcagagttcagtggtgattagagacaatggtgccttctgtcttttgtatgcccagtctttgccagggactatgttgagtacatatatgcatcatctcatttgatgttcgccctcagtctttgagagtaggtgctatttccactgtgcagacgagcaaactgaggctcaaaggtggtgttatgtgttggaggccaccctgcaaggttgggtccacctaactcatgagctggtgccttttaaccaacacgtcattgtcgggggaggctctatgaagaccatggcagccagtcacttgatagaaagaaaggatggtcaaagagaggggaggccaccagtgttgaaactgcagtcatcagcattgcagtatccagaaaggggtacaccacgcctgtaatctcaacactttgggaagctgagatgggaggatggcttgaggttaggagtttgagactagctgggtagcaggacaagaccccattgctatgaaaaattaaaattaggctgggcatggtggcctgctcctataatcccagcactttgggaggccgaagcaaaaggactgcttgagtccaggagttgagtccagggcaatatagtgagacctcatctctccaaaaaaataaacaaaattagctgggtgtggtggcatacacttgtagttttcagctactcaggatgctgagcccagaagtcaaggctgcagtgagcagattgtgccaaagcattccagcctgggcaacagagcaagaccctgtctcaaaattaacaaaaacagaaagaggggcatgatcctcttagtctcttctgaaccactcagggtggacacaaacacagcataccctgaagttgtacgtgaggtcctgggctcctggatttaagagggtagtgaataggctgagactggagctgggtttacagggtgtagacacagtaccagagagtggaagctgcaaaaagacagaaataaggagaatgttctagtagttttctccaccctctggcagttgacttgaggggtggacaatcagatctcactggaggcaacatagtgttggagctctgatgtaactggaggcatgctagcgggtcagcaatttgagtaatgaggctgaggctgatgccggggcgcaggagactgctttcctctgtgctccaatcccccaggcctgctgcctgcaaggcacaagctgcaaagcaggggtgacagttcccagagctagagcatgggccacccaggcaggagcaacaccccatgcagagatagggtcagtctgctcaaagcatgagtgagtgtgtgtgtggttgggagggaggtagcagcagcctacgctcctaatgatgattacggggcaaatgtgaatggaatggggtggcgcaggggagactccaaatcaagaactaagaaaaggcttaggggagcaggagagcggagaattttggggtacagacttcctctctgtcaattgtgctgtgcagatccaggaaagatccaggccagctgtcctggaaggaccgatggggctgcctctttgggacgttgccacctctgctccagtcgggagggctgaggaaacaggttctgctgaaacaggctgattcactgtttccactcggtcctcggctgtgttggtgggcagatcacacgccagcctcgtaaactcactctccgcttgtccatgtgacgtttatagccccacagggagctggctttttaatgagcctaatttgagactgtaagtaggagtttgtaaaacaaacagcgaggggctttgggtcaaagcccaaagtttcagtttaaatacacagggtcacattagggctgtgcagacaggccaagactcctctgtgcccagggcagcaagaagaaggtgctccccagggaaaggcccaccttcccaggagagcttgctgcaggctctgtcgttcccccagaaactggggagacttagagggagaccttcctattttggttctgtgtgcaaagcactcgagagccctagttttcccatagggaggcaaggactccttcggggtaggcctatgtgcaagcccagggttagaagtcagtgcaccgaggtctccagtgcctttctgcaaagcacagccccacatccagccttaagaggcttctgggagggaaagtctgttatccacaggcactgcatctgaaactcagcatctccctgtagcttgatttcatttttgagagctggttttcaaattaagattaagctggagggtgcctgttatgaggcctgttaaggtaacctctttctacagggctccaggtggaggaggaggctcctcacctcccactcggatgcttagggctctgtgaaccaaaattaaaattctaaggctccccagccatctgaatggacttcctccacagccagggcactcttaaaatttaacctgaaagactagttcaggccatgaatggaagtggggttggacatgcctcactatacctctctggcattaatatccacacagaccttaagtctaagcagaagcatttatcatctattctctttgaagcctgctacctggaggcttcatctgcatgatgaaactctggtcaccacaacctcttatgcaacccagacattcctttctattgataaccctttcaaccaattgccaatcagaaaatttttaaatctacctataacctggaagccccaccccttgcttcaagttgtcccacctttccagacagaaccaatggttttttgttgttgttgttttgttttgttttttgagatggagtctcactctgtcacccaggctggaaatgcaatggtgcgatctcgactcactgcaacctccgcctcccaggttcaagctattctcctgcctcagcctcccaagtagataggattgggattacaggcatgcaccaccatgtccagctaatttttatatttttaatagagacagtgttttgccatgttgaccaggctggtctggaactcccgacctcaggtgatccacctgccttggcctcccaaagtgctgggattataggcatgacccactgcacccagccaagtttttaaattaaaattaagtgagtgagtgggactccacagactgcctagcagcaggtgaatgttctggccagaggattgccccgtgaggggagcgttgagcccccctattcaagctgaatgagggctagatttgccgtcaccacctcaagccctcaggggacttggctagagccactctgttctcagtagtctaagggacacaggcacagccagccaggctggacagtgtactctgagcagtcactttagcctgctccttggaaacttggggaatcacttcatctgcaagtcacagaaaacctgacctttaggggctgaactatgtacctctcaagattcctgtgttgaaattccagctcccactacctgagagtgtgactgtatttggggatgaagtctttaaagaggtaatgaagttaagtgaggtcatgagggtaggccttaactcagtatggccgatgtccttatcagaagaagagatgggccaggcgtggtggctcacgcctataatcccagcactttgggaggccaaggcaggtggatcacgaggccaagagttcgagaccagcctggcccacatagtgaaaccccgtctctactaaaaaaatacaaaaattagccgggcgtggtggcgcatggcttgtagtcccagctactctggaggctgaggcagacgaattgcatgaacccgggaggtggaggttgcagtgagccaagatcgcaccagtccactccagcctgcatgacagagtcagactccttctcaaagaaaaaaaaaaaaaagattaggacacaggcacagagaaagatcatgtgaagacgtagacagagaatgggccacctacaagtcaaggagggaggcctcatgagaaaccaacccctgccaacaccttgatcttgaacttcaggcctctagaacagtgagaaaataaatgtctgttgttgaagccacccggtctgtggtattttgttatggcagccctagcaaattgatagaccaacagggggttatttatttattatttatttattttatttttgcaacaagaggttcagggataggcagtgcctggtgtcttttagctgctgggtgagactgcgagagagccaggctctttctgccttttgctctgccatcctcagcacgttggctctggccccactctctgagaacagcttcagccgtagcagggtcctgcctcctggttacacagtggctgctgctgcaccttcttcaaacagtatgtcacagttgaggcaataagaagagcaaaagccctgccagccagagagctgattatcccttttgatcaggagaagtagtatttcccagaaaccctgaagtcttgaattgatgtctcattgtccagaactgtgtggcacggccataagagagcctgggaagatgtccaccagggctcctggcatattgcatggccactcgagacagaacggcatgtcagccaagaaggagaaggaatggagctgggtaggtcactgagaggtcagcccggtttcaagtgtccagtgatcgttttcttacttctttgcagggaaagatcatagtgtcctccaagatgctgggaatgacatagtgacctctggcaggatatacccatctgggaatgagtgtcctactgggacaataaactagcttccttccctatacctcctccaccccttcagtccctctggtattgcatattgttgcttaactatgagataaccagggagtgtttgcttctcataaagtctgtaaaatccctttggagttctttgagtaaatgggggctttttgaaacatcctgttatttttcctcccttgctgacgataacagcacatagcaaaagtcctcttttcaggctgtccttccaagtttctactacagccatgcattgcttaatgacagggataggttctgagaaatgcatggataggtgattttgttgtgggaacatcatagtgtgtacttatgcaaacctagatggtatagcttcctacacacctaggctatatggtatatccaagtgctcctgggctataaacctggacagcaagttactgtactgaatgctgtagacaattgtaacacaatggtacatatttctgtatctaaatatagaaaaggtaatgcattgcactatgatcttatgttggctacaacatcactaggtgatagaatttctctttttttgtttgtttgtttttggagacagggtcttgctctgttgcccaggctggagtacggtggcatgattgtggctcactgtagcctcaaccttctgggcccaagcaatcctccctcctcagcctcccacagctgggaccacagctgcatgccaccatgcctggctaatttttaaatcttttgtagagacagggtcttgccatgttgcccaggttggctttgaactcaagcaatcctcctggcttggtctcccaaagggctaggattataggtgtgagccaccatgcctggctggtgatagaactttccagctccattataactttatgggaccaccatcgtatatgctgtctgtcactagccaaaatgtcatgcagcacatgactattcctactacagactcctcctctagtatttatcatggtctacttaaattatttgtgtacatgtttttcctcccctccagattagaaaactgggtcttactcacctctgtattcctagcactaagcttggtataattagtaggcgtgtaatgaatatttggataagtgaatgaatgatgagaacagcatggtaaatttccctagacaaatagatcaatggaacagaatagagagcccagaaataggcctacataaacatagtcaactcatcttgacagaggaacaaaggtaaacaatggatagtcttttttttttttttttttttttttttgagatggagtttcgctcttgttgcccaggctggaatgcaatggtgcaatcttggctcacagcaacctccacctcctgggttcaagtgattctcttgcctcctctcgagtagctgggattacaggcgtgcaccaccacccctggctaattttgtgtttttagtagagatggggtttctccatgttagtcaggctggtctggaactcccgacctcaggtgatctgcccacctcagcctcccaaagtggtgggattacaggcgtgagccactgcacccagccaaagatagcctttttaacaaatggtgctaggaaaaccagacatccacatgcaaaaataaataaataaatgtagacacagaccttacacccttcccagaattaactcaaatggatcagagacctaaatgtaaaacacaaaactataaaactcctagaagataacatggggaaaaaaatctaggatgaccttgggtttgatgatgactttttagatatgacaccagacaccaaaagcatgatccaggaaaggaagaatcaatcagctgcactttatcaaaattagtttctactctgtaagagacagtgccaagagagtgaaaagacaagccacagactgggagaaaatatttgcagcaaaagattcatctgataaaggattgctacctaaaataatatgcaaagaacttttaaaactcagcaataagaaaacaaccaatcaatttaaaaatggatcaaagatcttaacagacatctcaccaaagatgatatgcagatggcaactaaatttgtgaaaaaatgttcaacatcatctgtcattaggaaattgcaagttacaatgaccatactaggacataccactgcacacctcttagagtggccagaatccagaacactgataccaccaaatgctggtgaggatgtggaacaacaggaactctcatgcattgctggtgggaatgcaaaatggttcagccactttggaagacaatttggcagttccttagttactcataggtatatgataccaatacaattcagcaactgcattccttagtatttgcccaaaggagttaaaaacttttatctgctgggcacggtggctcatgcctgtagtcccaacactttgggaggccgcggcaggcagatcatttgaggttaggagttcaagatcagcctggccaacatggagaaaccccgtctctactaaaaacacaaaaattagccagtcatggtggcaggtgcctgtaaggccagctactcgggaggctgaggcaggagaatcgcttgaacccaggaggcgaagattgtggtgagccaggatcacaccactgcactccagcctgggtgacagagtgagactctgtctgaaaacaaaacaaaacaaaaaaaacttatatctacacaaaaacctgtgcacagttatttatagcaggtttattaagaattgccaaacttggaagcaaccaagatgtccttcaatatgtgaatggatagataaactgtggtacatccagacaatggaatattatcagagctaaaaagaaataagctgatgatgcacgacaggcaaacctcaaaattaggacttatcccaggagagttgttggcttcgcctaggaaataattcaagggtgagccagtggtgttaaacagcttttattgaagtggcagtttacagcagcagcaaaggtactattccttgtgggtcaggggtatcccataggcagtgtgtccagaataacagcttagaggcagttccgtactactagtacagtaatatttgtacccacttttaattatatgcaaattaaggggtggctcgtgcagaaatttctaggatgaggttggtaacttccaggttatcaggtcattgccacggaaagaggcaggaacatctaggtgttgccatggaaatggtaaaccaaccatggcacactggtgggcgtgtcttaatggaaagctgcttctgcccgggacctgttttagctagtcctcaatttggtctgatgtccaagccctgcttctggaatatcaagccatgcagacatggaggaaacttaaatgtatatttcttttctttctttttttctttttgagatggaatttcgctcttgttgctcaggctggagtgcaacagcacaatctcagctcactacaacctcctgcctcccggattcaagtgattctcctgcctcagcctcctgagtagctgggattacaggcacctgccaccacgcctggctaattttagtatttttagtagagatggggttttaccatgttggccaggctgctcttgaactcctgacctcaagtgatctgcctggctcggcctcccaaagttctgggattacaggtgtgagccactgcacccggccttgaatgtatatttctaagtaaaggaagccaatcagaaagggccatgtatagtatgattccaactatatgacattcttaaaaaggcaaaactatggagacagtaaaaagatcagtggttgccaggggttgggcagggagggatgaataggcagagcacagaggattttcagagcagactgatacctgctcatcatcaactgaggtgtcccttcttccaggaagccttccttgaccaccaagcctaggtagtctggcttagagatccttagtttggattccttgtgctgactgcatcacagccctttgtatccaatatttatttggctggcatactgtcttccctcctccactagactgccaacttcatgagggtagggacccccattcactttcatatccccagagcatagctgcttctggtgtattattaggtaatcattacacagttgttgaataaatgagtgaatgaatgcagaataaatgagccatctgtggtgagtaaatcacaatttttttttaaatcactgtggatcctagtggcctttaagaaaataacagaatcgagtggccttgggtctatccctccttcctaatagtgacaataacttttatatagtatctgatgacttctttgtcttgaagccatcagccctaggaatcaggctattaataaaaatatttttatttactatatgctttactgtgtgccaagccttttgctaagtgcttatttacaaaacctgttttaatgctcaatcttgtgaattaggaagtatgattaggcctattatccagagaaacaaattgtggctcagagagctcaagtaactagtccagagtcacacagctagtaagtggcagagctgggttttgaacctcattgctctgactcatgccctttaattgtctgaagagtctaatgatcaatcccttttggaattggaaccgaagctgattgaagcaggttatgtttataagcaggactccagtgcagtaaatctctgatgaatattctctgatgaatatactcatgttctgttaataaacatcttggccatctgccctgggccttgtgatgtttgcatcttttccttaaactctcaaggagagacttgtgtttgtgcccttttgatccctttcttcctctctgagctggcactgagaggtcacacccactgccctctttctgtccctggcagcactgatccctagcaggggaaggatgcagctcagctgtcactccctgcgctggctttgcctcctctccctccctcaccccctgcccagcaatggcagcatcccaccagtggtgattcggccactgtagctgtagaatgatcacacaggctcagagcagtaggtacacggcagggcagagcatcagcaagatgccacagaaagtcccactggtgatgcagtgcctgagtcaccaccacctggggccaggcgaaggggccagatgatagatacttggaatgaggcatgcagacaatgtctcatctactggttagcaatttagaatgggttctccctgagtttcttccaaaagcagtaccccctcattttttggtaaaatttctataaaacaaccaggttttcctttcatgtacctttttcttttaacctccatgagctcataataattgtaatattagttttgttaaaaagtatgaagaataatgggagaagaatcatctaaaagtataccatgcagaaataaattctaggctctttataggtaacaagataatagcgatagttttggctgggtgcagtggcccacacctgtaatcccagcacttcgggaggctgaagtgggaggatggcatgagcccagcaggtgaaggttgcagtgagctgagattgcaccactgcactccagcctgagagacagagcaagaacctgactttaaaaaaaaaaaaaaaaaaaaaaaagtggtatttttaacattcactttttcctttatctaaaaatttaatttcagataacaaatgttataccataattcaaattatgggtgttctttgctcagaagaaacattttgtcaccctcctctgcctctgattacatctcatcccctctctcatattgctcaaaacagtcattgttcctatgccagtaagccatattcattataaaaagtttggaaagcatagtagggcagaaagcatttttatgaccctagcatcaagcgaaccactcttttagtggctgttgagaagaaggctgatatttaaggtactgagtctacgactgcttcatctccatccttaatttctccatttactttgtgtgtgtgtgtgtgtgtgtgtgtgtgtgtgtgtgttttgaatgtgctgccttaatagaaaagtggctctgtgttgtcattggcttacaggaattagtgtgctcacccactgcgggtcaaggacagcgtatgacaaaggaccgtggtcatgtggcggactgttcttttcaaagaggcagtagttccaagactcatgctccctgggtcactaagttcttcatgtgttacatcaatactttggagagaggccacccagaatctcttaaaaagtattctaaataacacagagatatttttccacaggaaaaagctcagtagctcgaatgttagttttctgccccacattgcccaatgttgtgactattgcactggtttttccagggttcacctttaggtttaatttcctgaaattgatctgcttggttacactggctttattttatactcttttgcaaagaggagaaatggcagtgagcagatggcattttattaagtttttgcttcaaaaaaattaaacagcaatgtagcatccctgctagttttcttacaggcacctaatagtcatcctctgggtctgtgtcagaactgatatttaccatagatgaatcaccaaagtgccactgagccagcattcccagtggggattccaaatttgccacacttgtggggctgtctagttttgtttgtttgtttttgagatggcgtctcgctctcttgcccaggctggagtgcagtggcagcgatctcggctcactgcaacctccgcctccctggttcaagtgattctcctgcctcagcctcctgagcagctgggactacaggcacctgccaccacgcccggctaatttttggatttttagtagagatgggggatttcaccatgttagccaggctggtctcgaactcctgacctcaagtgatccacctgccttggcctcccaaagtgctgggattacaggcgtgagccactgcgcctggtcagggctgtcgagttttatagtagttcctccatccttctaaattctaaccctgctggagcccctctgagaattggaggagccagctggatgggagagaggcagtccccacaccaactccacaagcaggtgcacccccagcaggcccaaaggattccaagaggaagtgaatccagcccggtgttcggagtgaggtttactttgcaccactcttttttaggaaaattggggttgctggccctgagcacatcaccctttgccagccttttatctccccctgggttctgtggccgccagcttcttaagcagttgttaagtgtgtgttattattttactgtttaacagtgagctcctgggccccgggcctgacttcaccagaagaccaccttttgccagtgctgttctgataacttagccagaatgaagtgttaagtggaggataattgttatttgcttttaatttcctgaccttagaaaaagaaggaaagcacagtgctgatggggtggtgagtgctgaaggaagagtgctgtctctgagtttgcatggggagagcctcgtgttctcctccttcagactgagccagtgtggactccagtatcagacacactgggtctgaatcccacctctgccattttctagctgtggacctcagtcaaatgactcagcccatctaaacttcagtgtccctcgctggcaaatggggttagtaatagtactccactgcgagggtctttctagggtttcaaatgctcgttcatccaatccctggcagaaaggacctactcaatgcatggtagtccatgtccatttattattagccatggttaaaacctgcttctctggccaggtgcagtggctcatgcctgtaatcccagcactttgggaggtcaaggcaggtggatcacttgaggtcaggagttcgaggctagcctggccaacatggcgaaaccccgtctctactaaaaatacaaaaattagccgagcatggtggtgggtgcctgtactcccagctactccggaggctgaggcaggagaattgcttgaacctgggaggaggaggttgcagtgagctgagattgcgccactgcactccagcctgaatgacagagtaaggccctgtctcaataaataaataaaacctgcttctcaaacttccccttatctctcctgtctcccagcattttctccccatttgaatttttgggcctcacagtatcatggtcacgtcttgagatgggttttgcccaagtattagatgactttttgattatccttttttttttttttttttttttgagacagggtctcactctgtcacccaggctgtgtcgcccaggctggagtgcagtggtgcaatctcggctcactgcaacctctgcctcccagtttcaagcaattctcctgcctcagcctcctgagtagctgggattacaggtgtgcaccaccatgcctgactaatttttgtagtaatttttgtattttcaccatgttggacaggctggtctcgaatgcctgatctcaagtgatcctcctgccttggcctcccaaagtgctgggattacaggtgtgagccaccacgcctggcttgattattcctgatgaatcactttacatggatgattgacagctcctggggcatattccattccacttcaggtttttcctcttatttccctcatcttgctcttgtctcaacacccatccccccagcctctctgaacttagaatgtcatgtggaatactattcagtgaagggtttgggggcttttttaaagaattgactgtcctggctgggcatggtggctcacacctataatcccagcaaatttgggaagctgaggcgggcagattgcttgagcccaggagttctagacccgcctggaaaagatgacaaaaactccatctctccaaaaaatacaaaaattagctggacacggcagtgtgcccctgtaccccagctactcaggaggcagagatgggaggattgcttgagccccgaaggttgaagctgtagtgagctgtaatcccattactgcactccagcttgggtgacagaataaaacctcgtctcaaaacaaacaaaaagaatgaattgactgtccttacactctatttgggtctccctgaaaactattcatgcttcaacttttctacactttgttctggcatgactaatatataacaactgggcattaaatgtactatatataaaattccagatcagagaatggaaacacttaaaaataaaaaaattttaaaaaggggttggcttatctgggctatttggaaaccgttcagtggggcagtataatttttattttcagaagcttatggattgcaccccacccaagcttcccgcgcacctaagaaggctggcagaagacgccctgccaagtttccttgcgagtgcagtaaaggagtaatcctctgccctctggttttcctttcaaagaaactagggacaggcggtggccttggctgccttggccatgagcttccctgagccgggtagctggtgggctagtggggccgttggtggcaggtgcagaaatggtaccacactcactgtcccattgcccagaaagaacatttacaagtctggggagagcgctcgtaatggttgctgagtttggaggacagttatgttacagtcttggtggctttttgatgaatggtcagataaagcttcactataaacctatccagttttacacagaaaggacatcttttttacatttaaagttgtgtgtgtgtatatgggggaaagtggtggtgttatagctctggaggaaattaaaccataggaaatagtaaaaacaaggtctctgtgttcccactgttgacaattcacaagttaaatggtggaatgagaagggataaaaaggatttcaggggtgcacctgagtgctgtcgcacacataggggtcagagtctagaatcccagtgctgggaggacttgagaagccatagattccacccccgtggtttacagagaagggaatgaaatccccatcaatttggcctttggcctaagccctgcttctaaaaaccctttagaagtctggcttgtcatcccaaagtgcagtccaccagcttccgtcagcttggaagagacagcgcctctgcaagctaaaactcagctcacgtcccggttggcaactggcaagaaggcggcttcccagtcttctgagaactgggtttcccttctaactcagtggcaccctctctgggccctggtggagaatcacttaggaaagaagcaggctgctgtcctccagagttccacccatacccctaccattgaccctactcctaccactacccctcacccccatccctcacccccacccccaccccaacccctcaccccatcctcacccccacctctactctccacccccacccctacccccacccctaccctccacccccaccctacccccacccctacccccacccccacccctgaccccccaacctctcacctccacccctacccctcacccccacccctacccctcacccctacccctcaccctcacccccaaccctttccctcacccccacccctacccctcacccccacccctacccctccccctcacccccatcctcacccccacgcctaccctccacccctaccatcacccctctgggctagagcagagcagagtgaaaagtagcttagagaagcgaggatcaggtgtgcacagggttcctaactctgctgatatcttgggaggtgctgggaaattttccagtttactggcagaattactctcctccctaaatttcaaaaagcagagaaggacgttatctattctcttttctgggggaaaaaaaaagtttttttttggagacagaggctcactctgttgcccaggctggagtgcagtggcacgttctcatcactgcaacctccaccaggttcaagtaattctccctcacctcagcctcctgagtagctgggattacaggtgtgcaccaccatgcccggctaatttttgtatttttagtagagatagtgtttcaccacggtggccaggcaggtctcaaactcctggcctcaagtgattcacccgtctctgcctcccaaagtgctggaattacaggcctgagccaccacggccagccaggatgctaactattcttaaaggatagttagatgtgcaaaggagtttggacttctttgtgaggctaacagagagtcattgaagagtacaaagctggagcaaggtgaccagagtaaggggaagggggtaagcctggaggcaggggatgggtgaggaggctgctgcaggtccaggggggcaggggaagatggcagcctgactggggtggtggcagtgaaggatttttgagatatgttggtggtaaaagcagcaaggcttggtggttgatgggaggtggatgagaagggagagaactgataagggtgactcacaggtctctccttgggcaaccgggtggccacggtgctgtactcacagaggggctggtggaagaggaggtggaggctttgaggaacaaggtaatgagtctgagattcaagggttgggcaagcagaaagagaaaagttgagcaatggaagattagggttctgtgtagagattgagaaatgttgaggcttcagcacagtccacagcacattcgagtacaacactgagcagaaatgctgctgttttagaagagggaggcaaaggatcactcgatcatgctcactgctccacactccgagattcactcacagtcatgggtacagggtggtgcatgcggttccctccgtggcttttacatggtcccaaagcggttgtccctcttccctctaataaaggaataaaggcaaatgttcccgcatgctttcttctccatcatgacagaaaggaagaatttttttctaaggattttactaaatagaaaaaaatagatatgtcctttccttttttcttttttaaactccttttcactagaatgatcttgccctgggcccgttatgctagagctgggaatttgtgtggggaaaggaacacatcgaggtgttaagagaatgtaaagaaaatattttccatctctggtgagaactgctgaggaatgagctgatgtgggagagagaatttagaattgatgtagagaagactttcttacagagcagacttggaagacaagctgtggaactgtgttctgcaaagatcagagggagtcagagagacagctttttgtctgtagagtttcatgggaggcctccaggaacccttggcaggaggtgcctggagacccatgaaagggaaagtcctacttctgggccttactttgaatttcctcctcttaaacctcaggcccagacaaaacctctttcctctccaatatcctaggcgctgcctagctcgagaaaggacaaggtgggcaaagttagaatgtcatttatttcagcagcttgagaagaaattgaaactccagtccctgttccgtttctgaccctcagtgaccttaggcaagccactaaacttttcaggcctcagttttctcagctgtaagatgggtgggaatagtacctcctgcagttctggggtgttagataacgcatgtaagtgcctggcacatagtaagccttcaataaaagtcagctgtggttgttactgatcatgactgtcctgtctcccttgctggaagaacaaattactagatgtaaaaagtcatttaaaagcaaaaggtactaggcaaaagttgtgatgctatcaattactattattaataataggttcctaattacttttgccacggtattaagtgaaggcctctttgggtgggtgatgactgagaaaatgggaactattattaatggagctgacagctcctgttactagctccattgacataatatttctctctgggaatcctttgacaaatcagctgaatttcctattcccttaccctaagctctgtaaatttgatccacatgtctccagtgttgtttctgtagattaataatggagaaaggaggaggagtcaggcctgcactgggctctcccagctgtttggcctgtcgtgggtttcagcctgtagttggggtggttttcccttttgttttacttgttttaaagcttacggccagctcttcccaatgtgtttggttactcagctgtcagggagagtttctgctttagggactggggccctggcagggggctgcgggggagagcccaatcatgaactcttcctcctcctccaacagaaacaaagcttgaaggaagtgctttgaagcagtgctttgctaagtcagcactggatgtgatgagaggggtcgctgccatccaggagaggcaaagggagatggagagggggccttcaccacatcagccaggaggagagcggggaggcctgggtcaggggaaggtcaagctaggagggcaggactgaccatcagctgaacctgcagaacggtcagagaacacactgaggccctgggctggaggaagacctctgtgtgcatttcctcaacaaagaaaaacacatggggttcagcacagggtgtccatgagtgaaatgggcagtaataatacagccatattgtcatatgcaccagccacacataaggacagccatgagtgagctttggtgatgtgttcactggactctgagctcacagaggagttaagtatatgcattgtggaaccagtccatcccagatttgaatcctagctcttccacttacctgagcaagttactcaaagtctctgaatggcagtagcccagtatctcaaatggaagtcagtagtacccatcacacagggtttttttgttttgttttgttttgttttttgagacacagtctctgttgccaggctggagtacagtggcgtgatctcagctcactgcaaactctgcctcccgggttcaagcgatgctcctgcctcagcctcccgagtagctgggattacaggttaattttgtattaaaatgaaaaaactagccaccacacctggctaatttttgtatttttaatagagatggggtttctccgtgttggccaggctggtctcaaacccctgacctcaagtgatttacccacctcagcctcccaaagtgctgggattacatgtgtgatccactgtgcctggcccttatagggttgttggaagaataaatgagataacgtaaatgaagcctatgttcccagcacaaagtaaaaataatagcaacagcacttggtagagcatgtactctgagccaggcattggtccaagcattgacccccagttactcagttaatcctcacagcagccctgtgagctaggtactctagttatctctagttaacagatgatgaactgatgtagagtctaagtaacctgaccaagatcacaccactggttacgtgacagccagaattacgaaccccaacattctgctccaaagccctgtctgctgtacctgttgctgctgttgtccttgttacatcacacgtgtttagggacttctaacccagacttggccacatcccggtgctctccagttatctctaggaattttcagagattttctccaaagtgattaaattcctgtgggtatttttctttaaaaaagaaaaaaaaaaagtttgtgggtgagtgttggaaaaagaaaatctgtccatcaaagaaacagtggttaccaaaagttgggaatccctatctagattctgactgcaactagaatctctgtggccacatgctcttaagagccaacatgtaattttaaaccagtctgatttcacttttctggtgctttctaagaagccacatagtgagttggagaaatttacaggctgtcaccctctgggattgattctgacagttctgctccactgctgttgaagtgttaatgaaaaacattaattggacttggcccgtggctaggacacgtccccttcttgaagtggagaaggcagcatcccttttgaatggttgctcccagcatggggaaaggagaggactcagggcggcactgcccttcaggaagtcaggatgggcatttacatctgactcagccatccctgagctgcatgaaaacaaagtcaggtctctttgtcaccccagaaccctaagtatagcacaatacctgggctgagtcaggcactctgtaaatattcaacgagcgagtgaatgaatgcttgtatgatccaggagcctgggctgagtcaggcactctgtaaatattcagcaagtgagtgaatgaatgcttctatgatccaggagcccaagaaggccagtttcttgagtacctccaagaaacgatggtctccacgtgcttaaaaccacagctacgagtgagctacttctcattctggcccctatagcaccgtccacagtcaaagttctcaagtcctcaaggctcagagagattttacctcctgaacctctctctgtcaagagcaggggagcagggctgagccctgcctgcagcaggctggggcccactgaacttccactccttcctaagtgtgacctgtctgccttctttccccataggtgtcctctccctccccgcatacttcagcccctacaacggcgggtccctgggccatgacgagcgagccgatgcctatgcccagctggagctccgaaccctggagcagtccctcctggccacctgcgtgggcagcatctcggagctgagtaagtgtggcctcagtgtctagctggatggtagagcaacggcgaggtctcagggctgggggaaggcagggagagctcgcctcctcctcctccaagtgctctggcctcctcctcctccaagtgccttgccttccctgaaagctagatctttctagaccagaggttgcaaatacacaaatctggatttctggtttctcttgaaaaaacaaatgatctagcaacatggtaccccattcctgcacagcagtgacccacgggagctaagtagcagcaaagtgggtggcatgtgttccccactttgccacagacctgggtttcatcctggggaggctgtttcattaatttcacctgcctggccccacaggctctgaattcacaactggtgctctttctcgaaagaaagcacacccaaagcctcaatatagtaaaaggaagataacaatagagcccctctggctgaaggcaggtgtggccaggtggcatctcccaggactcagggctctgtggcacacacttggaacttgatgtggctctttaccattgacagctgcttccagggtgttaggagagatgaaatcccatgccagctcctgagctccccctctcattacccatttgatttgagaaatctgactacatcctctgctgccttcattccccctcgctctgttgagatcacccagtggagggcagtgacacagcaggggtcatagcacacagcatgggcacacctggagtttccctctgctccggccttctccgtttgtgattccctcaagtcttctgacccctgaacaataaacggcaagcctctgtttcttcaggtcatggcttcctccttccctgcattcttctgccccctctacagacaggaaatgaaggtgcctggttcaaggtcacagagcagagctgcaatagggctgggagagaaagcaggatttctgactccctgtctcctggtgacattacagtaggcagggccaggatgttgttgcctgggtcccctgtcccctgaggggccccacaggaagtgggttctggtttcatctccgtccctgagaagtgtctcctggacaatgggctgtcttgggccctcgcacagtcatgctttggtgagttcttgtgccctgcagacagtaagggacacagcccctggtccactggagagcaccttggttttactttacacttgaacattaagtgagcgccttctgtgtgcaagacaccattgtgaagcaccatattcactttttatctcatttgttcctcagaacaatgcagcaagttatgtcctgatgagagaactgaggcttagagaagaaaagtgattttctccaagtcacacggatcagagctgggggcttgactctggacgtgtctagggctgttggccccctggataagactagcagcccagccaccagctccttggggcagctgagatcaagatcggggctgatcctttgcctcttctcatggtggcctcatgcccattacaaccccagcccagcctaagggaggagcatttagaggcctcccctaggtaagggcttgacatcattctgccattaccgctagccaaggggccaagacctgttggctctaccacttacaacaatcctgagttttagtctgcccctttcaccaactccactgctaccaactgagcccaagctgaccatttgttttgttttgttttgtttttgagatggagtctcgctctgtcacccaggctggagtgtggtggtacaaacttggctcactgcaacctccgcctccagattcaagagattctcctgcctttacctccctagtagctgggactataggtgtgcactaccacacctagctaatttttgtatttttagtagagacggggtttcaccatgttggccaggctggtctcgaactcctcacctcaagtgattccccactttggcctcccgaagtgctaggattataggcatgagccactgcacctagccccaagctgcccatttaaagcttaaattgggttgtgtcactcatctgctcgatatctatcccctctatcccccgacaatggcttcccggctcactcggtaaaatccaaaatcctcactctggcccaggatccatatatgatctgacttcatcacttcatcctcttctctgtggactgcactccagctgcctggcctcctggctaaggaccctcccactccagagccttcacactggctttccctctgcctgcaacactttccccttgatcctcaagtacattggtccttcacattttcaagcctctgcccaaatggcaccttctcattcaggccttccatgagtaccacactctcattccactgtcttccctcttgtggctttgattttattaaagcactgatcaccacttgacatgtattatatatttacttacgaatagtttatcatctctctcctctgactagaagagtcagcttcctgagattggaaactttatctcctttgtccacggctgtatcctcattgcttagaacagtacctggtacagagaacagtacctgaggtgcagcgtgcacacgtgtgtgtgtgtgtctgcacacatgcatgcctgtgagtatgcatgttcatgtgttaggaggaatgaggtctatcccaccaaatcttttctcctaaaactcgcctaggatttgtccacatcctggcccagccactcctcagggccaaaggaagaagcctccttacagcatcttttcacagaccagagaacaggctgtgtcatgtgccaagttgccctgttcctccctttgaaaccagggcttttgctaacctgctgtggaggagggaggagacagaggtggaggcagatattgcagtttttctccctgagactaaagaacttaatgaggctagtgatacttggcactgaaccccttggacctcagagtgtaccctgagtttacatgcattaactccctgagcctctccaacatcaggctgccagatagggtgagaagtttcactcttgtatgagatccagcttcacacggagttttgggacttgtgctttttctttgtccctctctacccgcaaaaattttaaagggagagaatacaaaataaaacaaaacacttctttttgaagggagccagatgttctaggccttattttgaagacggtgttgaattccagactctctcctgctgtttttatttgatggctcataatgagaggtggaaggaccagagtgaaacctagcacctctaatcaagtctttcatggttaacaaggggggaggacttgtttttccttgcctggggggtgtttctgggcttcagactaaggtttcattgagtgtaggatcaattgaagtttcagaagaagctctgagtccctgccatgcttaaactgagagcccagcctagcctgcatcaggccttctcaaactatccatggtgaaggtccagagattttattcccctcagtctgctgcagaatgaaacctttataatgaaaaatcaaaataaatgtctagaaaaaggaaataagacatgtgaaatgcaagcccgatttttaaaattattattagctagatataaaattactgtcaattgctatgtaagtttttaaaaattcactcttcacttctgaaattaacttactgcaaaccagtaagtttgtggacctgtcccggttcacagaccacacttttagtagcagccatgtgatggtcaagagcatgcgtttgggaagcagggaccccagttcaagtcctggctgattgacttactagttgcagaactgggacgggtcatttaactcttgcaagcttgcttccttgtctgtagagtagaaagacctccttcacagggtggctgaaaaagttaaaggaaattttgtctatcttttcatgtctgtcatgaagcctagaaaatacaaagtggcagggagcaaaaatcaccctaggagaaggttccaagcaagccgctttctttgccataagtgggttgccacgcagtgtaagtttttagacgtcacagtcagagttctctgcagccatttgtctttctggtctgagagaaactgaccatagcagggcttggatcgaagaagccggggacctccatctccagctgccttcgtggtttttctgaacttttgggttatctgcttctgtttggatgggagattccatttctttcttgattttcttgtctacatgaagcaggaagtgtgctgccaaagggttctccaccaataacaataaaacaacaataaaaataattaaagataatgacttctaccttgttgagcctttgaaatgttatttcaacaaggtttctctttgatgctatcacagactctttgatttctcctccttgtggtcctgtggttctgccaaaagttatgacatttagacctggagaaacgggagccaggtttcaacttattagcagccaacttagctgtacaactggctgctgtgaggcgggttggctggtggttgtgaggccagtttctaccacccatggagcccaagggcagggttgggatctggcatttcagggtgcagactcctcctgtcctgggaaatgtggggcagagtttgacggcaggcagtagtcctggaaggaagagtccacaggaggcggcccgtaggatagaggaataataataataggacattaattataacagtgctatgttcagccctaccaaatacttactctgtgccaagcaggatgttaagtgctttacatttattgtttctttgagccctcaaaatcagtagggtagatactattgttcccattttacagatgagaaaactgaggctctgataactacgtaagggatttctctttctctgtaaggaatcgccaggggtggggcttaagctgacctccgggggagcctccctgagttctcaggcctaagggaatatgggctggaattaacagtaacaggccctgatttgaggccaactgtgtctgacttgaatcaatctatcagttcacctggtgattttcaaacctgagtggacattagaatcactgagggaacttctacaaactagagatgcccaggtccagccacagaccaatgaaatcagggtcacagggatggaaaccaggtgtcagtaactcactgccctcagccctcttggccctagggtttgtcaggagcacccaggcagctgaactccaacggtatggatgagtagtcaggagtagggaggagtgaggaaccaggggtggtggtggaaagggacaaggaggactttcctggtggggatctcaaactccaggggtgtcatttgtccctgcctggaagccaaacaccatcaccgtggctgtcatgggagaatttagcagctaatgagctcaaatcaagcctcagcagaagttgtattttaaaaagaaatgaatgtgtaaggtgaattcttcattctccaaatatctgctgagaacctagtatgtaacagaccctgtgcagggctctgggacacaacggaacagaacaccagattcccagaagcagcatgaaggttaattgagtaaatgaatgaactggttctgccatgcatttcatggcacttcaccggccaaattaaaacctgttcatttcttccaccttaaggttagccgtgcccgcctgttgaagggctctctctaaggaatggccaggggtgaggctgaagctgaccccgaaggagctgcttttcttagagcggaggtgcctgcaggtgccagggctccttcagcccatcctttctcagcattgtggcctcacacaatgatgagccgtttcctgtctggggctggtgagatattgaaaatacttaagtagaaacacatcacaggatatggggacctaaggatcccacagactccagcagggcaggctgcagcccagctcacagtgaagtccatggactttggagtcgaacagacatgaattcaagtctagactaccattttctagccacacagccatggctggttaactcaacctgtgggctctgaggtgtccctgtggccaggagaatgaatatatggggtcaggaaatgtttatcagataagcctcaagtttttgtttttttttgttgttgttgtttgtttgtttttttgagacaaagtctcactgtcaccagtcacccagactggagtgtggtggcacgatctctgctcactgccacctccgcctcccaggttaaagcgattctcctgcctcagcgtcccgagtagctgggactacaggcgcctgccactatccctgactattttttgtattttaagtagagacagggtttcaccatgttggccaggctggtctcaaactcctggcctaaagtgatccacctgcctcggcctccccaagggcttgggattacagcgtgagccactgtgcccagccataagcctcaagttcttcatctgtaaaatgggaataataccccctagcactgtaaggatcaaattaaatcatatttctggggaattgcatactttgtacatagtgagtcctcaacaggtgatgatggtggtgttggtggttgtaattggtgctgagacagagggaccttctccgctgaaatactttgggttttgtacaagacagtgcaggggagaattgccacagagcctggccctggctggtagaggctgggaagagagacccagagagattcccttggtcaaagatctggggagaggcccatgagggtggtggagagagtggggatgtcaaaaaagaaaccaaattaccctaagttctggaggagacaggccctgccaagtatttaattcagcaagagtgaaatgaaagggaaacgaaattgctattgtgcatctaggtgacagtttccacctccgcctgttggctgcagggcaaacagtaattatgcactaaggcaagggagcttcagccaggaacatccttggaagaatgcaggctgtgaactcagactttgtcttctttttttctcttcctcccctctgccctccccgccccccaccaggtgacttggtctcccgtgccatgcaccacatgcaggggcgtcaccccctgtgcccgggtgccagccctgcccgccaggcccgccagccgccacagcccatcacttggtcccccgacgccctccacacgctctactactttctgcggtgtccacagatggagtccatggagaaccccaacctggaccccccgagaatgaccttgaacaatgaacggtagggatcttccttgggctgagcacctggtgggacgtgctcccaaacgtgcattgaccgactgactgacactgactgacgactgaccaacagggcgaggaaggggccctggaactgtgctatgcctgtgaggaggtggcccaggaattccgatggatgaaggcctgcactggtgtgcagtgggatttttttttcctctgagctgatgcagcatggggccactgaggctcagaacgtgtgcttctgcctctgtgcccagtctggcatgagctcactgggctctctgaaattcagctgccttgttataaaatgagatagtcacacccacctagaaaggttagtgctctgagtaaaagcatgtaggatgggggctaggtgggaactggcccttggccagtggtagctgtcacctcttttcatgggtttatcccattcaaaagtgatcaaatgatcattgctgccgtcattgttatgaggggtcctgggtgtgttttgccccatccattcatttaacacaggagactatcctggccctggcagctctctgatctccagcaggttagtggttgaatagcccctggacccaagcctgtgggcttctagtcaggtactttcactagagggtcccaacactttcctagctgggagcaaggctgcaaagaacagatgtgcaggttgtatactgcacaacagaacccaatgaggggcatgagtaggggatgcacgtggggccatgtcagcctgaggacaggataccttttcttttttttttagacggagtcttgctctattgcccaggctggagtgcaatggcacaatcttggctcactgcaagctccacctccaaggttcacgccattctcctgcctcagcctcccgagtagctgggactacaggtgcccgccaccacgcctggctaatttttttgtatttttagtagagacggggttgcactgtgttagcaaggatggtctcgatctcctgatctcgtgatccacgcgccttggcctcccaaagtgctgggattacaggcgtgagccaccgcgcccggtcttaggataccttttctaatgggttttctctgagggctgccttttgaaattttctacctggaaaatataatattttttttataactcgtaccaaacattgtatatgctggcatgagcctcacatggaggccactgcttggccacttaaggtaaggtctgtccatgggctcaagagttgtgggtttgagggtccaggaagtgggaaaggcttgcactcagtttaggaagccccatccacacacatttcaccactcagtgaagcccaggaaaggcagagcccacgggcctcagtgccccacctggagggagacgatctgagacctcaatattggaagtcccaggggctctgcagtccccttgcctggctgtccgctgtctttggggggcattgagtctcatcagctctgtgatccacagctggctccacagccaggtctgcttcctcagtgccccagaaaacaaaggcactaaggtggatttactgagtgtttactatgtgctaggcactgtgctgagcagtttgcaggcggatgctcagttaattcacacactaccaagaaagaggtgttcttcagagccccatttacagatgagtaagtggaggcttggagagactaactggccccacgacacaggctcataaccactacactgtacctcctgtcactaagaggaatataaaacagcagtggcccagtacacgcatagtagggtcccagtaaatggtaccattgctgttatcagtactagtatccttatgtcatcattgttttacttctctgggagttggagggcaaatgcaagtctgaggagggccaccctgggcctgacacagcaagaaggctgcaggtggagccctgggcatcctgaaagacacctttggcgggagctggggccaaagcataggccctaagccccagctgttcctgctttgtggaaaagtgttgtggttgaaggagtcagctgggaaggaaaaagagcagggaagatatctgggaggaagaggcaggaggcttgcttgctgtttggtaaggtgctgggctgaggccgggtcattcacacaaaggtgactgggaggacaggcgccttcttcaggcctgttgccctggctgctgggccctcaggctgtcatggctataggcccaggggcagtcattcctctgctggcactttctcccgcccccactccccccccccgccgggcatctttgtcatgtcctgtggctttcccccaggagggttcccagccccctgtactctaatacacagcatcagggtttcttcatgatctgagttgcacagccctatgtggttataatagctgagcttgcatggtagtagacacacgtgcatgtgtttacgtagccatttatttaaaaaccgcactatctgtagcacaaataatttggtagcaaagatatttttccatgaatcatttcaaatgaatatcagacacatggggaattggaacccccattaggaaaaaaaaaaaaaaaccaaatttttaagttatgacacagaaaggaggacaaccctaaaaatacctgagggagccaacagcccgacggcgccctggtggcctggctcctgtcgctgagcagatctgctgccctctggctcactgacagggaaggccctggaggctgtggggatccttcctgggagcgctgagcttacagcattactgcaggctgggctgggccaatgtcccatcaaggccccagcaccctgataccctcaccagagctctggggaaaacctctcctgatgcaaatagtagctggagtttgctagggttccagagtggcagagctttgcttttgtgagtttggggatgtgcgacgtctgtctcttgctccacttcatcctcctgaagccccgtcctctgtcccacctggaagcatggcggactgagttcacccagccagaattggacggagcccctgatttcaatgtgaccgtggttgtctggctgtagagactgtctgtttggggattggtggctctctgggtttgtttgggattaagtgacctcctctactgccttgcacacatgggagagggagctcagtttggtgatatgggtttggcagcatgacatcattgatggaaccactcaagtctgtcctcatatttctgctttaaagaaaggtaccctgattccttcaattaggggctatgtgtgaccacatccatggcgacaaagggaagggacgtgtgttcatctcttttgtgtggagctcactgtggcattccctgctaagccacctgctgcttctgcagtgtttggtggggacttcacatctttccgtaaggggccttctccccagagctctctgctctggtttgggagaagagacagtgggaggagggaggggcagaagcagcaggaactcagagtggtgagcgggcagccttgcagggaatgagaagcctctaacctcctttcatctactcctgcagtgagcctggtgcatcaagaaacagtacaggctttggggcagaggcctgggctcagagggcccttccatgccttaggctcctcacctgtaaaatggggctaagtaattctatccggtaggacaaagtcagataacatacgcccttcttttaaagcccatttctacctacttctaggcccaaagaacttcagcaagtttggtgctatcattacctccgtttcacaagtgagtacaggaggccgcggggtacctggctgataagtggcgaggccaggattcaaacctgaggtctctctcacctcaaggcctttgcctttccctgtgccaggctgtggctttcccagctggctgctgagacctgatcctacagcactgaggcatgctgggtgggccctggcctttggggccaccttctctggggccattccagccccaccccctcactatcctgggaaagctctgcagctggagcctccctgcacccttccagggtgcctttctcactggcagctttgcatcccaggcaccagccaggcacaaggcagagtctaaaacacagaattagtcacagctgctgccctgcagggtgtgtcatcaccggagatcaagcttagaaagtgaaagagcctcttgtcagggatccaggttgcccagggagatcgggagcctccttcctctgaggtctggaggagaaaggacaaccatctggttagatgtggcccttgctggttgtgcctgggggcagagggatgggctagctggaacagaatctttggcagaggatatacctcctcagccatcacccttctggggaatgagaggtctggggcagtaaggataaagactacgcagacacgtaggaaggcaagagggccgcccgcttgccagcaaattgctggaaggcagcgtcatcaagtagaggagacagagggagacatgcagtcagaggtgcagagggcctgaggtcgacaggaggtgaccatttctccacatcagaacctgggctgctggagggtttggggtcccccaggcacccttccagactgcatctactgtgagcagcagcaaagaagccagacccttgaggagtggccaggcagagagagtgggaatggcagagggccactggtccacagagcggtccgcttgctaagcctcagatcctggcctcttgcctcgttctccccagccctgcacagcacgtctccgcctctgtggagggtggcacactcagaaggcttggagcctgctggtatccaggacatgaaaacaggaggagtgtggaacccttcccagagttctgattgggggtcgggcctagaaacctctggtgtcatgacttcgtagccagccagaatagccccatctgaggagggccctgctattcaaaggcgtgcatttgagatctaccttgccactttttataaccttcaaccagtcatttaacctcttcaaggctcttaatcatctgtaaggtatgcggacccaatgagttaacatatttggggggttttcttggaaacagggtcttgctctgtctcccaggctggagtgcagtggcacaatctcagctcactgcctctttgacatcctgggctcatgcaatcctcccacctcagcccccccagtagctgggaccacagatgtgccccaccacacctggctaacttttaaaaaatttttgtagaaatggggtcccaccatgttgcccaggttggtctcaaaatcctgggctcaagggaccctcctgccttggcctcccaaagtgctgggattatagccatgagccactgcacctgctcactacatacttttagaacagggcctaggacacactgagtatctgttcttatgattatcagcacgatggtttgtatcaggcaggggagcagcatatacagagtccaagtggctagaggcagcaaggcaccccagagagaccggcgatggggaggagcagagcaagggaacacgggcactgttgtgcaggatggagcacagaagtgggcggaccttgttggccaagacacacagggctgagcttgtggctgagaaggtcctgcccccattggtgcagctatttgtgattggctgggttttatttgtccttcttcccacacttcccttcttggggcctgaacccttctaagaataagggcagcagagggtccaggaagcccctcccatgctgcttgtcttgatgctcctataaaggtctgccctggagaagtctgatatgtagttctgcacccccagacaggttcaggagagacgagaccagggtgctgatgttatactaatcttgttctccaactcacatagagctctttttgctagggctagcaggacctgctcagaggttgaagctcttgtccaggtgagatcctggtagacgataaatgtgtgtctggcccagctcttggcttccctgttccgtatcaggctagacagaatttcaaagagctggagccagcgaacgtgtcagtgctctgggttccagccactttgttggaaacgcacacctggggctttttttctctttaagagactggctcactctgtcacccaggctggaatgcagtggtgcaatcatggttcactgcagccttgaactcctgggtgcaagtgatcctcccacctcagcctcccaagtagctgggactataggtgcatgccaccatttcacctggggcttctgatggtgaccaaggggaggagggtgccataagcctcttgggtcatcccagaggtgttatctcatctaccttctaggagtatgaccatgtcaactcatcttcctgggcctcagtttcctcatcagtaaaatggtgaagatagtagtatggcttctacggttaaatgagataatacagtaaagcacttagctaaatgctaggcacataaaaagtgctcattaaatggtgtctcctcctcattataatggccataaacaacatttagatggcatgtttgacactcagagcaggctctctttattgaggtagcatgacatttcctaaaatgtgattctcaagtgatatctgggtcagtaatactactactactacagttattaatactactactgatgatattactactaattaaccactaccactatgactaataataatacaattactaagattactgctactaccagcattaccactactgctagttatagcgagcgttatagagcacacattcacagacagatactgtcttaagtgcttgacttactcctgtttctccctggactcctgcggatccatggagaagggctctaggagaatgataaagagtggcttatgagtctccagcctaatgagggagacaaaagcaagacggaagtaaacaaatgagcaaaacccaccagacagtgcaggaggaagctcaggtgcatgatggtgcatgaggtcagccctcaggctctgaagtctgcctggattccaatcccagccctgccactcacgagctgggtggcctcaggcatgtcatttaccctctgcatctcagtctctttttttttttttttgggggggcagcggggcaggggtggggcaggggctggatggagtcacactctgttacccaggctggagtgcagtggcacgatcttgactcactgcagcctccaccttccagatgcaagtgattctcctgcctcagcctcccgagtagctgggattataggcacatgccaccatgcctggctaatttttgtatttttagtagagacagggttttgccatgttggccaggctggtctcaaactcctgtcctcaagtgatccaccttcctaggcctcccaaagtgctgagattacaggcatgagccacttgcggccagcccagtctcttcttaataggtgattaatagtgtcaacttcataggggtgttgtggggatcaagtgagttaatatacataaggcacttagcatagtgcctggtacacagtaagaagcagcagcagcagcatcacatttaagaggattctgagaaggctggagtaggtgggggacatgtcggagcagacctgggatttttaactgggccttaaaggacagccacagaagattgggagaggtgaatggcatgggcagcaagagtcatagaaggacttttgttgtttcagagcatgaattttataacagaaatggacctacactttaaaaacataaaaattagttgagtggttgttgttgttgagacagggtctcactctgtcacccagggtgggatgcagtggcgtgatcacggctcactgcaacgtcgacctcctgggctcaggcaatcctcccacctccacctcctgagtagctgggactgttggcccactctgccatgcctggctaatttttttattttttgtagaaatggggtttcgccgtgtcacccagactggtcttgaattcctggagtcaagggatctgcccagtcagcctgccaaagtgctggtgttacaggcgtgagccacagtgcccagcattttttattatatatatatttcttttcttttctcttttcttttcttttggctagtcaagtgaaacagtgggagtggcgaaggaacaaggaaatctgtaactggttgtgatcgattaattgtagaaaccactgcactcagaccagcagttggttttttaagtcatcgctgattgttgtttatctaggcaaatacttcaaggtcaagctgtaggtcagtggtttcccagtggaaaaagaagtgcatcctctgagccgctgtgggatgaggatcaaatcccagctcttttcttctggctctatgatccaagcaaatcatcttacctctcagagtctccgtttcctcctgcataaggtagagatctgaactgtgcctgcttcctaaggtggggaaatgccctgatacgagtgaggtaccacatcaaggcacctctttgttccattccagatgcagcagggagaatgtttccctcagacagcactttacataaagaggacatgcccacagataggctgtgtgttcagtctgaagaagtgggctcgttaatcttttgctcagcttgcgaaagtgttttcttatcaaataatagagatgatggcagtggtggctttatgctactgacttctgagttccttaaataccatttcaagaagatttgcaatgttaagctcttttctctcctttcctctccccctttttgtgcattaaatttccatctgtttacccaaaatggaagtaaatgaaataagaatagctattgggtgaattaagtacttgtttccgtgtattccccaggctggcacatccactagcctctgaagggacttgttcacagtctacggtgcacacagggagcttcctttccactgccaggaacctccctcactgtacgctctttttgtttccttcagagcaccttcctctatctgaagtcaccttgctcatgtctgttccctccccacccctctggaatgtaagtgccctcggtctgccctgttcctgctgtgtcctcagcacagtcccaggcatgtgtagtaggcagttaaatattttgctaagttaatgaaataggtggtagaacctaatggttgggttctttggagttaaaaaggccatgatatggggtcccggctctgccatttcctagctgtgtgactttgggcaagttacgtgatttgccaagtctcagtttcccttgcttgaaatagaaaatgacttgaaatatttccagaattttttgtgaggggcgaataaggtagctacatgttaaggatgtggcagagaataaggtgtttgtgcatggcagctgctattatcagaataatcactgttaccataagcctgcgtgaaggccaaaaagaccacgttgtgttcaatgaacaagcaatccagaaacatttgtaacagcaaaaatcatatcttctcaacatgcatgtcttctctccttctcatccatccctccctccttccctcagtccctgctctttagtccatcttaactcagccctcagagtagctgggagccaggtgagtgagaaagatgagaggctcacacctgtaatcctagcactttgggaggttgaggtgggaggatcactttaggagttcaagacaagcctgggcaaaatagtgagaccccatctctataaaaataaaaattagctgggcatggtggtgcatgcctgtagtcctagctactcaggaggctgagtgggagaatctcttgagcccaagagttcaagactgctgtgagctatgatctcaccaactgcactcagcctgggcaacagagcaacaccccatctcaccaaaaaaaaaaaaaggcaaagaagataaggtagacgagaagaccacatcacagaaggcttgttaaacgaggcccattttggacatctacgaaatttagccttatcacaccctacccaaggatttcaaagaactctacaaactggattccatttagctatgggatcaaagacgaagccaactatcagtcactctttaaagttggtgacgtccctggccccacgcctgctggtttagccatagtgcctatgtgcaatggactgcggctgctgaaggttaaacttggaagagacctgatctatctttacgtgggctggaagcatctagacaaagttttacagtttacagagcttgtttagtacacagctctctaacaggtccttacagtagctcttggaggaaactattacattcccatttatagcgagcagactgaggccttgaggaggtccgaggcatgcccaccatcacagctggtaagagacagatctcagctcaggaatggaggtcggttgtatcaataataatgcaatgaattcacattgctcagagtggtaaatcccttcccctcccaggaggggagagggtgagaccccggagccggggatctcggtcagcacctccttttcccagagcggtgtgggcagcttgctctcagctacttggggcctctttctcagcaggcttgcattggctggctctgggaggccagcctgggggtgggcgtctgcccagcatccgagaaggagcgagccagggattcggggcaggaagtgtcagtgccacataacagggatagagacaggacaggatcctggcccggcctctgacaagcaccccccagggctggctgttgcatgggacttcctgtcccattgttggacccaccggtcctcgcagaaaagaagactgggaactgccgggcccgaggagcttcattcatttggagtgtttttgtaacacgggcagcaacaatcccctttgtctgcagtcttgccaggattctcaatgcagggaattcccaactctaaagggaattgattttgctttcttaaagaagcctgcttccgaggcgaagctggagagcattcagaccctcaggatggggggaggacaggagctgggtggtatctggagccaagccgagctggttcctggcgtgctctcacttgcctgccaggcagctcttgggatttctatcctcttgcaagaccagccgccctgacagctgtctgtgacttgcccctccccgctttgactgctttaatatttgtggatttgaggggaaagggctcttaaggtgcctggggtgcaccccctgaggcactggagcccagccttctgttcccggccgagttcagggcctgatgaggctgagagagcaaaagctggaggttgggcggagcggtgccgtgggccccaaggcaaacctttctccatcacgcctccttccagctttccacccaccagggctcagagcatttcatgcctgcagtttggtatcctgaaagacccccagggtggtttggggggttttgttgttgtttataattgacacataataactgtatatgtttatggggtacaatgtgatggttaaatacatgtatacattctataatgatcaaatcagggtccttagcatgtccattgcctcaaaccttcatcagtgctttatggtggtaactttcaagatcctcttttctagctgtcttgaaacatataatacattgttattaactatagtcatcatactgtgtaagggaataccaggacttatttttccaatctaactacaactttgtacctgttgacccacctctccccccaaccccactccagcctccagtgaccattcagaatggttgttttttagaaccagactaatcacctttgtctagctatgtcaccttggacatgtgacctaccctctacaaaggctgtttctgcatttgtaaaaatgcagactaataagtatatctccctcgcagggtgactgtttcagaggtaacatatgcaacctcacacccacctggcacagagtaggccctgagcacatctcagcaaggtggctttgctgctcagaagccaatgccagtcttccctgcagctgcccttgtgatgtggatgcacaaagcagggtcaggccctgtcctctgagcttgcactgtctcttcctctctctctgtctgggctggagtgtaccacccctccatgacccccatcccatcaacagctcaggtcaaaacactgcttgccagtcaagaatttcactctcatatcaggcttcaagagccctcacgccactgcttcttcctagaagtttctagaaactcttcagctgacaatctgaatgggtcatctttctgccttatactatgagagttggggaaggtgagtgctgtgtgattacagttagctgaatccaaacaggattacctatcccaagagcctaaacaaaagtcccccaaccctggcccacagctcagcagataggataaacctcggggtcctcccacgtctgtcttcttggcagaggccaatgggtggtggcaggtgccctcgggagggaggtatgtttgagcaggttggaggtccccgcctgtctggtttccatgtggtgaaagagctcgtggtctctggtgagccaccacaaacaccgctcatgggagaagaaagcgagtccctggcacatggctgcagtgagccccatgggtggggcgtggccagtaggcctgggagctgcttcccaatgaggtggagagatgccggctttcacacctgccacccaagggtgtgggaagcactgaggcccaggcctgctggaccagctgcctgcccttgtgctggggcagccatgctggggagttctggcctgagaaatgaggcagatgtcctggcccttgcagggctaggagctctccctgccgtgtgggaaagcgaggaggggtggaggcccatgcgcagtctccactggaatctgtaccatctcacccacacgaaatgccgccctggaaccaggcctgattcctaaggacagatggctgtgtaccctccactgaggctcagacacggtaacatctgcagaaccacagccaccttttcctattcctggtgacagctccatccctacatcctagctgccttcccagaagctgccttcccagaagccaccttggccccgggctgccgtgcttcccctaggaagttgttgcatttggaacactctcctgtgcaatagctgtctttttactggggaattatttccttttttttctgaaaagaactctttgccaatacccaagccaactcaagcttctaggaatgaaagacgaagcagctccccctttcgtgagagtgctctggagcccttaatgaacagtcctggaggccggacgcagcagctcaagcctgcgcaacatagacctgtctctacaaaaaaaaaaaaacactttttaaaaattagccaggcctggtggctgagatgggaggatcgcttaagcccagcaagcaggttgaggctgcagtgacccttgattgcaccactgcactccagcctgggcaacagaggaaaactccccgttttttgttttttgtttgtttttgtttttgtttttaaaacaaaaacaaagtcctggagtaagagcagcccctgaaaccatggtagcagctggaggactttgcctccaggagtgagaaacatgccttgtgtttataaattcaaaaatgaagtttctaacaccggcttctgtgcggagagatggggaaacgtcagtgagcaaaaatgcctctgccttcagagaagatatagtccagaggagagaccgtacaaaaccataccaaccaaatcattgcaaattggacgagtgctgtgcaggcactaaggtagggctgagtgctggagggcagagggaggcctgcttctgagggggtgagcaggaggacctcctcctgcctgcagacagcatgagcccggcagcaggccaccgtgggcagtctctctagccgagggcagtacggtgaccatatgttctggtgtgcccagcccagttctagtttacacccggtagtcccagtgctggcggtagctctctttttccctttcaaaagtcatccagctgggcacggtggctcacgcctgccatcccagcactttgggatgccaaggtaggcagttggcttgagtccaggggttcaagaccagcccgggcaacatggtgaaacctcgccttacaaagaacacaaaacttagccgagtctggtggcacacacctgtagtcccagctacttgggaggatgaggcaggagaatcacatgagcagaggaggttgaggctacagtgagatgtgattgtgccactacacctccagcctgggcgacagagcaagaccctgactcaaaggaaaaaaaaagtcatccagtttgcatgacaaattgtggttactgtgcctaatatcatcatccctaagatggaggagttgggccagcaccaggtgaagaatctgagtggctgtggaatgtcatcttcagaagcttagactcagggacactgcccaggttcatatcccagctctgctccttggcaggtgcatgacatagggcaagtgacctcacctctctggccctcagtttccccatgtataaaacggaaataataatagtacctgctacatcaggcagctctaagaagcagatgagccactagatgtccagggcactgtggcagctgcttagtaaacgctccagaaatgttagctgtttgcatttttctattactcctgaaggccctgattgtcacacggtggacctcccatctcactgctaacagaaactctcaggctcctatggggacctgaagggtgacccctggggagacacaagggaaatcacccagagctagtcatgacttggttggctctaaatttctgtccctatgtgtatctgggcaagcttcatctagtgcctctaatctgtaccagatgagttttaataggaaaagtgaatttccccccccccccagagaacccaatgccccacctcaagcagaagtcacctgggcacaagtggagattctgctgtgggctcagctgcggttcagaggcagcctggctgctggaggagatgaggctgggggtccgaagagggaaccatgcccaactctgcctccaagccatgccaaaccattctggtttacccagcagttctagaaaaataatgagtacaagatgtgagctggactagaaatgtttctttggtgcagagtgaaatctgacttagcgggacaatgttggttttttatcctacgtggatgttttggcttggtattaggccgtggtggctgtgtggaaatctcagggaagctatggtgagggcctcattgctggccctgcagagccagccctgaccttcccaaagaagtctgttcgtggagccgtcacttgcttaggaaaagcttggcatctttgcaagttcctgacggtgccacttggcacccccagcccagacaagacagggaggagcatgggagcagtgtgtttcacggcatgatccatgagaaagggtgagtccagggggatgtgaccccattcaaccccagtgcttggctctgactcccactgaaggtggggcaaagttagtggaagaatttagggctgaaggtaggaaccactggggccatcctctcccttgatcgtcatctcttgcctgtcctttcctggactcccagggtgcttgcaggtggggcaggccacagcttagcgggtgatggggagctctcttggaagcaagcctgtggcacagtgtacctcccagccctgggagccgggcctgcaccccagaacgttgtatgctcacacccaccctgtcttcccagagctaagcttgggcctggtctcgaggcccttcttagcttgtgggtgtgtccagggtctgcctgagtctttgtattcagctcctcctgggtggatggagaagggcacaaaccggctggcctcatttgcttggcctgccaggatgggaacagagacccgaggcttgtgcttggggcccgggtcatgtggcctctggttacaggcctgtgccccatctgccaacctgactcactctggggtccctgcctaccccggggaagaacagagcctgctttgagctggaaactggaggggtttcctgttccatgttgttaagacaccacttataggactgtaatcccaataaatcatatgctttctgagtgcaacagggttgttttttttgtttgtttgtttgtttgtttgttttccaggctgcaggggcctcttaaaaccaaggccttggctgggcatggtggctcacgcccataagctcagcactttgggaggccgaggcaggcagatcaggaggtcaagagattgagacaatcctggccaacatgttgaaaccctgtctctactaaaaatacaaaaatttgctggtcatggtggtgcatgcctatagtcccagctactcaggaggctgaggcagaagaatcgcttgcaccagggaggcggaggttgcagtgagctgagatcgtgccacctcactccggcctgggtgacagagcaagactgtctcaaaacaaaacaaaacaaaccaaggccttaagaagcttatactctttcattttttaaaggggggaataatagctttctcagtcctagttccattgaggggccttaggagacccttggattgaacaatcaggctcacctgtatgattaacttaaaggcagatgagagagactgttatggcacctgggtctagcatccctattgcagctgaattggccgtgtaaccttgagcaaggcgcttagcctctctgggtttccttttcctcctctagcaatgagaggaggtggtcagggatttcccatgcttctcatataaaaagacccatttccattggtctatttcatgtgctgccctttatgtacacaaagacaaatgctaccagaaagccactgacctttttaagtggctttgtccatctctgggatttgtctgcatgtatgcatatgacggtatttaggttaggcctttgggctgtttgcagcatttgaggacagatcaggggttgctgatcccttgaagtaattctctgctcacccaccctcgccaccacacacgttcatgacccaaggcctctgggtctgtgttccttgctgttgccccttcccttgtgtgagttttttcactgccaaggccaagaggctgcactgccagaaacagtttccagctcacactcgacatagtggttgcatttgttttctctgttttatgagctgggatggagtgggtggtgggcagcctgctggcagacttttgcaggctttacatgtttatacttgctgtggggggaaggcaaagagttggctggactttcagaaagctggagctgaggcatttaatagaaccagattcctatagccctttttgctattatatattttctctgtcaacagacactaaactagtaataatagttaacatttatggagaagttaccatgttccaaatatgatggtaagtattttacatgcatgcttctagctgttttgtgaggtggtcctattatttataaccattttgctgatggaacaactgagaccgggagaggtgaagtaacttgcatagacccacatagctgaactcattgggaatacactggattccaacccaggccatctccctcaggagtccgtgctcttggtcaccatgcagtaggtacagctactatcgtatggagtctgtgaaataaaagcaaaagggctctcacaatgaaaggagttaaaaaccacgaactttggcaatttcttctttaatacaaaatatggcccacagaggatgacgatctgcccaaggttatagagcaagttcagttgtataaaagaaactagaactttctcccagtgaggatgccacagggaaggggtctaggaccttcggatccctttgccaggagcatgcatgcaagccatacaccactctaggattcaccagaccgtgtgccaccaggggcgaaatgccagctctgtgccagcgccgcctgccagcccctaccagctttgtcctagccatcagctgtggtcttccacagcaacagtcctcaaagtgtggtccagggacccctgaggtcccagggactcttgccaggagtccacagggccaaaactattttcataacaagaagttatttgccttttcattcttgttctctcacaagtatccaggagacttttctagaagctgtgtgatatcatgatgtcatcactctgacggcaaatgggacatgagcttgtgcgttcatgtgtttaacattttctcagttttaatttctgatacagccaatatccgtagaataacacacataaacaaaagctctttgaggtcctcattaattttttttttttttttttttgagttggagtttcactctgtcacccaggctggagtgcagtgatgtggtgtgatcttggctcactgcaacctccaccttctgggctcaagcaattctcctgcctcagcctcctgagtagcttggactacaggtgtgtgccaccacaccctgctaatttttgtatttttagtagagatggggttttgccaagttggtcaggctggtctcaaactcctgacttccagtaatccgcccacctcagccttccaaagtgctgggattacaagtgtcagctgccatgcccgaccaatttttaagagtatatatagagtcctgagaccagggaaaaaattgagaaccactattctgaggtatcagatccagctaaggaaaaattcagcaggcagaaaggctgaacaaagggagctttttcagccccgacccggtctcctggctctggccctgcagatatctgcattcgggcacggaacgaccaagctcagcctacgggaaacgcaacaagcggggaatgagaacttctttgggatcttgaggatggtgcacacatcagtcattctcagccttgctccttcaggccctctcaccctggagttctcacacagccacgctgttgcagatgggagtttttaaaggggttttccagaatggccagacatgcaggtccagctcatctcagcctgcccagcagactccatggaattatcaggaaggaaacagtagcctggaacccacagcccatggaaggcatgttcctgagaaagtccatgaattacttctctttttaccttcccacagatcccaggctggggaggtgggtggaccaaggagtaaggcctgaagggatcagtttgggggccttgtttgtacatgtgggcaccagcccctccccagaggcagagggctaatctagatttctgtatattgaaagaggcagagggctaatctagatttctgtatattgaaagtattaatcagttttcattcaggaagcagcattctgggtattgtaagcaggagatgatttaatgcagggagttgggggttcacagaatcattggaggagctcgtggagcagggtgtaggctgagcatccaggaatgacgaactcgcccattaggggagctgctccctgagacagcgcctggaactgtgagtttgaacaacacctctggagctgcagttcaggagtaaagctggaatcaagaaggcgttgcagccaggcacggtgcctcatgcctgtaatcccagcattttgggggccgaggttggcagatcgcttgagcttaggagtcgagaccagcctgggcaacatggtgaaaccccatctctgctaaaaatataaaaaattagccaggcatggtggtgcatgtctgtggtgccagcaatttgggaggctgaggtgggaggttaaaaaaaagaaaaaaagactttgctattgcttttatcatttcaccatcactaccactactctgaagcctcagataggtggaaactggactggaatgttctgtaggaaaaaaaaaccctcagttttcatgacctggtttgctagcaaaaacagacaaagggaacacaaaggtggcctctgcctcccattcacttaccaaatttcatgcagcatatcttaatgataaaacctaatttccagaatcccagctgcaaaggagactgggaaatgcagttttcaattttccacctcaccagccaagatggtaaagtgagggctgaatgagcccagtgtatacccagtgagtccagtgtatacccaccaggactatcaatactgcattttctcaagtgttgagttctaaggagcatgaggcagggggatgaaccaagatgccacctgattagacttcatgatttcccgaattccctcttggatttcccctagtgcagctaggagatgccctcttagagttttagtagccacacgtggtgctttgtcttggctgttggccacaatagggaagaatggctggcaaatccacggattatctttttgtttacacttcagtctccaatgctgatggttgaaataaaggcttttcctgcaatcagaaggactgatatatagaagcatgtctgtaagcttgccttccagccctgtaatataagaattgtgaaatctaaaaatatttggggggaattgggcatttatgtttaagggaactcttataaacagagggataattcatgaatagattgttgtttcttcctagactacacaagatccccccatagaatctcagcttcctactctaatgagtcaacactaggctcttgaaaattatacaccattcttttctgggcagaaacatgacttggtccataactgaaaacctgggtacactatagtaagttactgatgttcatccatactttttgtcactcagcaaaactttctactaataattttgtttgtttgtttgttttcttgagacacggtctctctttgtctcccaggctgcaggggagtggtgcgatcatagcttactgtagcctccagctcttgggctcaacctgtcttcctgcctcagcctcccaagtagctgggactacaggcgtgtgccagcaggcctggcttcagtgaacatttattgaggacctgccatgtcaggccccaggctggtcatatttcagagaatacagagatgaggaagtcattgttcccgtgcttagaaggaacagtctggttaggaagacaacatgcattcatggctattgctgtaaaggaaagttttcagtgatctcagagcaggaagatatttctttctctttttttttttttttttttttttgagacggagtctcactctgtcaccctggctggagtgcagtggcatgatctcggctcattgcgatctctgcctcccaggtttaagcgatacttatgcctcagcctcctgagtagccggaactacaggtgagtaccaccacgcccggctaacttttgtatttttagtagagacggggtttcaccatattgggcaggctggtctcgaactcctgaccttgtgatccacctgcctcagcctaccaaagtgctgggattacaggcgtgagccaccgcacccagccccccttttttttgggggggtggggagagagaatctgggaaggcttctgaagcaggtggcattggaatggagtcttgaaggataaataggatctagacaagcaggggtgagagctgttcgttctcatgcatagatgggagcaggcagggtgggcctgaggtccatgagtgctggtggtgtgtcctggtaacaggggtgagtcacggcaggagatagggtgaggtgaggttctgggagtccttgagggccagagatagtgaggctttactggcctgtggccctccccttcatacagattggtatgctcagtggaccagttaagtggttcaaacccaggaatattggaaatgacagaaccagaacatcagaataccttcccaaaggaaagacctttaagatcacttctgattacagaaaatccctaacttatgatggtgcaacttacaatttttcagctttacagtggtgtgaaagcgatatgcatttagtagaaactacttcgagtacccacacaacaattctgtttcactttcatacagtattcagtaagttacactgatgttcaacattattataaaacaggttttggcttatataatcttgcctaactgtaggctaatgtaggtgttctgagcatgtttaaggtaggctattcagtaggtgaggtgtattcaatgcgttttcgcttaggatattttcaacttactatgggtttattggtatgtaaccccatcctaagtcaaggagcatttatatttgtttgccactttttaaaataaaagcattctttgccctcaaggagagaagaaacttttagaactctggagatgacccgagcttttggagacctgagataggggttccgagggcagcccaggctgactccctggaggtggcttacttcctagccaaggagagagaatggacatcttttccctggcgggagcacttagctgcatgtcaaggggagagaccacagtgaccgcacaggcgggacgctccaagagccccgagggagttggggtggctggaggcctggccgcctgcccctggctgcctgcccgctccctggcttaatttgtaaggaaggacaagagtggcatcgggaagggctgggaacaggcaggagccgggaggctgacttttgggctgtcatcagagagaacagcatgagtgagggacagggctccagggctgccttgttcctgtgatggagcagggaaagagctccgtccattctgggcagagcaggtgggtgtcccacgaagtcatgaagccacaggctgccatccgggcccctcggtggcggggaggtctgttggacggcgaagtggtctcctgagggggctccaacacggagccttgccagagctggcagaggacagaaacgcgtccccgccccccagctgaatctgagccgctcgccgagggcaggggcgggcgcggcctgagccgcagtcagggcccagcacaggctgtgcacatggcgtcccctggtggcacagagcgggcctcatgagcggcgccccgggagtttgcagctctaagcctgccgccgcctttccctgcttttgtgggctcttagtgatactcggacccgctaggaccattcctccctgtgggacttgaagccgctactctttttctttcttttttttttttttttttttttttttgagacggagtctcgccctgtcgcccaggctggagggcagtggcgcgatctcagctcactgcaagctccgcctcccgggttcacgccattctcctgcctcagcctccagagtagctgggactacaggcgcccgccaccaagcccggcttattttttgtattttttaacagagactgtgttagccgggatgatctcgatctcctgacctcgtgatccacccaccttggccgcccaaagtgctgaggttacaggcgtgagccaccgagcccggccgaggccactactcttttctgagcaccaaactgggggcaacctggcctggcacacgaagtggtgtcagcccacctcagtctaggtgccagatgaggaaggagtggtcattaatgttgtacaacagcctaatatgcatcatcccatttggcctcatgacagcctccataaggaggtatcacacgtgtgctacagatggagaaccagactcgagtgtgcttgtcggaggggatggtgacctgaccctgctggtggcagccctgggtttggacctgggtctgtgagactcttagctgtgcagcctctcccctctgcatagaagaacacttggcgaccctgactgaactctttggagggggaaaggtccccaattccacacactggggaactgctccttccctgggccacctgagggccctcaggttctgctaatggcccatgatggaaattccttctgtgcattgcaggtagtcggggtctctgtgagcagaaagagcaggtcccttgcaaggggtgatcagccttggttgccacttgtgagcatgtgtgtgcttaaggggtcccctgctgcccttcagggagcactctctctaggcctgaccctctgctgcccagcagggagccccccaccctaggactgaccctctctctgctgccccacaagaagcaccctcccaggcctgaccctctctctgctgccctgcagggaccccaccccaggcctgaccctctctctgctgccccacaggcccttcatgctgctgccgcccctcatggagtggatgcgcgtggccatcacctacgcagagcaccgccgcagcctcaccgtggacagcggcgacatccggcaggcagcccggctgctgctgcctggtctggactgtgaacctcggcagctcaagtatgaaccagggaggagggagggccccggcatccatgacctgcccccagcggctcccctctgctcgcttcttccccagatggctgggcgggggtcagagagcaggggctgcagcacatttgagctgttctaagggtgtcctctgcaaaggccaagcctgagtatgggaacagatctattgtagactttggctgctgtctggaaacgtctcctgcagctgctggtctgctacacagaggagacacacattgggactggggcaggagagcccacacatctaactctttgggatacttggggactgaggggcagaagtgggcccgttctttcctctgttcctgtaattgacaccacatggagcccttcctgggtgcaggtgctgtgagcccttcctctttatgtgcattatcttagtcctcatgacaagtgcagggaagaggcaatcatgcccatcttacagatgaagaagctgagggtcagaggggaacagtagcttgcccacagatactcagctagcactttaccgtgcccagatttgaacccaggtccatacggcctccaagcctgtgctcctaatttccttccctaaatgcctctcacagtagacttgtttgctgaggagcttttctagagaagcgtccctggccatcctaggcccatgagagccttttatctatctatctatctatctatctatctatctatctatctatctatatacacacacacacacacatatatatatatatatatatatatttttttttttttttttttttttttgagacagagtttcactctgttgcccaggctggagtgcaatggtgtgatctcggctctctgaaatctctgcctcctgggttcaagcgattctcctgcctcagcctcccaagtaactggaattacaggcacgcaccaccacgtctgggtagttttgtatttttagtagagactgggtttcatcatgttggtcaggctggtctcaaattcctgaccccaggtgatccacccaccttggcctcccaaagtgctgggattacaggcgtgagccactgctcctggccttatatcttttttttaaccctctgccaaaacccaggttatggcctcctctgtcttcatacggaaggcccaaaccccattctaggacatgaattttctacactttggcccaaccaaggctccagaccaaagctgccaactggacgtctgtgatgcgccccctataacacaggcattatctgtgactttccttgtaggttgcgttgattgcaaatggcagtctatgctactctctaccatctctttggtacttctgagcctcaccaggaagccttaaagagagagaatgtagagctaaatactagaacctggccatggtgaccgtttataggctgagtgcagcctgctcaacacaaacagtatacagccaagtgctgaggcatgagtctgggtgggagctgcttcctgcttggggcagacccataacagattgttttacatgagtctttgttttctgccagttgaagcaacaagggctcagaacacttacttacttacttacttattgattgattgattgagacagagtcttgctctattgtccaggctggagtacagtggcacaatctcggctcactgcaacctctgcctccagggttcaatttattctcctgcctcagactcctgattagtagggatacaggcacatgctaccacgcctggctaatttttgtattttgagtagagacagggtttcaccatgttggccaggctggtcttgaactcctgacctcaagtgattcacctgccttgtcctcccaaagtgctgggattacaggtgtgagccactgaacctacctcccaagcaattttttaatgtacttatagaaaagcagaaatgtgtgctcttcatatgacagaacatgatggggacagtaattgctgatctgatcataactccctggtgcttcccacccatcctcatcctcactctacacgtaaagctcacacatgtgtgtcacatcattgaaagttgctgtctgcatacagtcacacgcacctttgggtctcttctgggcagacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccaggtacgtcctgagagctccacaaagacaggcacgaggaccagagttgggaattctcagctcccagcattggcggccctctgtcctaaccctgagatttgctcagctctgtacttcgaaaaggcgggctacctccctgaatcctgccctgcctggtcatgtggaatgtcagcttggagacttctagtatcccttggaagaactttgtcatgtggcttccgcttccctggctggacagctggccactgtttcaggtggtgcaaggctaggaacgagtctgggagagtgagcttcatctccagctagggacacgatcgctaaccctgtagtacagcctattgtgtgccaactacttgccagggcatggaaacccttgtcctcatggagataccattttagtgcaggagacagataagaagaaacacagacatgtaaaatgtagaggatgttaaagtgctgaggactaaaatgaagcatgaaaatgggtaggaaatgtgggaggtgatgtagttttagataggctttaacttgagtttcgcatctgttttgttttttacttttgctgtgaacagctaccatttatatagcatttactatgttcgatgcattgttctaagtgcttcacatagattaactcacttcctcttgacagcagccctgtgatgtagcactattattttccccattgtatagatgaggaaattgagggacagagaggttgctttacctaaggtcacaccactagtaaggagcagagctgggtggagaatctgagcagctggacccagcctctcaaccactatggaatatcctgtgtgtttatttgacactgtactgagagcacttacagtgtgcggaagggcactgtggggtttggaaggccacacagagcatggggagttagatgacagtggcgagttaaggcagtgttctcagatgaggtgacggcacaatgcagcctgtgatgaaactccaggcagaccgtgaggccagggtggaccctgacagatgggatgggctgcaaggggaagcttcctgctggaagcggttgagccgagcctgggggagggcaggatggggacggagcagagaggagtcaggaagggattccagggaaagggacataaggagtgtggggtggggcagtcagggcgtggacccaggccaggggttggggaaggaccacaggcccagcactggacttccagagggcagtggcaggtgacaggctgctgtgggatctcgtgggggcctctccgtccacacaggttcccgggctttgtgggagcttttgtcccagtggagtcttccttcttgaacagcacagtgtggaagcccgtggactttagcttcagatagacctaggatttagtggccatgtaagagctgtagcatcttgaacaagttactctgcctccctgaggcacttcagtttcctcccctctaagatgggggatggtagcacctgacacatagggttgggggaagtctgcatccagcacatagtcagcactcactaaatgttcattccggtttttattgccaatatgatgattattgtagtcgtattgctgttgatatgatgatgatgcctgatatctgcgagccggcctggttttatttggcctctttatatgtctggagtgcgtggggacagggacaagggaaaaagcagtgtctcctcaccgggcccgtcatttggtttaaactccaaattgtatacagatgtgtggagaaaaaagtaagtcaagtctgtccgcagggagatgaaacaaagccaaatttttattctgtggtgttggcctttgtctaagtgctcaatcctgtttgttccctaaaccttagtatttatagaatgatctgtgggtaaacagctctctcaccccatgattaatctcaggccattgctttatctctggccactaggcaaggatttatgaggtaaggagatcttgtctacacacaaatatcctaataaataacatcacgggacaccaggcaaacacttgctgggatccagccgtggaataaacagtttgcactgcctttgctgttgccggccacagaggaggattcccagccagggaggcggccccgccaactgcccacctaacccagggagacagcaggactcagcttgcaggaatgctctgaactgctcagtagcagaagatgttgaagtcaaatgcctcctctaccgtctcgtgggacggcgcaaagcttgggcttcacagcttatggaggcctggttcctgccccgagttcaacctctcgctagttgtgtgactttgggcagtcagttccccttctctgctcctcagctgtaaaatggggaggatgggaatattacgatgatggagggagatgctgcatgctcatcactagcagggtgatttccatgcacagggcctgggatggcggctatgaggctgtatggcatagtagccatgagagtgttgttggtattttaattacatagctcttaatcaaggtaagctcattctgaactaagcactttatacatattaatccacactctacaacaaccctttgagggagataagatactgctgtggttccccatttacagatgaaaaaactgaggcacagagagggcaaatgacatgtataaagtttacagctccccatggcagaggagaccttggcaccgagcctggctgcacggcctgtgctgggccctgctccagtgtcctgcagtgctcatggcagtgcccccactcaccttccccatgccctgtgcccagcagcccaggaagcacagagcctgggggaccacaggatgctcggctggggtggcggggtgcccgatctgtggtttctggggcagaggcctgtgggcacatggtgttgtgttctgtttgcaaacagtttagcacgtgcatttgatttgctcagggtatgacgccactgatgtacgcctgcgctgctggggacgaagcgatggtccagatgttgattgatgctggggcaaacttggacatccaggtgaggaagccccacagagctgcacccaggccctaggccagcagggatcactccgagggctccaacaaacacgctgggcgtgatgttttgggcaactgagtagatgtgtgtcaaaagaccggaaagacaagatgcacagaggccactgttagccagggaagtctcctcaagatttgggctttctgtctgaaaaggagtggactgaggcgggagtgagtggagagatgggctgtgattctgttttcatgatatcttcctccttttaccagcctaatctccagccattccttccatccccaaatacttctagctctgcctccctctgaagcataaagcactccccatctgccctcttttgcccagggcagacattgctaattaaatacctatcctctctttttgagccttgtccactttgtgctccaggcaaacattatcaatcgaatgtagaaagcacttgttaactctggttcaccatccctgcagggtactcccttcgctcgggtgcccagaaaacacagatgatttgtggtattttccaggttccaagcaactcccccaggcacccttccatccaccccgacagccggcactggacctcactgacattcgctgtgctgcatggacacatctctgtggtccaggtgagctcctgccaggtgaacaccatgccccccagcttaccaggtgacctgggccccaagcacagccccagcctcagctgagtgggcaggtgccctgaatcagagatcccaaaggcactgcttgaggccagctcacctgatcgatagagcagcagcccacctgagttgcctcaaggaaaggggttagtgcaaggacaaatggaattttaggaaacaagacccaggtccaggcagcactagggtcctgtcatgccctcccggcatctctctctctctcgtgtcgggcacactgggggctgtcccagtcccactcagctttctcgcctacagccgcctttccgacccttcccttttctcctccctcgtgaattctactacagggccaactctatatcatggggtctgtgcaattctgtcccctccttagttcctgagagaggtttcggattggcatggctcacccgtcgagccaagccacaggttgcccacctcagctcaggtagctgtgctggcgtggggacagtggtggttctagaagcagaagctgtgggcagagcagctccccatgccagcaggggctccagccacgtgcacttactcccaggtcctcagatcgctggcatgcgcagggtttcatggcaccccttccagggagttagcgtgacaccctcgctccccactaggttgcaagacctctgagggcagggattgtgtctggctgattcacagccctagcctatcacaaggactcagcgagtggctgttacccactggccaccacatcctgccgcctttgccttataagaaccggagcaaaatcccaacctcagttcagactgggcctgcagggctgtgccctgagcttgcctggatccgtgcctagttttgccccagtgagcaggcccccgcctccacggccttggcactggtacagggagtgactgatttctgactgctgcatctccagtgatgtctgtcctccatgccacagtccatgggactgagaggtcagcctgaactccactcctggtatccaggggaagggcggttgggctcccctagactgccatgcatgcttggaggaagctttggtcttcaggagcctgggagggctggaaggttgctccctccagagcagctggtcagggaaggtggaaagggagctgaaagtcaccagttggagtaatgcaggccccacccctgccccaaggcagagccaggaccggctcatctggaactgcctggtatctgttaaccctgccccgtctgtcccctgtcaaagcccgcccttgctagcatggggagaggccctctgctgtcctagactgggacttcctgcttcagccccaccacctgccttcctggggtacctgctgtacctctccgacaagaagcctaagggaagcaagcccctcttcccattctgtgaatgaggaagactgaggctctgggagttgaagtacctgctcggggttactcattggccagtggccagcactgacaccctgctccttctgactccaacacgtgctgccacccagagccatggtttaccatagattgcgggcaacattttctgtgctgctcatccacatgtgttctcagaaaggtggctgcagtcagttcatgggaaagcatttgaaagacggaaaaagctcagaggtcctcacagcttaggggcttggtcttggaccacaataatggagttgaagattctagaaactttgagccctgaggataacctggagttctaaagttccagttcctcagctgctggggtgaactgtgtcttggtcacatgcctggagagaagcaaaggccctgtccccgaaagcaccctggcccttcccaggtgctccctgccacgctgagcagtgccctcctcctctgtgcccctggcagttgctgctggatgctggtgcccatgtcgagggctcggcagtgaacggcggcgaggacagctatgcggagacgcccctgcagctggcctctgcggcaggtaggcacctgctacccggaggctctgtctacccttccctgcagtgccccccagcctggccaggcatgtagctggacgtgcaggggtctctttagcacacacggaccccatgcaggggccttaaaaccccttctctggaccactgggggcttcccctggccccacccatcagtttctgttgggctcagcatctggcaggacccagcagggcagggaggcccttccctctggagacccagggagggggagcaggggcagggcacggccagccttcttcctctcccttcacttcgtccaccaaatgcagatgagtgtggggtttactgacttattccagcactcagagctgcgagaatcctgctctcccttccctttcgcctcagctgccctggcggctactgtctcagtgtcctccgtgctgcccaccttctctttcagggaactatgagctggtcagtttgttgctgagccgaggcgccgaccccctcctcagcatgctggaggcccacggcatgggctcctccctccacgaggacatgaactgcttcagccactcagctgcccacggccacaggtacctgcccgggattcccaccctgtgtgacatgagggcactgaactaagctcacaggagcctcagtttccccgatgggagcaaaagagctaggcccggagacctttcccaaaacagggggcctgtgtgctagtaaaccagaaacatgggggagtttagcctgcacagggcccagagatgggggaggccccacagctgattcctggcagacctgggactggagcctgggcctcccgacgcccagggcagaccgtcccatttcccagtgagatgccactctgcagctgccagagcccactcaggaccacattgcttcccatgcctgctggtggtcctccagtgcccaagtggccttggacgtccaaatagcatacggctcagctgtgcagaggcttctggtgcaaaattgcaccctgccccaggtgcagatggtagagcttgctttgtggggaccaggcctgcccaggggtgtggcgggacagcagcaggctgaagtcagggacagcacggaggggcaaagggagaccagacaagggcttattacagggcagaaacggggctggaaaagcggggctggataagcagggctggcaggcaggacacttacttccagttccccgacaccattcttgccaccagcctcatgttctggctggggtcccctcccctagaatgcttttctctccagctgtctccagcccacccccacattcacccaccccagccaccctcaccctccaggcgccatctttcacatcaccacctctaggccgctccaccccacccagtgcctgcatcccccatggaggcctcttcaccctgcgtggagactgcctgcctgctcatctgcctgtcactctgagcacaggacccttgggacagtcaccgtggctagttcaccttcacatgccagcgcctggcccaaacaaggtgctctgtaaactgcctgaactagcaagtccacacgtgaggaggagcccttgggagggaccttgggtccttggaagggcacctccaggccatgggcttggcaggtaggaggaggatctgcggggtagccgtggagcaggtcagcccccaggaaccttgcagcaccacccatgctgcatccatcccagagccccaggccacaggaggtgacagaatgagcctgggtcttggagccagaagtcctgggtctgtacccccacctggagtggccttgagcaagatggatccatcgcctatgacggtgatgtgtctgggctctcacgaggctaaaagcagcagcacgggggagcgtcctctgtggggtctaacattctgtgtcttcattcataaatatgaatacattctacatgacatccgtcttcagttcatccttatcaacatgaagggaccaaatgagtacttactgggctcttcctgtgttttagacactttcacgtgcatagtcagctgctatttagaaagacctgctgtgtttcaggctctgcatttaaaccctttacatcagcctcacataagccccaggaaagtgtgatatagtgacaccctgtaatatatcccaaagcagtcagggctcagagaggtagagtgacctggctaaggtcacacagccaggatggcagagctcgctcagccccgaagcctatggcttctctgcaatacggggatggtagaagggtgggttcccctgcaccctgccctgcctctcagaggtatatggggattggtgaccctgggacccctggcctgcctggaggaggaagaccatgaaactccgagccctcgggtaccccagagcagcccgtcggggcaggagggcactgggggacagctcaggtgggcactgcctgtgggacttcagccctcaccttcattcatccctgggcctgcaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggtgaggcctcacgggcatgcacacccatgtccatgcatgcatatggacacacacggtcactccctgctgctcttcagcaggcctgagagggccagggcctgcagggacagacaagccccagggcagctgagcacagactgggtggaggctgggacccccctgctacacggccagttcaggaggggccctgggcctcagacagtgctcaacagtgccacgtcttggggtcatggcccagtcccctgccctcgggccctccaccctgcctggctggagcttcgctgccccctccccagtcacagcccagggatgtcgagcactgggagcctctgaagccccgggactccacgctgtgaggcggcagtcctgtcactcggctgaccttgcactccttgggtctgcgagtctgtggacttttggtgtcctccagggaggctagtcagacagacttaggtcaggtcctgtgttagctgcataccacgtcctctctccaagcctcaactcccacctctgtggctttggtgctaatgatccttatctaagaatgaggtgacatcacctgaagtacaaggcgtagtggccaccgtgagcacttggtggatgacagcaccgtcactgtcatcacaaggccacaaacccccagggccgggccaagacagcagtgagtcagcctcagtgttcttcaccgtaaaacagagacgtcactcccacctgcagtcaataacccaaggatactaacacaccacactactgtcaatgtgtcgctggggaatgccgtcagttctttgatccacagtgaggttggggtaagaagctgtctctctaattaccagggacaggactagtttatgtcatgaacttcccacagcaatgttaagttacagccccactgacacatgctggggaactgtaaaacagtcattatgtgcctggggatgtgcagcggctttccagtgctctgtgtgctggagagcccctcgtgataggaccgggttcgtttcaagcttccgtgcagacaaggaggcctgtgtgtccttgagtgcctggcatattctctggccatccaagccctcctggccacccctccacaactaatgagacctctctagcaagtaattcttgagcccactaagcaacaaggctactttgggtgctgggcccatacttccaaatccccaggctgggcggtcaactttcagagcttgagttccctgcatttgggccgaagccattcctccacctcatctcatgagaacctgaaactccactctgacctgccagcaagacctattagaatgaattaaagctttcattctatggccatcctgagagggccactccatgcccaggaagggggcaggcgggagggggcgggcggggtgctctgcagacagcgggggcatcccgagagagtctgcccagaaaaggctgtggtctgtgccgggagcgctcagctgtggtgcgtgactgcctgcccttccctgcctggaccaggagtcccctggaagctgcacatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaagtaagtgtggccagtggccagttcccaagcccacggcccagactcagaccacgggacacacagatggacacacaggcagacacgtggacagacacagggaccccctcacccaacgcacacacactcacacgcctgccctcagcacccagggacccccccacccaacacacacacacgcccgcccccagcacccaggcccccccccccactcaacacacacatacacacacacacgcgcgcgcgtgcacgctcgcccccagcacccaggaacccccccacccaacacacacacacacagcacccagacttagacttgcgctgcctggctgtagagggcaggggccatgggctggaacctgaccaaaaaagccatttcgggaatcactgatgaaggaacaggcatctcttgccaagccacatccagcaggaacaaaagatagcggctgcactactcctggcctggacttttgaaattagcctgacgtatctgcatctgtgaacagccagccacagcgggcagctcacaggccctctctcctctccccacagaacgactccgtcatccagcaactggctaccatcttcacccactgctatggcagcagtcccatccccagcatcccagagatccggaagaccctgccggccaggctaggtgaaggcgcgccccctgcgccctgcatcaccacacgtcctccccctcttccctttcctgcttcctccccactttgtcatctttctccatttccaagcgccaaggccccagcctcagtttctctgttcctcacctctgtgtcccacccccaaccccagacacgcacctcacagcacactcaagcaaaccccagcaggggactcctcagccatatccctctgtctccccgcttttcacagatccacactttttgaacaataaggagatgtcagatgtgaccttcctggtggaaggaaagctgttttatgcacataaagtcctgctggtgacagcttctaacaggtaggcagcctcagataacaaactcccagcccaggggcacagaagcaccttgtttcagattccaggtgacagagagtgactcgctggggctgtaccctgcagcctctgcccctcagactgcagtcacattgcagcagagccccactcgccccacagcgggatgagacggggtggacccagggcagcaggaaaggggggctctgaggtggtgttctttctggcctagttattgcttttattattagaaaacataaatatcctggaatgaagagtcagcattctggccacaggcgtcaggtcgcttgtagggtgggtggtggggacagaattgggctcagctcagatgtcttcctaagatggtgtaaaatggcacttgctgaaaattattttaggagcacagcagtaatttttaaaatgttccgtcttgtggtagccggtcaggtgacagatggtgccatcgccacacagtggtgaagtaaaaggttcaaaacccaccttgctttgtctcctttgctccaggttcaagacactaatgaccaataaatcagaacaggatggggacagcagcaagaccatcgagatcagcgacatgaagtaccacatttttcaggtgtgtgggtcttggtgccgccctcttctcagagggatgaccctcccccaggagcccaccttgtgggcagctgtgcattggttgtcattgttcactctattcccagtgccttctgtattctgttgaatgaatagagcatccaggtctttccctgtgcagaggtagccatccgttgtggggctgcagcttcagagcctgtcacatgggtcctgagctctaaccgctggacaggtggtctgggcagcctgcagacagacgtgcaaggacagatacaagccacacagctggggtgtgagtccttgttatcagggtgggctcccagccaatgggcattactgagagcttgttggaaatgcagagccccaggccccaccccagccctcctgcatcttcacaagctccccaggtggccatgtgctcagtgcagtttaggaagtgctggtggaggctgcgtcacttctcccaagcatcaaaccccggccacattggtcaaacacgtggccgtgaggcacacatcctgactgtagatcaaagtcaggtctttcgggctttaagctttgcagaacatacaaggttacatactagaaactccagtcagggcagacaaggtccagaggaagacctggctgggatctcagctgaaccccactgagaggagctttctagaaagtagcaactgcaggtctccaggctgtgtggtgggctcagggctgcaagagctgacccttatgggctgggactgaggccaggaggcagctggcaggtgggtctagggccttgccctgcacaggagtggtttgtgatataataggagagattgcaaaccccagagtctcacagaagcacatggggccacctctaaaatggcttttttttgttttttttgacacggagtctcactgtcgcccaggctggagtgcagtggcatgatctcggctcactgcaagctccacctcccgggttcacgccattctcctgcctcaccctcccgagtagctgggactacaggcgcccgccaccacacccagctaattttttgtatttttaatagagatgggatttaccatgttagccaggatggtctcgatcttctaaccttgtgatccacccgccttggcctcccaaagtgctgggattacaggcgtgagccactgcgcccagcctctaaaaggttttaagcagtaggaggaactcaccattactaacacttaggcaggcagggttctaagtgctttgcttggtttccattgaggcctcacagcacagttccagggaggtaggtatgttattatcccctcttggtagaggagtcagaggcatggagaggttgagtaacttgctcaaggtcacatagctgggaagtgatggagacagaattcaaacccaggatgtgcaaaacagccaagtttgcatttgcagcggtaagaagggatggaagggggcatggccacctccaggggaccagttaggggctgctgaggaatccaactgagtgacagtggtgacctggattggcagtggctggggggatggagggaaatggaccagggaagagtggatgggacttggaacttggtaactgacggatgtgggaggaggggaggcccagggtctggcataagccaggtggcgtctccccttccctcttttctcaccccttaatccaactcactggagaatgggcagctttaggaacatgtccaggtgagtgggagcaggaggtggagtcatgctcagatcaggcaggaggcaggtcctagaggggctacagggatcgctggagactggggagcgcacttgtggccatgggtgaccactgcctgtaaggggacctgtgcgggctcagtcgcctgtgctcacctgccaggccaagggagggcatctgtcatagaacaggctcagcagccccttggcacctcccggggttgctgggagggcaaataggggacaggcttcaggtccacagcacacacatgccttcccctgggcctcttgccaagttctggccgactgttctaactaggcccagggcactggccttgccccgtgggtctcctgggtacagaattttgccatatccagggcatcatttcagatggggcttccagacctcagctccgactttccgggcctccctggaggggtcagcctgaagccatcagtctggggtcagggctccctaacaaagcctgcaagttttccagcagcccctaaataccgcattgactctcatgcaggcggggtggggtgggggtgtgtggatcattattttgttttctggaggaggaaacagaggcccaaggacatctagacagtactgtcggatacagtgtgaggcatacattgtaattaaaaatttactactagtcacataaaaaataaagagcaggtgaaattgattttaatatttttgaacttacagtatagccaaaatattatttcaacatgtaatcaatgtaaaaagttactcacagccgggcacggtggctcacgcctgtaatcccagcacttttggaggccgaggtgggcagatcacctgaggttgggagttcgagaccagcctgaccaacatgtagaaaccgtatctctactaaaaatacaaaattagctgggcgtggtggtgcatgctgcataatcccagctacttgggaggctgaggcaggaggatcgctcgaacccaggaggtggaggttgcggtgagccgagattgcgccactgcactccagcctgggcgacaagagcgaaactctgtctcaaaaaaaaaaaaaaaaagttactgagcatatagcccagagggccccaaccctgcccttcccacatggtttctgcagtatcagcttccaagtggcccactcaggacagaaggaaaccctgctgcccttctacaggtggtcctgtctggggcctttcctcaagcagcctctagccccacaggctgcctggctccaggaggcacatgacctgtatcctgctagggactgccaggctgtgcaaaattcacccacctctgcctgctggctgcccagctcccatagcaaggctccaggtgagccgttctgatctgacttctgtggcctcatatgcattcaagtggcctcagggagatccatgtgccacggatgccaagactgggccttgccaaaaccaaatcctaaaatgcagcaggaggtagccttccaggccaggaagggagctgcagcctaaggtggctggtaggcctggccctaggggctgccctgaggccatcccttagcaaagaatcccaacaggaagatctgacctgcctgcctggtgctctaaccccaaccctgtatgaggggcattccaggcactgctcctgctggtgcctcaccttactgagcactcactcagtgccctgcatggggagggcagagggacctgggcatggcctgcccaaggcacacactatctggagggagcagacggacacttactgtgcaatcatgagctcaccacccaggctccagcaggggctgcagaaggccgtgggagcttcccagacctctagaggtgggaagaggctgacatctccagggtgggccttggccaacatctcctgatgcctgaacaaggctggcaggcctgtctccccacttctctccccacagttgggccttctcctagaccctctggtgcctctgcagcctcagggccggtcttgacagagcccgactgtgccggctggagctgtgtttacttacacacttgccagctccttgctggagccgtttcttcagccagccagaaagaattgtttttctttttccaactgggaacctcactaggctccagcgtgatggcagagtttgtaactgaaacctcagcagaactaaatcgttcccggtcctggaccacctcatctgggagcccaaggcagggctcagcctgtcgaggggagctccgggcctccgggcctccgggcctgggctctgcgctttctttttgaggaagcacacctgagacagagcccagatggggcactcacctccacattggagtccttgtgcaaacaggggaaggcaggaggcagcgtcctccaacatcccttcagagaccctcccactgctactccctgtgtagaatttagatcacaccagcaatgagccacacggggccaggcatgatgcgagagccctgctgcaggcatcaggggagctgaaggacttgagccaagtcatcttccttccctgggtctcagtttccccagctgtgaataggaacttccctcctgggctcaccgtgttctcatgaggattgtagggaaaacattccaaggagagagcctgttatccgggcagggactcaggagagagggtcttggagttggcttccccgggaaaacacaagtctcagcctgagcaggagagggagggagagacagagctggggacctgcagagggacaggcccctggaggcggcagctggagcagtaccctgtggggctggcaaggactttcatgcctcaggttcacgtggcattcacatgggcctcttcccaccacagatgatgatgcagtatctgtactacggaggaacagaatccatggagatccccaccactgacatcctggaggtgagactcgggagagggggagggggcctgggctagggtgcccagcggctcggtctcccattcacccccttcagagggaaggtggctcttcctctccatctgacaggaagagcagttcccagaaagaggaactgtgcacaccactgagcccagcctcagtgcgtgtcccagcggggatggttaggcccaggagtatcagaaggtagtggggcctgagggtggaggcagcagggcacacggcactcgggagctttctgttcggtgctgtctgggccactggtctggccatgggtccccaagacctgctctgcctccctaccagctgctgtcagctgccagcctgttccagctggatgccctgcagaggcactgcgagatcctgtgctcccagaccctcagcatggagagtgccgtgaacacctacaaatatgccaaggtgagggccaaggatgcctgctggccacctcccaccacatgctctgctccacgggggcctcggccgtgtggctgcactggggatgagctaggagatgcaggtgaccaggctgcttctgagggcagtgtagaggctgagggagggttagcaactccctgtgttgcctggggtcactgctgcccactggccatgtggtagcttgggaggtgagcttttgagccagctgcaccctagttcacattccagctctgccacctgggctgtggtagctggacaagttgctgagcctctgagtcaaatcaaagccataggtatttacttttctcccctacctgtctgtgcctccctagctgtcccatctcaacaatcaacatggtcactgctcagttgctcagactcaaaactcaggaatcatatttgatttgcaaaaaccctcccatatgcaagccacccacctctgaaacacaccagcggtttctccacttcccttcatctccactgccctcgccttgccctaagccaccaccatcactctcttggacaatggcatcagcccagcctccctacttcctggctttagccctgcaatccacaagcttctttcaaaagttcaaaaaccatggccaggcacagtggctcacacctgtaatcccagtactttgggaggatgaggcaggaccaggagtttagaccagcctgtgaaacatggcaagaacctgcctctacaaactagctgagtgtggtggcgtgcatctgtggtcccagttgctcaggaggctgaggcaggaagatcagttgagcccgggaggttgagactgtagtgagctgtgatcatgcgcactccagcttgggcaagagcaagactttgtctcaacacaacccccgccccccaaaaaagtacaaagactgtgttactcccatacttaatcccaccaaaggttttccacctactgcaggctaaataatagccagcccttatcatgccttccaaggcccccaaggtcctgcccacatctcccctcactctgccatgcttccttctcagcgtgcccagaccccaggacttttgtgacacttcccttttcctgtaaagctctttcccgcccttcatcttcacaactggtgtccccaggcctcccctggcctctcacaagccatcctgtcacgttggctttacctccttcacagtcttctgcagttaccttgtctttggttcctcagattctgtctgtctctcccaaactaggacatcagcagcactgcagagatcttgacctcagaactgaaaacccagagcggccccttgatatgtgttgagtgaacatctttatccagcatttaccatgtgcacagtcacatgccaggcctggtgctgagccctggacacccagtggtggacagtccccgttcccacccttaggaagggaacttccaacccaacagggatgactgccacttaacagggcagcatgacagtatgacacaggcaggaaaatgacgggggctgaacagttcagatatagcagaggtggcctcaggatgcagggacagggaacgcctaccctggccagagtggggcttaatcagggctgtggccatgggtaggtagtatttgggggtgagggtgagtggggctgtactaaggcgatgggcttcacccctcctctctctgccctacagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactcccccggggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatg

SEQ ID NO: 37907 - DNA, 837141 bp, Homo sapiens; identical to SEQ ID NO: 36860

SEQ ID NO: 37908 - DNA, 633367 bp, Homo sapiens; identical to SEQ ID NO: 36708

SEQ ID NO: 37909 - DNA, 968 bp, Homo sapiens
gcggagtctccaactgggagagctgcagctgccgagaggaggagaacgctgaggtcggtcggaccaacggacgcgctgaccgctgccaactgcagctcgcgctgcctcctgctcgcgccgtgccactaaggtagtccgcctttctatgagccctccccaagattagctgggtgcggggtggtgggagccgttctttggtggctgaagcccctctcctgctgctcctcctgcaggtcattcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctcctaggaactgtgggagaccagcggagtgggagggagacgcagtagacagagacagaccgagagaggaatggagagacagagggggcgcgcgcacaggagcctgactccgctgggagagtgcaggagcacgtgctgttttttatttggacttaacttcagagaaaccgctgacatctagaactgacctaccacaagcatccaccaaaggagtttgggattgagttttgctgctgtgcagcactgcattgtcatgacatttccaacactgtgtgaattatctaaatgcgtctaccattttgcactagggaggaaggataaatgctttttatgttattattattaattattacaatgaccaccattttgcattttgaaataaaaaaactttttatacc
